United States Patent 7,868,149 (PLANT GENOME SEQUENCE AND USES THEREOF) - sequence listing, part 32

SEQ ID NO: 16218 - DNA, 6463 bp, Oryza sativa
  unsure (1)..(6463): unsure at all n locations
taattcccccccccccacttaattgcacgcgggggcggcgggatgcggcggattcggcggcggcggcggcggcgctcggcgcgggcggggcggcgagagcggcgggaggacggggatgacgggtgggccccacccgtaagcgagggtggcgggcaggcccgcccgtcagcggcacgcacgcggggagagaccgaatgggctgcgggggagaggagagagaggaagggagatgggtcggattcggcccatccgaggggagagagattttagggtttttctttttataaaaaccttttcaactttttttatttcttaataattattatttgtgctctgaaaatttaagtaaaatttgagggctctttttagaccaaggagaatttaacaaaaattctccgggtcacattcgaatttttcttgtacgcattttaatgtttgccaatttctttttgaattttaattaattttattattccttttagagaatgatttttatttcgggatgaatttattaggacgtgacaaatttgatcccaaaaataataaaaaccgtgggtcctacatgtcggtctcacatagaaaataataataaaaatagtgggacccacgtgggcctgagggcactcaaccgaggccgtagaaaccagaggagaactggagaaaaacaagatgccacgcctacgctcccggcacgggacgaacccgagaaacaaaggagagagagacctatccactcctccatgcggcatcgcacctcacttcccagccactacttaccagttgccaccaccactaccacccacaccgaactaacctcgccgtggaaaccaaacccccgcgcccgaccaccacctccctcctcccacctcttcttctggccccaccgcgcgccgcggcagacctcggcacggcgcgcgtggccgtaccatgccgtgacggccggaacccgccaccgccttgatcgccgcgcatatgcaccccatggccgtggcagtggccgccggaacagccgccgtctcatgcccgcgcctcgtccccgagcgtatccccctctccgcctccgtcgccgtcacatgtggccgtggctgcggggtggcggtgagggcgcatggccaaagcgcaacgcgtcgcggagagaagctatgcgacgaccacgacggccatggtggatgccagtgcggcggctggtcgcagcagcgccgaggagcggcaacacgggaaggggtcgtggagtggagtagccagaaggaggtggtgagggcgaggagctcgcccgccgccgctcctcctctgctccgccccgccggcccgcgcccgcccgctcgtccacgcctcgccgccgaggtgctgtcccgctcgtcggcctccccgcgcgctcgccggcctcccccgagggagcacccaagatagagaggagttagctcgagccgccgcagccagggccacctccccccgccgattcctcttccgccctcaaccgccggagccgtgcctctgccgctgcgcgccgctccctcctttggccgccggccgccgcgtgccgctgcctctccgtcgcctggagagagaggagaggagagagatgaagacaggggagatggggagagaggaagaagaagatgaagggtgaggatgacatgtggggcccacgtggggcccactattccggatcgaattgccacgtaagcgctacgtcaatgccacgccagatgaagacctgagtcaaattaagccacataggcgccacgtcagccaaaaccacccttaaaaccacaaggacctaatctgcaccggttttaatagttgagggacccagtgtgtctggttttctggttgagggacgaaaatcggattcggattcgtcgacaagttaagagacctcatatgaacttatttcttccttgtttggttcgacctcgatcggggttgagtgggctgtggcggtgaaatcgagcccaaatcgacagttgcagcatggtccaaagcgagcccaaaatcaacaagaaggccggcccaaaggctgaggcccatggacagctgcagccatcaaagccgccccaccaacacaactccccacgaggccccgagcatatcatcgccttcgccgcaaagtcccaacactagcggcgaccggcgaggactccggcggcgacgtgggtgggactgagaagcgccgccgctgacaccagcgagacgaggcggcgacctccgttgacggtaacctacctaccaacctcgccattcctctccaaactgttgtgctgctgtctagatctcccacactacactagttactcctcgtagatctcggctacctggctcaagatccggggtcagatccgggtccggggattttctttgtgccctatggctgtattttggcgtctgtggctgatgacagcgtgtgttctcgagtgcggatgcaatctgagttatataggcaaatggccttgtcaactcgggcagcggcattgctttgctcagtgtgtttgaatgtgctgaaattcatgtagtaggctgtaggctgtgcatttcttgatttgcgtcttgcataattcactggtggattttctaaacctaacaagtttaaaattagaccattcaaccaaagacaggaggaataagtgaagctgttgtagtcacagcttatggccgatccaaaatttgttaggaatgtgaatatgtgatgctacaaacatatccttgtaagctaccatgctatttatcatgttccatcatggtgattggtgagcactcatgaaaaattcagatccaaacctagtgttacatgtggatttgtgctctgcaatctatcgccagtaataaaatggttgagtgatccagctactacaaaatcacattgcatactttttttttttgtagattatgcatcctggttttgggtggtgggttcctgatgtcaggaatataaatttagcctgctgatttaggtagcactgccggtgcacactttggtttttgaatacttgtagtcttccagcttcttgtagaactggtacaatgtgggccgtatataagaagggctgtcaactagcacatgctcactaattagtctaaacatttatgtttttattcattcaggtcaggtgcaatcatagaagtagttaatgacaatactttagttgttctaatattatttatgtatggactcaaattaacatgcaaaacatatgagattagtggcatgcattctttttcttaatagtggaaaatacgagataatgataactgtgaagctctgttagtactcttcattactctatttgagtggcagcatatctcatgctagccataaagcaagttctagacgtattctgttgttaattacttgtagctatataacccaacctagtcattccagcttatgtctcttagagatcatgtttattagcacctcaagatttcctctgcacagtatagtaactatcgaaaaagatattatttctttgtttttaattgacaaccttcacgtgctacttatttttgcagagtaaatctataggaaatggctgacggtgaggatatccagcctcttgtctgtgacaatggcactggaatggtcaaggtcaggaacttcatcttttaaaccatctatcatctccaagactccaactgcatttttaccaatttgaattccttaaaattttgcaggctgggtttgctggagatgatgcaccaagggctgtttttcctagcattgttggtcgtcctcgccacactggtgtcatggtagggatggggcagaaggatgcatatgttggtgacgaagcacagtccaagagaggtattctcacgttgaagtacccaattgagcatggtattgtaagcaactgggatgacatggagaagatctggcatcacactttctataatgagcttcgtgttgcacctgaggagcaccctgtgttgctcactgaagctcccttgaaccccaaagccaacagggagaaaatgacacagattatgtttgagacgttcaatgttcctgccatgtatgttgcaatccaagcagtgctttcactctatgctagtggccgaacaacaggtatgtgatgttttacttaacttctttctttccaatttcttggttcttttgcatctatagattcatttagatgagagctcggatgattaagaactattcttatacatttttaatgttggtcagtaggtgttagaattatattatctatgctcaataatagtcgtgcaattatttaatgttggtcagtgcatatggctaatgctgttttaatcaacaggtattgttctggactcgggtgatggtgtgagccatactgttcccatctatgaaggatatgcacttcctcatgcaatccttcgtctggatcttgctggccgtgacctcacggattctcttatgaagatcctcactgaaaggggttactcgttcacaacctctgccgagcgggaaattgtgagggacatcaaggaaaagcttgcatatgttgcacttgattatgagcaagagctggaaactgccaagaacagctcttcaattgagaagagctatgagctgcctgatggccaggtgattaccattggctcagagaggtttaggtgccctgaggtcctcttccaaccatccatgattggtatggagtccgctggaatccatgaaacaacctacaattccatcatgaagtgcgacgtagatatcaggaaggacctgtatggcaacgtagtgctgagtggaggcacaacaatgttccctggcatcgccgaccgtatgagcaaggagatcactgcccttgctccaagcagcatgaagatcaaggttgtcgctccacctgaacgcaagtacagtgtctggataggagggtctatcctggcttctctcagcaccttccagcaggtaagtccttatcattacagcttcttagatgctcaccagaattagttcataactacttcataaccaatccattttgtttatttgtccacaccaagttgtattttaatggttttgctaatgcacatgtgatttgtttgcttggcattgataaaaacagatgtggatatcgaaggatgagtatgatgaatctggcccagcaattgttcacaggaagtgcttctgagtttctcatgctgccctgtgcgtcggtttgtactagaggagaaatagttgcctttatgcagccataaactgcctgtgaattgtacgtcactctcttatgtggttggttgctccagatatcgttgtactatgttcttagctctgtgactgtgaggtcacctctggaacttctctggcttggttggttggatggagttgtgatagctgatagccctggtgttgtttggggtacaaactcatgtggaattttgaactatatatatccgtgtctggtcatctggtgacatgtttgatgcgtttctagtatacctaccaaagtgacaaggcattttgtcccggatggttttcgcattcttattctaagggccgtatagattacctttctttaccagacttctagttttttttttttgaaaaaagaacttttttatctgtatttcgtaaactctaaaactttttaatgttccctccatttgataaatcattttgatttatttttatagtcaaatttctttagttttgatcaaatttatagaaaaataacaacatctatacgaccaaattagtttcgttaaatataacattataatatattttgataatatgttcattttgagttaaaaatattgctatatttttctatatatttgactaaactttgaaatgtttgaataagaaaaaaattaaaacgacttataatataaaacaatatatagtaattcattggttcgtgtcctcgagtaattatcataaattcaatttcatccattatcctattttagactactctaagcatcctttggaacgaaggaaggaatttgaagaaaaaatatgggaaataaaccgatatacccatgaaatcgtatgggcccttagcaatttggtggacgaataccgccctgttaagtataagaggattaacacttaaagaggcaacgtgattagagcgttggctgcgtgattagctggtgttggttctagaagcagggcagcttaagaaggttgtacacgtgggcaaccgcccatctccttctcccttgtaatccgttggtttgattcgattcgctttcccactagccgagccccatcgatcgtattcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16219 - DNA, 3170 bp, Oryza sativa
gaagatggctacccccagaacatggatgattcgttacaagaacatcaccctcatggagattatcaccccaatatttgagttgccaacgcacggtgctagacatggctcccaaatgcacagggacatgaggggcatttgcgacaaggccaccatccggaccaaagagagcacaagaaaagtccagtctttcctttatattggtagaaatagaagttctttgaagtgttcgacccatctgttcagcaatacccatgaatcgatgattgaagatagaaagttggaccacatcagcaactgtctctgatacttctacactgcttggagcagcacttatctcaatttttatgttaccatacttggtgatgatagctttacagtctttttctactatcactgtactgttcccattcattataactgcacgacccttcaatacatgcccatagcccaaattctgaagcttgtaaagtggcgtttcctgccatccgtatgaaaaataaattcgacatgaactttctggcacaggtttggttgatactggtgtcagttcatgatgctgcaagatatttgtagcaccaactccctgaaccctcacatcacatatgagtatttttctgtttaataatttgaagccatactcttgctgaaacagtttcacaaactcatcagcataatcacttccagattccctctctggttgtttaaccatgattgctgtatcggttccctcgtacctcaagttcaagtatgaatgtgtcctgatgctgtcctctccaaaaccctgctctattaacttttctttcacctgcttaactaaaagatctactcttcgagatgcctctgcagcagaatcaacattataaatagcagagtatggctcttgcaaatcttcaataacatcagcaaggcccattccatatgcactcaatatgccacagtagcgatgaataagtaactcagacatgccaagggatcttgccatagcacatgcatgttgaggaccagcaccaccaaagcatgcgagagcatggttcttagtgtcatgccccttcatttcggtcaactgccttataggtcggcacatcgcctcatttgcaacattaacaaaaccgagggcaatctcctcaaccgtcatgtcctttgctgatggatcctgactctttcggtgagagtttatctcaacagcaagaatctcaaatgcctttttagtagcgtcataatcaaggggtaaatcttcgttaggaccaaatatggatgggaagtactcaggaataacagttcccagaatcaaattggcatcagttattgccagctcaccaccttttctatagcatacaggaccaggatgtgctccaacagaatctggcccaaccttgaaagctccaaactgaaacttaagcttcgatccaccaccagcagccaccgtgtttatgtcaagctggggagcttgtattattgccccagcaatttgggtctccagaacttgttcatagcttccatcgtagcggctaacatctgtggatgtaccacccatgtcaaatccaatcagcggttttgatgtctcaagttgaaacaaggtctgagagtagccaaccacaccacctgcaggacctgacaacactgctttgtgcccggagaatctcctctctggtgccagaccaccatctgactgcataaacagcacattcacctgctcacctcccccttcaaacctggacatgaatcctgataggtactctttgatgactggtgtgagataagcatccacactggctgtcaagccacgaggcacagcacggaccatcggcgtcaatgatgaagacaacgatacatgcttgaatcccatctcaagagataatttctcaatgagaagctcatgctgaggataagtatatgagtgcattaaaaccactgccaaacatcttattcctttgtcaagcaaaccttccaacaaaggcttcaatgcttctacatcaaccggcttcgccaccctgaccaattcccctgagatccctttaacagataaaccatcatccctctcaccatcaccaccaccaacaagttcaaccctctcatcaacctcaaccacctcctcatacaaattcgacggctttgacaccttgagatcgaatatgttcggccgagcctggttaccaatctgaagcaaatccctgaatccccgggtgacacacagcgcgatcctttcacccttcctctcaagaagcgcattcgtggccaccgtggtgcccatccgaatccaatcaatcttgcccgtgggaatcttggacgaccgcgggatcctctccccggagaactcctggaggatcctcctgatcccttcgatgggggcgtcgtcgtagttcgacgggtcgacggagagaagtttcatcacgtagccttccctcctcccgggcacctctgcgtagatgtcggtgaatgtgccgcccctgtcaatgcagaatctgaatttctccgtgctacccatcctaacttcgaggtactctcagaatctgcgtcctctgcaaaacaccaaaacagcagcgtagatgcaggcaattcagattaatctggtaatgggtgatggattactgtaataagtagaaggagttgtagcactgagctgtgctgtgaattaatcaaacaaagggggataagagcgccaggggcggatccaacttgggacatggggggttcagttgaactcccaaattttgggggaaacaaacaataaactgttacttgtattttctcgtgaaatagcttcttccagaactagaaaagaagctaggggttaacgaacgcaagcaaattccagacagacgtagccccggtggggtgggagagagagagagagatgaatcagaagctcaccaggatcccctcccctgctctgctcgccaccgtgctccaaccctgccaccgtcaccgtgctgcgtcgccccagttgccgtgcgccgtgctgccgccgtcaccgtgcgctgccgcctaaaccgtcgcaccgagagaaggagggaggaagcagcctctggctctgccgccgctgcctcgctcgtctcccctttttctcctcgcgataaggcccgagtcgacgagtgggcggcgcgacggttcggctggatccaaggtaatgcgatggcatttcctgtaatttcgatgaaaggggacgggta

SEQ ID NO: 16220 - DNA, 930 bp, Oryza sativa
  unsure (1)..(930): unsure at all n locations
gatcctctccccggacaactcctcgaggatcttcctgatcccttcgatgggggtgtcgtcgtagttcaacgggtcaacggagagaagcttcatcacgtagcgctagcgccttcccctacctcaagaaccccctcccgatgctggacatcgctgacggatcgtttggctccggcgccgcggcgatgtgctaggactgcggtaaccaagcaaagaaagactgtggccaccaacattgccgcacgtgttgcaaaagccgcggcttcggttgctccatccacgtcaagagcacctaggtgcccaccgctcgccgccgtgagcaccaacagctcactggctcatccccgtcttcccccgcaaccgcctctaccacagccaccgcttccgcctctgcctccaagaagccttgccttctcacctcccaaacgacgacgtcgcacaccttcacctccgatgccaccacgcccgcagctttgacaccacctccagccatcaagtaaaacgccattgataccagcgcatgttcatcaatacatacgcgcaattcggcatgtttgtctcctacgaatctacaaacagctcaaattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16221 - DNA, 504 bp, Oryza sativa
aacaggaggtgagtgctgaacaatatcattaacatcattaccaacaatttcagtttcctgatcatccacgtgctccacctgcacgctaacatattgctgctcctcatcagaaccacctggtatgacatctgtgggcaagctgtcattaaacataacagattcattgaaaacaacactcctgctcatgaatgtcttattagtttcaggattccataacttatatccttttactcctgaaccataaccaagaaacagacacttaatagctctaggctctaattttccattatcaacatgagcataagcagtgcatccaaaaactctcaactgtgaataattagcgggcataccagaccataccccaataggagttttcttattaagtgggatagaaggcgacatgttgatcaagtagcaggcggtgttagcagcctctgcccaaaaacgcttgttcatgtgaacgttggacagcatacaacgagccttggagatgattgttctgtt

SEQ ID NO: 16222 - DNA, 658 bp, Oryza sativa
tgcagcccgtctaaatttgaccattcgtcttatttaaaaaattttaaaaaaaaattaaaaacacaagtcacgagtaaagtactattaaagctttatcatcttataacaataaaaatactaattataaaaaaaaattaaataagacgaacgattaaagttggacgcggaaactcatggctgcacttattttgggacagaggtagtaaacaaaaataaaaataaaaatatagcgtctctgctaagtgtcaattcctctacctcaaagcttttggttcccaacaactgatgtagctttcttggtgggtcttgttgtctactcatttcatgcttgataccatctggagacagtatttataccccaattattcttacaataaacacaatttagaatctttttaatggtgtatagtactcccttcgtttcacaatgtaagtcattctagcattttccacattcatattgatactaatgaatatatatatatatatatatatatatatatatatatatatatatatatatatatatatatatatatatataatatgactagcattttccacattcatattgatgctaatgaatatatatatatatatatatatatatatatatattatatatatatatatatatatatatatatatatatatata

SEQ ID NO: 16223 - DNA, 898 bp, Oryza sativa
  unsure (1)..(898): unsure at all n locations
nnnnnnnnnnnnnnnnnnnnnnnnnnnnnnnnnnnncgaatgcacggttatgtctttcggactcactaacgcacctgccttcttcatgaatttgatgaacaaggtgtttatggaatttctggacaagtttgttatggttttcatcgatgacatactgatctactccaagtccaaggaagaacatgagcagcatcttcggctggtacttgaaaagttaaaggagcaccagctatatgccaagttcagcaagtgtgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgtcggttcattgagaacttctctaaaattgccaagccaatgacccagctattgaagaaggaagaaaagtttatctggtctgctgaatgtaataggagttttgaagaactcaaacgacggttggtgtctgcacccgttttaattttgccagatcagacgaaagacttccaggtctattgtgatgcatctcgccaagggttagggtgtgtggtgatgcaagatggcaaagtggttgcttatgcttcacgtcagttgcgtcctcatgaaggcaactacccgacccacgatctgaaattggccgcagttgttcatgctttaaagatctggcggcactatctcatcggtaaccgttgtgaggtatatacagatcacaaaagtctaaagtacatcttcacccaagctgatctgaatctccgacagcgaagatggttggaactaattaaagattatgatatgggaatacactattatcccggcaaggctattgtggta

SEQ ID NO: 16224 - DNA, 5745 bp, Oryza sativa
  unsure (1)..(5745): unsure at all n locations
gcaaagtggttgcttatgcttcacgtcagttgcgtcctcatgaaggcaactacccgacccacgatctgaaattggccgcagttgttcatgctttaaagatctggcggcactatctcatcggtaaccgttgtgaggtatatacagatcacaaaagtctaaagtacatcttcacccaagctgatctgaatctccgacagcgaagatggttggagctaattaaagattatgatatgggaatacactattatcccggcaaggctaatgtggtagcagatgccttgagcaggaagagctactgcaacgtcgcatgggtagaggaactatgctgtgaggttcaacgtgatttggaacatctgaaccttggtatagttgagcacggatttgtggctgccctagtggcacagcccacactggtggagtaggttcgcatagctcaggcaagcgatcctgagatagcagaactcaaaaagaacatgagggttggaaaagcccgaggttttgttgaggatgaacaaggaacaatctgaatgggagaaagattgtgtgtacctgaaaacaaggagttaaaagacctgatagtgacagaagctcatcaaacccaatattcaatccatccctgcagtaccaaaatgtaccaagacctcaaagaaaaattctggtgggtcagcatgagaagggaaatagctgaattcgtcgcactctgtgatgtctgtcagcgagtaaaggcagaacaccaaaggccagcaggtttgctatagccccttcagattccataatggaagtgggaagaaattggaatggactttatcaccggtttgcctaggacgtcatcggggcacgattctatttgggtagtcgttgatcgagtcaccaaagtggctcacttcattccggtgcatactacctactcagggaagaagttagcagagctttatctggcaagaatcatgtgcttacatggtgtatctaagaagatcgtgtctgatcgaggaagccaattcacttcaaagttctggcagaaattgcaataagaattgggaacctgtctgaacttctgcacagcctaccatccgcaaactgatggccagactgagcgagttaatcaaatattggaggatatgttgagagcctgtgcgcttgactttggtggagcatgggacaaaagcttgccgtatgctgagttctcctacaacaacagttaccaggctagtctgcaaatggcactgtttgaagcattgtatggacggaggtgtcgtactctgctcttctgggatcagaccggggaacaccagttgtttggtacagaagttttaaatgaggcagaagagaaagtcagagctgtcagggaaagattgagaatcgcacaatctcgacagaatagctatgcagacaaccgccgaagggagctcgctttcgaagcaggggattatgtgtatctccgtgtcactccgctcaggggagtacaccactttcaaaccaaaggaaagttggcaccacgctttgtgggaccatatcggattttggaacgcaggggtgaagtttcttaccagcttgagccttccctccaacatgcttggcattcataatgtgtttcacgtctctcagttgaagaaatgtttgagagttcctgaggaacagacaagtccggatcacatcgaaattcaggaagatctgacctatgtggagaagccannnnnnnnnnnnnnnnnnnnnnnnnnnnnnnnnnnagaaggaccagaaacaaggtaatcagattctacaaagttcaatggagccaccactcagaagaagaggccacttgggaaagagaagatgagttgaaggccgcctatccgcacctcttcgccagctcttccgaatctcggggtcgagattccgtttaaggggggtaggttcgtcacgccctgaagtttccccctttttcttactttaaaaatttgttaaataaatcgtccggagaaattgttctaattaacctagagctaattccctaattgataaatgcaattaataattggaattggcattgtgggatttttcttgggttccacatgtcgcaattgattaataggatttttagtggaattttcagagccctataaataattttaacccattaaaattcataaaccgcaatatttaaatcccagggaaattcctttttccttttctttttctttaccttcttnttctttgttgggccgtcagcccaacctccctcccgcgcgccctctttgctgggccggcccgctcctcccttccccttcccgaagtcctccctccctccctctctcattcgggggctgataggtggggcccacctgtcggtcgtctcccacctccagccgttgtgtcctataaatcactccccgagtcccctctccctttttccgcgctcgccgctctctcccatgcctactattgtcgccgcgccgctctcccgagctccgccgcttgccgccgcatttcagccacgcaccaccgccgctagagccgccgccgccgctagcttcgtcgtcacgtgggtcatctcggccaccgcctcacgttgccggaaccccaccggaaccctatctccctcatgagccggtgagatatccatcctcctccgtctccggtcaacaatagtggccgctgtggtcacttaccccacccctaacccatctctgctccctcctagggtgccgccgccgcccgtccgcacctccgcatcgccggtcgtcaccgccgccttcttccttcgcgccgtccgccgtgctcgccggtgaggaatccccctctcctccttcctttcctctctctctcccatgagcgccgccgcgatccgcgcgtgcgtcgtcgtcttcggccgtgcgccgccgcttttgcgccggttgccgccgcctcccgcggcgccgcttgccgtcgccggcggccgctcgccgccgccgctccccaaggccggccggtcggttttgtgccgagccgagccatgccaagccgccgcccgcgccgtccgatcggcctcccggccgatctggacagtcggtcccgtggaccggcggtggaccacccgcgtggtcccggtccatggtggaccagccgcctcgtgccgctgacaggcggggcccgcttgccggcgccgcgccccctcccttgatgacgtcagccctggggatttattgcgcaataattaattaaggccttttctttagtagtaaaaacacagattatcttctaaaattcatatctaattcatcggagctccgtgtaagtccattcaagtctcagtaaattcataaaaatccctagaatccattaaaaatggttttgtttcctgtttcagtagtcttatagcatgttttgcttgtgtgctttgtttgtcacatagatctcggccgtttcgtcgatccgcggtttctcgaagacgttgctgaggtctcatcagtgcgagagcaaggcaagttatgcattacaattgatcatattgtacccaatttacaaatatcccgcatttctattaaatgttgcattcttttacaatgtcatgtgggatgggtcctatcactcagccatttattgtttgccttatgccattgataacttgggtatcaaaatgattagatgttggttttggaaatgcttagccatgcttagttcaactagtacacaaatggggatcacattattacatagactttgactattagcatagctttggactagtgccaccgcaatggtgttagttaattaaaatacactgaatggtgggctatgggtgcatggttttgctggtcgcacccatggcaattaaggaccggttcacgggaaaccctgggagacttaccgtgcttaccacaagtgggagtgggtaactgcttgatctgaagtatagctcgaccctttcctaggcaccggtggcgagggtgggcatgatggagttgggtcggccggggtgtccggttgtccagttgccggattcaccacggcacaagaggggaccgcccactgcctttttaggggtgggggtgaaaccttagcatggtgtggatggttaggggagggttatgcggagggtcttgtcacgatttccccctttgcagtattatggtgatacttcggggcatgtcgacatgtgtggaatcgtatcttgtgggtacagttgtacacctctggccagagtaaaactatttgaatagccgtgcccgcggttatgggcgatcacccagattcaccgtgattagtcttacccctagtttagcttaatgaactggtgtagttcaagtggttggttgggcctgttgcaacgtggtgtagcgttggacagtgattggttaatattgattaattactacaactgttttactgctttcaacttctgcttttaaatgctagctttgtgcaaatgaacccctagcctcctttggttatatcctacatcatacctcctcttccggtaagtcttgctgagtacagtgggtagtactcagccttgctctcttttcccccacaccagagttgaagttctttccagttggagctgtatcgaagaagttgatctcatcgctgccgtcaagggatgcctgtggagtggagtcgccccgctgcagaagtcaagcgtccaagtctagctcgttttatctttccgctgcatttgtaatcttttctatttttgtaagacgtggatctatatgtcaacaactgtcgtttgtgtaccctggctggtcctggacagggatttgatgcacattcagcttagaaattctggttcgtgaatttctgggcgtgacaagttggtatcagagccgaccttgaccgtagaacaagccaactggaaacctaagagccctctgaaccccttttcatctgcatatgctctttgtacttggatttgtttcgggaaaatttggggttttgcctctttggtttgcgggaaaaatcttggtcgttcattcggatcggatctttaaaattagctcagtctagggttttagaaaaaaatatttggagtttattcgacaatcagtcgggaatctattgggtgatatgcattaggtcgtgtctatgtttgatggggcatttttatgcgcatcattttccatgcatctgttttatgcattaagttattgtttagtcagttgcattagtgtcgttatctgggttcatgaaaaatgttctatgcataaaaatcagtcatgctcggttatttatttgagtcatttgttgctttgtttaatttggatttgagcatgaattggttcctatcccttgtccatctttagatgtcagacctgttcctcgatcgcaagcgccgctccaagcttcagagtcgccgcccttagctttatcgtcttcttagtgtgtttgcttgctagtttccgtgtttaggtttgttgcttgtgggttagtcggcggtcgatatcatgtgtcagtggtatgtctgccttaattaggagttgtttgcctctttttcagtgttttaatcaagattaagataattgcacgtaaatttataagaaagattagtttctaagccccctgttttcttccttttctcatatttctacctatccccctccagatggtgaagacaaggaatggttcccgtgaatccaacaacgccagtggcagcgaagagcatatcagtggagcatgtgccagcgatgcatctgacaacagtccatctccaccgcccgagaannnnnnnnnnnnnnnnnnnnnnnnnnnnnnnnnnnnnnnnnnnnnnnnnnnnnnnnnnnnnnnnnn

SEQ ID NO: 16225 - DNA, 1820 bp, Oryza sativa
acagatgcaacaacagtaccatcaggtgttgcagcaggtgcagcagcaagcacaacagcagcagcagcagaacctgcagttttgtcttccaccactccagtctaagatgttagagtttctccgtgtcaagacaccgactttctcaagcaccaccaacccaatcgaggccaacgactagcttcatgctattgagaagaagctgaaccttttgcaatgcaacgaccaagagaatgttgcttttgctacacaccagctggaaggtcccgcttctgtttggcgggacaactatatggtgacccgtccagctgggacagaggttacctggtcagagttttgtcagagtttcaataaagcacaagttcctgagggaatcgtggcacaaaagaagagagagttccgttctccgcaacaaggaaccagagcagttatagagtatttgcatgagttcaaccgtctcgcgcgttatgcccctgaggacgtgcgcactgatgccgagaggcaggagaagtttttgtctggtcttgatgacgaattgaccaaccagttgatctgcagagattatgaggactttgagaagctggtggacaaagctatccgtcaggaagagcagtgcaacaaaatgaaccgtaagaggaaggcagctcagctcagaacttcccaggggatcagtcagaagccttgcttcacgatgggacatcagggtggaccttccacaatgattatccggcagcaccgtccctaccacccgggtagcttcaacaagaactacaacagtgagcagcacagcctcaaccctactccaagtcttctaatgattccagctcagtcatttcagccagctctgcctgctcagccagaacagcccaagaagtttggagaaaagcccgaactctgcttcaattgtaacgagtcaggatacatggtacgtacgtgcccgaagccaagacgtgccggactcaagttcgtttaggcctgtgtcaatcatgcatctgcagaggaggcgcagtcagcaccagagattatattgggtacattccccgtcaactcgacaccggcagtaatattgtttgattctggtgcaactcattccttcatttccaagcgttttgctggtgcacatgggttatctttagtgaagcttaagatacctatgcgagttcatactcctggaggtggcatgaccacaactcactattgcccatctgtgacagttgaaatccaagggttgatttttccagccaacctcattcttctcgagtccaaggaccttgatgttattcttggaatggattggttgacaaggcacagaggagtgattcattgcgttagccgcaccatcaagttgaccaatgcgaaaggagaagtggtaaccttccagtctccagtaccgcagaagccaggaatcagtctgaaccaggccactggtgaggtagcagtggagaaaacctctaagaagttggaggatattcccatagttagagagtatccagaggtttttccggatgatctgacaacaatgccaccaaaaagggatatcgagttctggattgacttggcacttggaactgcaccgatccacaagaggccttacagaatgggagccaacgagttggcggaagtcaagaagcaagttgatgagcagttacagaagggatacatccgcccgagcacgtcgccttggggtgctccggtaatctttgtggaaaagaaagacaaaactaagaggatgtgtgttgactaccgcgcactcaatgaggtcactattaagaacaagtatccgttgccaagaattgatgctctgtttgatcagttgaaaggag

SEQ ID NO: 16226 - DNA, 872 bp, Oryza sativa
  unsure (1)..(872): unsure at all n locations
nnnnnnnnnnnnnnnnnnnnnnnnnnnnnnnnnnnnnnnnnnnnnnnnnnnnnnnnnnnnnnaagagattcatgttaatttacataaaaagtagaattaatgaaagaaaaaataaatttatttacctccacagtgctttggcctttttgtttggtgccatttatcctccaagtgcaagggcaatcttcatcaccggacttgcaataagccctatatctcatcttacatgacttctctactcctaaatcaaactcctccttaatggcaaattgccgcactgccaacttgaactcctccattgttgggtacattgttcctaaagccatggatgggttgttcttatcatatgaaatgagcatctcacccggtacctcatcactagtaggaatggcagcaccatcattattttgcccaagctcactatcatgcccatgttcatacattcgacaatcaaagccctgtgcaggtatatttgttgtgtcctcctctatcacacctaaaagctcacaaatctgtgactcataagtgcaatacgaccttcatcatcatgtgtctcgaccatgtgtatgttatccaatcaactctttccatattttccacatgatctacttgggacctaaacaagtgaaatcaagttttactactgcctactactatcgtggtaaaaaaaacagaaatctagtgcaaccaatacatttgcacttgaagaacaagaaggttgaactccattgctggaagaggagcattgggcagcaatgttgtagcagcggctacagcactagcgttggcgttctactatacatggccattggctgccacagccaaggcattagccggcgcgcccaggccaccaggcgccgggaccagacccc

SEQ ID NO: 16227 - DNA, 4496 bp, Oryza sativa
  unsure (1)..(4496): unsure at all n locations
tatttaacgatcagcgataccgcattccatctagaataaatgatcgaaaattttagaattctcatcgtttcattttatactactgtttgaatgagcttataaaatctacttcctccgtttcacaatgtaagtcatactagtatttctctcgtgctgataacgtattacgcaaccctcctgctacatgaagtagtccaagagggtcccgtaattctacgcaagtggagacacaagatatgagggtgtggcatcctttctcatttatccattgcattctcaagtgtacaaaacctctcctccaaccctctatttatagagcaatgccttgcccactttccatattagtgatgggcccaattagtgggtaaccgggccgggccttcatgggccggcggtttcctaacactcccccttgggctctcgctgcgtgatgcctatgcctcatcaaaactccacaaaaacccagtgggaaaaatttggagaaagagtacatagcatacacttgcaatgtcgcacgaattgcctcgttaaaaaccttaataagaaactgctgggaaaacttattcaagggaaaaagagtacaatccacccaattctttgttcaatctttctagattgattttgggtacttgattttctatatcaagattctgaaatgagtcggcgaaattctccccctaaattttgcatttctctaagtctcattattccgatttctcggacacacctattcaatgaagatgtcaataatgagttagcggatgaatctgcaagactttcacatgacttagttcatcgcttctatgcaattcatgtacatagaagagcttgggggttcatatgcttagtgagtttgctactcacataactcatttgcatatgtgtgatatatgctgctttaatttcataaatggtgggggttgagatagttttcaaatcgcgattgctgttgcgggtaaccatctctcaaaaccatatcgaggctttgaacagttcaacgatgcttagttcggtttagttcaattagccaaatattcatgtgctgctatgacacacttgtgtttgggaattccatcccattttgacgataattgactattcaaaagccatgcaccatgaacatttctaagtgcagttggactgatgtactagacttccatctgtcgcatgcctttacctgcaagcgtaagcatgatttggattcggccaaatatttcaaatcaaactcaaattcaaaacgattaagtttcttttcttcaattcttttatgatttattctattcttttgatgttggttcggaacctgggtacttcttcatgtactattatgcaagtgtccgatccaagctcctgaaatgcatccattgattctatcttcaatgcttatcaatattcaggttgagttcttttcaacttctagttcattaattccattcaactcctggttgactgccaatgagttttgttgtctaaaagagacattgccgatgataggtctcattgccaatttctttatgcgagtatccatggatatacaaggagatgcatttttcatatgcttcttcttcttcttcttcttcttcttcttcttcttcttcttcttgcttaatgcttcttgatatgggcatgtaccagcgttagtgtgcactccaacagctagctcccctctattcggtggggtactttccgtgactttgagtatgatagtccctcttgccctgttttcactagacatctccggttactttaggggtgtgaggagccgaagtttcttgtccaattgtttttgttcgaggcctctggacaagatgagggatacctttactttcttcggtatttcaccctcctccggtgcattcatgcaacttagtcaaactcttcaaagtcacaaaagtatttacaaagtgatttggcagttttaattctttgtgcaaactgcattcactagtgcggtgtaacatgcattagtccctttctactatcatatttcctgacatttcctatctaggggttcattctctccccctaaatgactggaaataattcttatttgtcaaggaatttaggcttcataactatctccgtaaaaggtttccgactttcggagagagcattttgcaatgcattatgatagtgagatatgcacataaaccaaacagatgcaatagcactagtcgcaggatggatgttcatgccgatgatctgagttttctttcagagtccgctgctttcaagactacatgtccttttctactgcggctattacaacaatgatatagtaaatattgcaattcatagcttatacttagtcggcttatgcggatatttggtacttcgtgctaccaattcaccaatcatcaaatgcaatgctagcattgtcctcgcggacttctgaagatgatttagtgagttctattggagttcacgtgatcttgttgaatcagtcttggcaaagacacggtgtctaagagacactggatgtttgctgcttcggaagcgcatttatccatacagtaccaaatgggagccacatatattcttcgcaatccagttcagggatgctagaactatacgctgtttatgcattaatctcctatcggtgcatactagcacacaaatcttcatgatttaggaaaattatgcatatatgtgctatgaccatatgagttgtaatatttattcttataattctaagaccggaatggttgaaaatccgttgctaaaaggtgtagcccaaatcatcacacttttagaaagttcaacggggttgacgaacaatagatgcttctataaagtgcatcatttgttccataggtaatatgaccatggcactttctaggtcgacaaattcagttgttgctgttagcaacggtcataatatttccagttctatgggtctggaaatacctctttctcttaaagtgttatttgtggttatgcggaccacaattcatttttcttttatgtttggacgctacacaaaattgaaagcattataactatgtgccagaaaggagtgataaaatagtaaatgccttaaatatgctattttatactaaaaataattctttattgcagagaaaatgtgtgctctacttgggcaaggaccatttctttgatgcaatgttcaattcaaaaaattgcaacacgtgatgacgaagtatattgattcaacgaagtattccggtacatcggattcaatttacttcatagcgaatttcttgctcaacacctatggcaatgctttactattctggcataaatcttacggccgatcctatctagcataggagattctacggtcatagccatgcaaataggctaggagttctccccctcaattcatgatgagtgtgctattaggattgtccttttcatgttcctagattgttcaccttgacatgtgttctactcccccttgtcctcttctttcattgaggtaagtgcaccgggctagatgctcgtgttaaatttattatcaactgtgctaggtgatttgggaagacaatgttcttctgacgaacactatgccgaatgatacgcaattctattatcaactagttaggcatacttctcgtatgggcaccagtgatgcatgcgtgtgacttttgtcgcgttcgggtagaacatcaagagtttccgcagtattcggtgcaaattcggtgcaccgtattaccgtactctctgggtcatctactcagtgaaccatagtcgaaatatacccactcttgttcatagtccttgctctacgagagatagggtttgcgccataatcttgtaagttgcttcttccgtgcagtcaaaagagtaccaacacgcttatccatttagcatactcattcctagagtagcttggaggcaccaacgagagattgaagtgcttgatcaatctcgtcgaatcagtaaataaagcgctaggtttaattatgtaatggagctgcaaggtccactataatttcgacattgagtgcatatgtcagagatattctagatttagcgaatttttaattcgcgatgccagtcatcttccattattcaatatgcgcaaattaaacgctggtaaaatgcacaagtgttgcaatataatggtacacaaaattcccgcaaatagttccaatatattctatgctattctatacaattttaccgcaacgatattaattataagtaataaaaacatcataaataatcaataatcgtaaatgcgataaataaatttcataatcacataagtcagtaataaagggggtacctggaatgcaaagttgagggtcgaagtccagagtcctgtggtcccttttgtgcgaaaatatgatttttggagatatttgcaaattatgaaggccattcaaacaaatagcccaatgctgagggttaattgtgtattttctggaaaatacagtgtttaaaatgcaaaccttccaatgcagaggannnnnnnnnnnnnnnnnnnnnnnnnnnnnnnnnnnnnnnnnnnnnnnnnnnnnnnnnnnnnn

SEQ ID NO: 16228 - DNA, 992 bp, Oryza sativa
  unsure (1)..(992): unsure at all n locations
nnnnnnnnnnnnnnnnnnnnnnnnnnnnnnnnnnnnnnnagggggtgaataggcaatttaaaactaaatggcacttaaacaaaactaacctaaattgctaggcaatgtgagatataaggttaactaagcaattaagttaagttttacagacctacggtgatataagctcaaatatatctctatgaatgtaaattgcacaaatgtaaatgcaacaaataaatgagacaagagaaaaggaatttttcaccgagattcagaaactcgccggtttcctaatccccgttgaggcgatgtaggatcgagatatcgactaggggggtgaataggcgatttaaaactaaattacacctaatcaaaaccaacctaagttgctaggctcggtgatggtcaactctaacgaagcaactaagttatgttttgcaaacctagggtgatagtggctcaattatatctctagaaaagtaaatcacactcctatgtcaatgtttagcaatcctagggtgatatgatctcaagtatgtctttagaaatgtaaattgcacaaatgtaaatgcgacaatcaaatgatacaaggagacaagagatttttcaccgaggttcagaaactcgccggtttcctactccccgttgaggtgagctcaattccaccgctcaaccacgaagccaccgcacgccctcttcgtcaaggggtgggcaaggcaggagccggcccatggagaggactacccaagcctcgatcactcggggtggttcttccttcactccgaaggtgctgaactccaacccactcacaaccggcgccgggcctcctccataatcttctcggagaggtcactgggcaacttctccacaagccgtctaggaggcggcaacctacaagagtaacaagcgatgacccggtgtggagatgatcaagtgccacactagctnnnnnnnnnnnnnnnnnnnnnnnnnnnnnnnnnnnnnnnnnnnnnnnnnnnnnnnnnnnnnnn

SEQ ID NO: 16229 - DNA, 619 bp, Oryza sativa
ccgccccctggtcaggccgaactcagtgaatgcaaggtgttgtgtatgttgtgaaaaagtgagcacaagtgaaaatgcaatgacctaatgtggcaattaaaatcatctctttgctaggtcattactcctcttaatagtacaacaaagctataaataaactagcacaattttgatcgcccaacgccccgatcaatttaaaatgaaaacactagtttaccgtcttctcttccttttgctttgcgccgtcaattttaatccatcagtagacatccatgcgcatacataatgtgaacctaacttaatatatatctcaatagcaacggttagtccacaattagcgcttgtcattaattaccaaaattaacaacgggggcctagatgcttcaggcgagcccaactccaccgctcaaccacgaagccaccgcacgcccccttcgtcaaggggtgggcaaggtgggagttggcccacggagaggactacccaagcctcaatcactagggtaattcttccttcgttccgaaggtggtgaactccaaaccactcacaccggtgccgggcctcctccacaatctcctcggagaggtcaccaagcaacacctccacaagccgtctaggagg

SEQ ID NO: 16230 - DNA, 362 bp, Oryza sativa
  unsure (1)..(362): unsure at all n locations
taacttagatgcaacttgttcaaaattatagtcatgtacctcatatgcatcacgtggagaagtcgtcatatctcgtcgaaggtgtagaagtcgatgttctcgtattcccttacgcaatcctgccatggttagaagcaaacaagaaacacacaaaaatatgcacgctcctatcaactactaggtagtggcagctcaaatatcacacacactcaagcttttaacgaagctcttacaagttcttaccaaagcaagcggaatggtgatgtacaccgacttaaccaagcaccccaatggagattggatgtatcgatgccttgggaaacactnnnnnnnnnnnnnnnnnnnnnnnnnnnnnnnnnnnn

SEQ ID NO: 16231 - DNA, 649 bp, Oryza sativa
  unsure (1)..(649): unsure at all n locations
nnnnnnnnnnnnnnnnnnnnnnnnnnnnnnnnnnnnnnnnnnnnnnnnnnnnnnnnnnnnnnttatgtttgcagatcagttagttgcccgatcccatgaggcatgctaacatgaacatttcctggttccttttggacatcaaggtgccgcagctttgtcaaattcattgtgctttccggtaactcaatgagacagcaacaatacttgagttctaatgtctgaagggtttgtaactgacctatttcagctgggagactttggatctttgtattgttcagagccaagaattgcaagagtttcatcttcataatagaactggggagctctcgtattgttgtacagctcaaattcaacgctcttaaaaatctacatttcatgagaagatcattcagacccagtattttcaaaagtggcacaaatgaacctgggtactctgatgcagatctcttgacaaccatcagggactgcagatgtctttgtactttagtcagcacaactgacttggaatctggaagaacaactgaaaggtggcaaatattttctggaaggctgcaaaatgcttcccctgaactgaagcattcatcctttgagacggagcacgcccaatcatgaaataactcatgcataacaaacttatccttatgatcat

SEQ ID NO: 16232 - DNA, 1354 bp, Oryza sativa
  unsure (1)..(1354): unsure at all n locations
nnnnnnnnnnnnnnnnnnnnnnnnnnnnnnnnnnnnnnnnnnnnnnnnnnnnnnnnnnnnnnttctttgtgttgaaatatccggtgcagatagttctttgtgttgaaatatcctttggttcctttattgctatatctcccaggagactagcaacaccaaggtgctcgcctgccttggcactccccttgtgttagcgattgccttccaccatttctgcatcgtcgtggttggttcccacaagacgagtattagcttgtcgcaggacgtccaccctaacatggttctccaaattctctttgtatatctacgttctgtcaagtggtggagggtcgtctcctgtgtccaacgacatagggggcatatgtagatgttttaccaacacgtgttaccaatctattcgatgtccaaactctattatagatcaccaaccatgcaaaatcttgctctttcatggggcccatggcttccaaatgagggtatcaaattctgactttgttgtgcctaggagttgcgctttgtaggctgatgccaccatatactcaccatggttggttagcttccaagtggtcgtgtcttcctcgccctctacgagatgcacttcttggactgcattccagacagtgacgagctgactgattagtttggtcatcctagttgcaatcgccgataggttgatgtcgagtagccattggccagatttggtggcctactgtagagttctgtttttcttccagaaagtcgcttagaccagaggggccaacttccttaagccttctcccttgcaaccaagcaaagtcccagaatttcgcttttgtaccatctccaactgtcgtcgtcgttcccacaaagaggagtttgccaatgttgtcgcaaggcgtctccgaccccactcaaagctttcttagataaacaatgtagcaatcagtggcgcttggcgagcccatggttcaatttttcgttttcagtatttgtattggggtgctgatataccgaaatttggtccagaattatttgaattttcgaacaaaatttggtcaaatttgaataaatattactaaattcacacaaaagaataaaaaaaactttggggatccggaaattcgacctgcaggcatgcaagcgagacttgtcgtagattctgtaaatcttctctgacactgatacaacgatggctcgtgcatcatcctcatcctcctctccggcagcattgatgtccatgtcgaagctacgctcggctggaggatctctgcacgctccataatcttgatgggtgtccgcgagctgaaggagcagaagcttccatccccaatggcgcacgagagctgacgacccggatcaaccattggcagcagct

SEQ ID NO: 16233 - DNA, 383 bp, Oryza sativa
  unsure (1)..(383): unsure at all n locations
nnnnnnnnnnnnnnnnnnnnnnnnnnnnnnnnnnnnnnnnnnnnnnnnnnnnnnnnnnnnnnttgtaaacttgggctgtaataggcagattgtagttttgataaaacactatcttgctttgcataactcttgcatacctcatttcttgccattggagagcatgttagtacttcatatggccctttctttatttgcttatgaatttatttgagtaagagttactaaaagtaagaaaactgcagcttctttcgacacagcttgaacctctcactgagcagcagctgtcagggatagccaaccttcagcagtcttcacaacaagctgaagatgctctttcacaaggaatggaggcccttcagcagtccttggcagaaacattggct

SEQ ID NO: 16234 - DNA, 347 bp, Oryza sativa
ccgcccctcccgtgtcctataaatcactcccccgagtcccctctccctttttccgcgctcgccgctctctcccgtgcctcatatcgtcgtcgcgctgctctcccgagctccgccgctcgccgccgtatttcagccgcgcaccgccgccgctagagccgttgctgcgcctagccgccgccgccgctagcttcgtcgtcacgtgggtcatctcgaccaccgcctcgcgttgccggaatcccaccggaaccctatctccctcgcgagcaggggagatatccatccccctccgtctccggtcaacaatggtggccggcggggtcacttaccccacccctaacccatctctg

SEQ ID NO: 16235 - DNA, 3474 bp, Oryza sativa
  unsure (1)..(3474): unsure at all n locations
ctatagggcgaattcgagctcggtacccttaaatattgcggtttatgaattttgatgggttaaaattatttatagggctctgaaaattccactaaaaatcctattaatcaattgtgacatgtggaacccaagaaaaatcccacaatgccaattccaattattaattgcatttatcaattagggaattagctctaggttattatgtcattcagaaactggtttgtttgaaatcagttcccttttgtttgaaatcaattcccttggtgttggtggtggtatcttaccagcactaagactttgttatgatcttttgccatcacgtctgaaacagtgcatcaaattttgttccttatttccaagaaactatgtttttgtcaagcatcacctcgtccagttatggatttctcaaggttttatcaaccctgaagaagacagtcaaccagaagacactggtctgcagtattttaatgagttgttctgcagatcattttttcaaaacggtccctctcgcgatgatgatcataaggataagtttgttatgcatgagttatttcatgatttggcgtgctccgtctcaaaggatgaatgcttcagttcaggggaagcattttgcagccttccagaaaatatttgccacctttcagttgttcttccagattccaagtcagttgtgctgactaaagtacaaagacatctgcagtccctgatggttgtcaagagatctgcatcagagtacccaggttcatttgtgccacttttgaaaatactgggtctgaatgatcttctcatgaaatgtagatttttaagagcgttgaatttgagctgtacaacaatacgagagctccccagttctattatgaagatgaaacacttgcaattcttggctctgaacaatacaaagatccaaagtctcccagctgaaataggtcagttacaaacccttcagacattagaactcaagtattggtgctgtctcattgagttaccggaaagcacaatgaatttgacaaagctgcggcaccttgatgtccaaaaggaaccaggaaatgttcatgttagcatgcctcatgggatcgggcaactaactgatctgcaaacattaacagtatttaatacgggggatgatttatcacattgttcaattggggacctgaagaatctcagtggactaaggggacatgttcatataacaggtctcagaatattactgcaagtgatgatgccaaagaagcaaatctagtaggtaagcaattcctaggagctttgacactggaatggtgttggagcagtcaggacatggaagatgacagtgacaaagaaattgctaatcaggtccttcataatcttcagccaaacactaacctgcaggagctctccattcgaaattattctgggaatttattccccaactggattcaggattcttcactttccatgcttgtctcgattactatcgatgactgccaagactgtaatgagatcccacatcttggtgacctgccttttcttaaatatctcctcatacataaaatgtatgctgtagaaagctttggacaaagaagtaaccctttgactactgaaggaaaacatgcccctatattcccatcactggagatactgaatctgtgggagatgtactctctgcaattctggaatggaacaaacaatggggatttcccacgactttcccatctctgtattagcagatgcccaaaactaactaatttgccgccactgatttcgctattatatttgtcatttcactgtggtgatcaacttccagcttactcagaattgccatcactaaagtcactgaagattgaaagcttccagaagctcaagtctgtcagattctgtcctgaaatgccaatgttacagaaactggaaatcagtgattgaaaagagttattatcagtagatgatcctttgttgtctatttcaaatttaaaagttgtcaggtgccccaaacttcgttttggaagcagttcactggaaagctgtctcatgtgggaaaagcttcaaaggtaaagaaatataattttgcatattttaaattcagtataaatatttggtcgacttatcaagggtagcctagtaacaaaatgatgagaccagaaaaaaattgtcagtaatttttattcgctccatgcaaaatatgaacatacaagcctgaacattatggacacttgctcacgtgccataaagttggatggtacttgtaaattgggaattttacagtgccctataatgaatattaaccattcatttgttttcatctgatgactgacggtcaatatgtaaatcattttttatcacaaattagttatccaatttgcgaattgattgcaccgttaaattcgtcgtgattaaatctttaaacaaatatcacatgattatatttttattgcaaataaatttaacagttataactgttgaaacatcacacaataacaactgaaacataacaaaatatttgttgtaacatcacacatatacctactgaaatattcaaagagcactgcatgcaacactccaaatgacctaatgaaacatcatttaaatcatcacaaaataactgctgaaacaatcaaatagcactacacgcaacattctaaatgacctagtgaaacatagtaaactacttattgcaatatttagaaaaagcattagaacaaaaaaaccttaaaaatatttttttatcaaaatataatcatgagatcttattacgaagatttaattgcaatgaatacaacggtataatcggatcatatatcagatacatagtttagataaaaaaaatatttaaagctttgctattaagttaaattacgaagagtgagattgacgagagaggtggggggatgtgttgtatgcatgttgactattgatgtgatgacatgtgcaactaaaaggagagggtggggggacaaaaatctgtatgtgctgcgggcgtccgatttttctagttggaatcggttgctcagaaggaagcattgtcgtagtttttctgttgactatttttaatccgtgatttgataattgatacttctacatagttgatgatttcgattcaacatataaaggattgaacaatactacatgttagggcttccaattaacaatagcaggtttggttctggtgtttgcttgcattccatgtttgtaattatctgcctgcacatgagaggacgagccatcggggcgaacgccggtggcatatcactgccgtgcgggatgacatcccgacgtcgcatcacccaatccgagaagccacagcgcgcgaacatcggtcaaagggcaaggcaaaaataatgacgagagtttctaattttcaaatgaaatagttatcgaaaatacccttgttatgtggtgtttggttggagggactaaagtggggctaaattttagccccannnnnnnnnnnnnnnnnnnnnnnnnnnnnnnnnnnnnnnnnnnnnnnnnnnnnnnnnnnnn

SEQ ID NO: 16236 - DNA, 4921 bp, Oryza sativa
gtaaaatatctctttaagaagcctacgacagatgatggctggaattggagaaagtatagtgaaaaggatttacttggctccaagtacaaaaggtgagaacatgcatatatctctaaatgtatatgtactgcccagtcagaaaggagagttttttttggactttcaaaatttagcaagacataacttaacaacttaattattttgcgtaaaataaagctatggtacatcattttcttattctatgttctgaacaggattatgataaaagttaacttgggttaactgcccacatcctaacaaacatgcttttgtgatcagatacttgttcactttattgccattttcaactcaccaaaatctggtatgatacaaactaaacatgatctcaccaatacaatcataccaaactttagtattttcataagtttactcttaaaaaaacactactcccttcgtttcatattataagtcgttttgattttttaaagtcaaacttattgaaagtttaaccaagtttataaacaaaaatagaaacatttatagcatcaaattagtttcattacatctagcattgaacatattttttttatagtttctttgttttgtgttaaaaatattactatattttttaaaaaaaaacttgctcaaacctgaagaaattttatttagaaaaaagtcaaaacaacttaatatgaaacagaggtagtaccaaattatggaatggcgtcaaactaaacacctacaatattaccaaaatttggtatctccaaaatgtgttacaaaattttgataaggttgatgttatactccctccagcccactgaataagacgtggtcaaacttggcacaatccctctaaaactaatctttgactttaaatttcttatattctataatgtttatagcaacaaatcatcatataaaagtaaacccaaatgttaatctaatgatagtgttttcatcaaataaaattattaaattaatttataataaaataattattagataaacaaagagttgtatcttataagcatgtcatctagcaaagaattctatggtcacgttataagactcaatagttaagctggattttacggcaacatttcagatcatggtacagatgcaaccagaagcagtccacggggtgcgtggcaaggaagattgttgagcctaacaacgatgatcccaacacatggttggtaacatacttatacgagcacaaccataaacaagaagctaggccctgcgacaagccatcaccttctgatttgcacgttcagctggcaagtggcaacacgtaaaagaaaggaatctgatgcatccaacgatgaaagcacaacaaaggaacacacttcagcaaacaaaaagtgatagacgatgttggagactgagaaatgattcgtcaatgcatttagatggcgcaacattgaaatgaaatgcagatggtgcaacgagatattggcgtgtgcaatacaactgcaaaatttcaaaatatagatatgagaaagattatatatatgctgatatgaactataaaggtgttatccaatggtgtcaaagatggtgatggtgtaacttctttatggcaataacattttacactaagtgaatcactcaatgctaatttatatactaactaattaatgtggaatagtagctacaaaatgaatggttgtgattaagaatggaaatgatgtaatggctcttctttctaaatgatgtggctcaatacttatgaagttattggttgtaactatatagcaactatatactccatccatccaataatactctcttcgtcccataatataagggattttgagtttttacttacactgtttgaccactcgtcttattcaaaaaatttgtgcaaatataaaaacaaaaagttatgcctaaagtactttggataataaagtaagtcaaaaaaaataaataataatttcaaatttttttcaataagacgagtggtcaaacagtgcaagcaaaaactcaaaatctggatggagggagtataagatgtgcacgtttttttagatccagctcttgcaacacttgaccaacaattagtataatatgcatttgaattttatttgttgaaaataatatcattggattgacattgaattttatttttcatatggtattgctacaaaccttatagaatatgagaaattataagaaaaaagattagttttagaaatcgtgtcgagtttgactgtcttatattatgggatggagggagtaggatatatagatgagtaaaattgtacactaacctccacatagaccggaaccaagttcgaaacaccatgggcccaacctttttttagataatggaagttttattaatctcagtaaaactctatcaagtgatacaattattctgagagcacctccggcttctgcacccaaagaatgcacacagccaacaagaaagaaacaaaagataaactcatcatcccaatagcagggacaaaaagaacttcaggcgccctctaaccgtagcctagaacaccacccatccgccggggtagaaaactccatggccactagctccaattgttaacaagccgcaatgatagtaccccacaaattgaccttctgaaagatagcccatgaccggagccaatgtgtaatcaaaaagataacctgcaaaggagaagatatgtttttcctttcaaaaaccacatcatttctgcaaaaccaaatagaccaaatagtggtagttgcccctaataagaccaaagatctcaaattgtgtggttgtcttcttatccaatgcccaaacatatgagttgtattattaggtaaactaatattcgaagcaaactggattaaagaccaaactgcgcgggcaaaacgacaatcaaagaacaaatgattaatagtttcatctttgtggcagaaataacaagacttgtttcctctccaatttcttttaataagattatcttttgttaagactactccacaacgtaagtatcataagaagatcttaatctttagggggggctttaatcttccagattcttttgtttatattgggaacatcggtctgcaccaacgcaagataaagagatttaaccgagaatctgtcatcagtggttagattccatttaaactcatcttggtcgtgagataatataatattagcgatgcgtgagagaaggtgattccacgccactaacttagagccagtaaggtccctgcgccaagaaaagcttagaggactgatttggaaaatttctgaaatagttgcatgtttatgcctaacaatgttatagagacaaggatattattctcttaaacaggcattccccaactatttatcttctcaaaaccatgggcccaactagtggggcatcactaacttgctccgacagtttccgacaataggtcataaccattaggcgatttccaacagttggaacgaacgaaaattttgtactaggacgtcttccgtcctaggcttataggaaggactttgtccctcgtattacacctgtccaaccgcaatatcgagagaattcatctttcagtagtacacttaatgtcgttaactataagggaatagacaaatcgacttccgacgaacgagacgattgagttggtgtggcggctggcactaagagcaagtttaatagtatagccaactatcagctctaaatcatctatagtcaatttaatagccggttcatacaatagttatctatgaacgtatactatataattcatagttggtcccacctgtcatacacacatgcatcttataatcggtgctatagctggctataaatccatagcccactgcttttctctctcctattttatcttcttaaaaatgtgttaatagctggtttatagtctactattgtatctgcactaatagccagtggtgtgtgcttagaggcttctacggtggagtgaggcagatgacggtggggagcaacacacagctgcatgagcgtgactacaccggcaacgcaaatcacagtggcatcatcgcaagacagacatggatcgagatgctccggcgcggctgcacggccggccattctcaacgtagagctgtcacctattggatatactgtgacgatagctctagtatcaaggacaagttggagattgtagatgtcgatgttttatatcagcaataataaaggagcaacacatgagcacgtagagtagatggattgatgggaacaagattttagagtttagacagattcaaaccttctcgatgaaaagtaataccctacttctattttgagaattgtatctgtcgagtgtattattatgatttgactatcgtgttgtagtatgtccttgaaggacttcctacccccgtgtgaagctcggtgtaaaggaagtagcctttcagtagtagtttgtttttttgtcaggatctgctacagttgtcatttctgatatatagaaatgggaaagcgttgctttcctagctaaaaggaaaaaacatatcacaatagattgcagcaactcactcacgaataacaaagaagaacatgtggtcataatatcttgccaaagcggggcaaaatcattaagctagcattgcgaggcggtcgggtaacaagacgagtggagagcgcgtctaggggtgtaagtggctaacccgcgaaacccacttataggctaaaataaaccgcgaacccgcttattttgaactataagtggattcgcggctgacccacttacagccctaagcgcatctacaaatctatgaactatttttttttgagagagtacaacgaggatgcacacacgaactcactccacactcacacaacgcaacactacatgcacacacacacacgtgcgcgttcaacacacgcaaatgtagactttgaggacctaaatcctcacatgtgcgtttcccgcacaaatcctcacatgtgtg

SEQ ID NO: 16237 - DNA, 1800 bp, Oryza sativa
tataggcgaattcgagctcggtaccccaatttagcgactcaacttttcactacttaaacattaatcatatagttaaaagaatttacataataggtgtatctacattaatgctaaatataaatccaatcaaagagaaaccaaataaactcattcatgttggaatatattttttaaaaaagaacattaatatgcatggattgcaacaatggcctatgtcacttcaccaacatgaaacactaaattcaaatatacacatcttgcaaaaaaaaaacaagaagaaagaaacataaagaaatttggctatgagccgtgttagtactatccataattgaatttaattattttgactcactgcatgaatttgtacttgaaatttttcaagttagtctatatattatataaacgtcatcaattttttttgttgatttttctataactatttgattggtacttgaagaatgagaagcaattgcatagaggcgtataatgttagtaccaaataaggcaacaaacaatcaatttatatattcataaattgcatattgtagttccttttttttaatgaattgaagagcgacaatttgattagggatgaaaacggagcggataatttccgtccgctatggacaaaaacggatacggatacctttcggatcggatagttcggatacggatacgaataacgctatggtatcagggtttcagtcggatactgataataattcggatatccggtgaacagtactattcggatatccacagaagccatgagacataccgcatttctttctaactctataaccttcaaatagattttaattgtagtttatctcttaacactagtccatactattaatattatttatttcttaaaaaatatttataaattatacttcattttatataaaatgagctaattatatatgttgatatttgtttctattagaagttgagttggttttcgtgttccgagaaaaaattgtttctgtattcgtgtctgatcatattcgattcttatttgtattcgagataatccgtatttgtttctgtattcgagctatccgtattcgttttcgtgtccggtaaaaaatatgaaaacgaatatggtatgagcattatctgttcgtatccgcttcgttttcatccctaaatttgattgaattgagcagaaaaaaaaaactatacaacaagaaaaatgtgtaaaagtacatgtttggcccttaaggtctgctatggctaaggcagccacacaacaagcttaattcctagccccttctcggcccatgttgtggcctcctccttaatcttgctgactaggcttggtgcaaatagttctttgtgttgaaatatccggtgcagatagttctttgtgttgaaatatcctttggttcctttattgctatatctcccaggagactagcaacaccaaggtgctcgcctgccttggcactccccttgtgttagcgattgccttccaccatttctgcatcgtcgtggttggttcccacaagacgagtattagcttgtcgcaggacgtccaccctaacatggttctccaaattctctttgtatatctacgttctgtcaagtggtggagggtcgtcttctgtgtccaacgacatagggggcatatgtagatgttttaccaacacgtgttaccaatctattcgatgtccaaactctattatagatcaccaaccatgcaaaattttgctctttcatggggcccatggcttccaaatgagggtatcaaattctgactttgttgtgcctaggagttgcgctttgtaggctgatgcc

SEQ ID NO: 16238 - DNA, 1685 bp, Oryza sativa
  unsure (1)..(1685): unsure at all n locations
nnnnnnnnnnnnnnnnnnnnnnnnnnnnnnnnnnnnnnnnnnatgaagtggcacacatgagctagacttattagctttcaagtttcttatatgacggagattctatcaaaattttgaaagtagcatgcatgtactctgaattctatatctaaaatgatgcacattgaggcttgccatttgtcctttctgatgctacagccccaaggctccagtgcaagaatctctcctcgcagagccctctgaatgcttctttcaccaagaagaggctagtttctgtccatgcctcggcagaggctggcgcagaagaagctggcacagatcaaccagaggagccaaaacccacggtttcgattgagacaatgccgctcgaaactaagcagaagatgatcatggagcagagggcgaagatgaagctggccaagaagctgaggcagcggcgcaggaggcttgtccagaagaggcggctgaggaagaaaggtagatggccaccatccaagatgaagaagctcaagaacgtctaaccagcagtgatgtcggtcgctgttcttctgtacacctctatgttctgttcatccgtctctgtatttcctaagctgatgcccagcgaattttgctgttcaaaatatgaaacacaatgtttgcaaaatgtgattatttctttcccgatgaaatttcatcttgtattttttagataatggataaaccggtcaccgttaaaaacacacaaagcccagtactgaacaaattttcttctaacatgtccctcctttttctcctttaggctttagctgtcctacagaagtaccactaaatctaatgtgtgttcccatagtggaaatatcatatgcaccttgatgccttctgtgtttgtcaaaaactcaaaatcatagcaaatttcaagaagccttgctgtgctgcactctatatttgtgaggtatttgcctgtatatacacttccatgatgtgttttgttagggcctctcacaactctttcgtctgacctgatgttgattaaagcacaaaggatcaacctggacaaggaaataactggagcaaattcgggtttgtttgttgtttgccactttgtcaggcacgatgtgaacaatctgaagagtgccattttcgattttttttctgatgcccttcctgttgatgtggttgtaaaatttatctgaaatttagccttcttgagccatctttgtgacttgatggtgtaccgtcacaagttcttgaaatgttaaccacgatgttttttgtggaaacaaaatttgtaatctctctatcgtaggaactgaacatggccgtagctgactatgtttttgacctttttcagcatcagtctgacagtctcataagatggattcctagtttcctaagttgctggaaagaatctttgtttgcttgccttgcttggctacatggtgttgttgcctgcatgtgttctactgcccccacgcttctctctttagggcccttgatgcttcgatgcccaaggaaggaacaatcaccacataacctcacaaaactccttttcagttattagttttttttttggtgtgtgtgtaagagtaactaaccatttttagtttttgttataaatattttgatgttttctgctgaaagaactataaagaagatggtagtacaaaatggacttgaatgagggtaccgagctcgaattcgcc

SEQ ID NO: 16239 - DNA, 2270 bp, Oryza sativa
ggttgttgatgattgatcccactattgggttatttggatattacaatcgcattcaatatgaaagaacgaaagaaagatagagagaaaaggggcactgatcagaagaagaaagaagcaaatctgttgcaaaaaaatgtgttctggtgatgcctgagagttgagatgagagctcaactaccagaaaacgactgacactaactaaaggcaagctgatatatgtgctccatggaattcttcactcaaaagaagacagccaggtgaccaaaaacagcctgcctcagctttgtcaacaattgtcataacgcaccgacatgattagctctgattcccaatctattgacaagaattttgtgtggttaaaacaggtaacaacacagcacacactcttaactaactttgtgatcatccatcactttccttgtagtaatttattcagtactaacatctagttgcctttcagatcagcaaccacctggagatattcagatcattaaccaagaaacaatgcaattgtaggacaccaaatgcagactgctaattgctcactaactaaagcttcagaatgagatcaatgaaatgataagcctaatttaagtgcaagaggaaaaaaaaaaggcaaaggcaagcaaagcaaagcaaggcttcatctccaccaagtagagacagtgtcagaccgcacatattccattcctcgcagccaagcaatctcgtcagaaaacaatcatttgggcagaattaattttgatctcaaccagccatgtggctggtcaggtgacggcgacgacgacaacaacggcgactagcggatcaccatgagaagtttctatctgccatgctcccatggaaagagaggagctactaaagaatcatcaaaagagatagaagggtacataaagaggccagtcagagttcagatgaatctgattctgcagccatcagaaaagcaaggcagaattccagctacaaattgggccccattctgaagagtttcatatcatatcatctcctacttagaacttgcacttcagaggaattttgcacgagcaaaatatttagccatatatatatattagtaggaagggaagctagctagtgtggtgtgtgtgtccttactgcaacctgcttcactgaagctcagtgatctttgagaagttccatccatggtgaaccgcgcacatttcgtcatcctcgtcctcgtttaccgcctcatggtacctctctcagccgagccagcccagaccacagaggtagattttgaccatgatcagttgatcaccattagattgcacctgcaagagttggagcagattgttaattgcataatttgcatgagttatcaatttatcatagtggttattgtgaccaatcaatgttggatggaatttgttgcagtcgtatgtcgtctacatgggcggcggcggcggcggcgccggcgccggcgccggcgtggaggaggaggcggcgcgggcgatgcacatggagatgctgacgtccgtcgcgccggccggcgacgatcaggggagggcggcggcggcgctgacgcagagctaccaccacgcgttccagggcttcgccgccgagctcaccgaggcggaggccgccgcgctgtccggtccggccaccgccaaccaccatccgatccattgttcttgatcgattcctttcccggcgatcgccgtgatcgcgccgccgccacgggggggaatctttttttgttgttgtttgcagggcacgagagggttgtgtccgtgttcagggatcgcgcgctggagctgcacacgacgcggtcgtgggacttcctcgacgtgcagtccggcctccgctccgaccgcctcggccgccgcgcctccggcgacgtcatcatcggcatcgtcgacaccggtgagcgacacgtggcacgtgacattggcctgcgtcgtgtgtgtccagagctctgacgttgtggtgtgatgtcactactgttactgtggacggcgacaggtgtgtggccggagtcggcgagcttcagcgacgccgggatggggccggtgccggcgcggtggcgcggcgtgtgcatggaaggccctgacttcaagaagagcagctgcaacaagaagctcatcggcgcgcggtactacggcagccagcccggctcggcgtcgtcgtcgtcggcggcgggggcggtgacggcgacaggcggctcgccgcgggacgccgtggggcacggcacgcacacggcgtttaccgcggcgggcgcggtggtgcccggcgcggggtactacggcctggcc

SEQ ID NO: 16240 - DNA, 657 bp, Oryza sativa
aagctgattgaaattctcgctctttccgtcagcgtacaacaatgcgtaagaggtaaaatggctttcttatagtagcatttaaacggagtttgctaacgaaaacctaacgatgatagtatgtttggataaagacacttgtacgacggtatttttaaggaagttgagttcgtcgatagtactttttgaattaggatgaatgatcacctggtaaaattctagaaggataaatggcggtaacttccattttgactgcgtgttggtttttggttagcctgatctgatggcgccgggggtgagcatcctcgccgcgacgatacccaccgccgacaaggaggacgtgcccgccggcaagaacccgtcgccgttcgccatcaagtccggcacgtcgatggcctgcccgcacgtcgccggcgccgccgccttcgtcaagtcggcgcacccaggctggtcgccgtccatgatcagatcagctctcatgaccactggtacgtagccgatcgaatcaagaacgcgacgagagcagaggcgtgtccgattgattgatcgatcgatcggttttgattttggcagcgacgacgaggaacaacctcgggcaggcggtggcgagcagcacgggcgcggcggcgacgcgcacgacatgggcgccggggagatcag

SEQ ID NO: 16241 - DNA, 1196 bp, Oryza sativa
  unsure (1)..(1196): unsure at all n locations
aagcgtgctaacgaaaaacgaggaagttgaagtttgaagttgagaaaaggaactaggcctaagtcctcatctcccctctcctccctcgctctcccggtccccactgctctcccatctcctctactcctctgccctctcctccgacggcgggttttggcgacgggggtagcggcgaagggtggaagcgttaggcgagggctcgggcgacggtggtggagcatgagggcagcgggcgtggactctggcagtggcggacgagtgggacggcgacgacgggtgagggccacggcggggcgagcgtgggcgacagcagtgacgatggccctcccccgcacgggatctgtcagtcgccgccctccttcatcctcatccggcggaagccgcccttcccacccctatccggtggcggcagcacctcccgcgtggacccgtcggcggtggcaatggcgatggtaggacgacactgacggcgacggcggcggcggttggagaacgaggaggatggcagcggtgactggaggacgaggatgacagtggcggcggcgacaagatgattctagggatagggtttcagttattcaatttttgaaatttttatttttttcgtgttattttcttcacatgcggttgcgctagctaaatataaaaatctgattttcgtatacctttggatgcatgtgagccacctgtccgtatgtaaaattcgcttttaaccatatggaaaaattgaatctgtatatatatgtgctaggtagtactctctacattccaaattaatctacatatattttttttatgttatttctaattgatttacatatctgtgttcatcattaagtctattcgttatttgtgcattggagtaaatggatattgatgcatgcatccatgcacacaagtatttatacccatatgcaatatcttgatttgctattggctactccctccggttttattttaattgacgctttggacaatgacacgctttactagatatacctttgaccttatttctctattataatatatacaataaataaataaatgtatgtttacttttattatagtgttttgaaagacaaatctataaatttttttatagtttctttaaactaaatacttttaaagttatcgnnnnnnnnnnnnnnnnnnnnnnnnnnnnnnnnnnnnnnnnnnnnnnnnnnnnnnnnnnnnnn

SEQ ID NO: 16242 - DNA, 424 bp, Oryza sativa
  unsure (1)..(424): unsure at all n locations
atttacgcatttttgttactggaaggctgccacctcgctttttaagcatattgatggcctgaggcgttacgccgaccttttcagcaagcaccttttgagagccgcccactgcattaatggctttctcaagcggggtgctggcgttggattttttgttgatcatgttttgctccgctcatgtgtaatcaacaccatgttaattcatggcgtggattaaatcaacattatggtgatggaaaaaatccacatgttgtttaccatgcatggagcggagggttttatgagcagcatttctgaaagaattaaatttttactggcaagggaaggcttgaagcagcgggatttggctgaggctttgtcgactagnnnnnnnnnnnnnnnnnnnnnnnnnnnnnnnnnnnnnnnnnnnnnnnnnnnnnnnnnn

SEQ ID NO: 16243 - DNA, 729 bp, Oryza sativa
ctagattcattaagatctatatgaatgtgggcaatgctaaaagtcttatattgtgaaacgtttcacaatgagctcattcaaataatagtataaaattaacgattaaaattctaaaattttcgatcatttattcaagatggaattcggttacgctgaacgttaaatattcgtggtcgaaaagggcgcgtacaaatccgagatcggtcacgcggcccagtatccacactgttaggaaacctccggcccacgaaggcccggcccggttacccactaattgggcccatcactaatatggaaagagagcatggcattgccctataaatagagggttggaggagagggttggaggagaggtctcgtacacttgagaatgcaatggatgaatgagaaaggatgtcacacccttatatcttgtgtctctacttgtgtagaattacgagatcctcttggactacttcgtgtagcaggagagttgcgtaatacgttatcagcacgacgttctaccggagaccgagaaggaaggagggtaagatctaatcgcgaaaacgaagtcctctcccacttctcatccatttttgcttttcccggagaaatccgcaacgccgacttgaagtcgccggtgaaaaccgttttgggatttttcggaattgttggccaagccgtgctcatttttaactgcgccacaccgggcacggacgtcgcatcgcgctgaaacggcaagccggcgat

SEQ ID NO: 16244 - DNA, 715 bp, Oryza sativa
  unsure (1)..(715): unsure at all n locations
ggctcgtcagccggctcgaacagcgcncgcgggcaccgggccgaccggccagcagcgacggcagcacaacgcgggcaaggggagaagcggagaaggggaaaaagaanagccgaaggaagncgncggcgctccggtgactgacggcgacgacagagggacggccgaggatcaggacgacctaggaaaggtggtggcacggccgggcgaaacccctctcgcacgcggggagcggctgaaggcagccaaaggcggctgtggcttgggagcgcgagggagaaggcgtttaggcggtgggttggaggagcaaagcagcccccggggtggagcttgatgcagcgaagtcgacagcgcaaaaagagcggtgaggcgtggtgatggctagcgcggcggcaacggccggccggaggcaacatatggtagtggcggcttgggttggcggtggaagcagcgttcgggcggtggaatgaaagaggggcgcgtcggttgttctgcaacgtgaagtggcggagctggtggtgcaggtggcgtagggcggcggcggctctagcggcggcggcgcgcggccagagctcgtcggttagcggcggagcacgggctcggcgtggggagaacgggagggggcgcagggagctcggggagaatagggaaaaatggnnnnnnnnnnnnnnnnnnnnnnnnnnnnnnnnnnnnnnnnnnnnnnnnnnnnnnnnnnnnn

SEQ ID NO: 16245 - DNA, 1200 bp, Oryza sativa
aaatatcgaccgtgcatcgggcctggtctgtaggtaactttgatctggctcagcacgccgcagtggcagtacatcggcttcttcactgtgatgccggcgtatgggttaacctgcacaggagatcccatcacttccattggcttatggtgtgattggttgggatacggagagtgcgcaggggacgactggcacgttattgactgcggggcagattgccacacaagcgagttggtgatcgaaaacttgaagccccggtgcatcagcaatgcaaggaggcgagcggtgttgcgagcatcatcgagcccacagtgggcacggccctcccatgtaaggccagacaactgaactgcctcttttaagttgcaccggacacccccaaacacttcctggaaaggaaccttcaagtttatccacctgcaatttgtgcaaaagacgtcaatattagaaccacggttggcttctataagaatattcaaaataaactcaggccttttaactcagagactccaacatgacttttaatcattacaaagccaagtaaaaacatgttactctgtacattggatttttacaaggcactgtttgatttggttgggtctccaaaactgaaagtttgaccgttacttttttacaccatattgttcaaacaacaaaattatggccataggaaagtattttaaaatataaatccaatggtgccaattcttaaaacaaaatctagataatgctggactaattctagaagaaaaaaatacaaactttgaacattgatattcgcgtgcgccctatgaaactgaacagagtatcgagtatgcatgcagaaacatctccactacttctcatcataaataagatgagacacgcagcatacagaagaaaaaaacagtcaaattactctattaacctaaccaactttatataaaaagtctatagtgctattcttgtttttaacattatacttccactaataacacattcaaggttgtttctcaccttgttaattacaatgatttcttgtgcaaattggatatagtaacagagcatgaaacataatctcaaaccaggaaatataaaaaaatatacagaacatatatgatgaattttccagttcatgttaatgagtgtcctgttctcatttatggcacttttttcttcactattttcatatttgccactaccacagtgacctcctaaaaatgt

SEQ ID NO: 16246 - DNA, 771 bp, Oryza sativa
actataggcgaattcgagctcggtaccctcgaactcaaaggagcaagaggcagcgccagcgtggtcctcggaggcgggcggaatggcatggcacgaaggtgggtcggcgttttgcgtgaaggtggagcacagtgatggcgcgtgttgcgcgcagccagggtacgaggccattgcgtggcagcacgattttctgttttagatgggctgcgtgtctccgattcgttggcggcgccgcggtttcagagagatgcagctttgcttcctcccatgtgttggctgttgggctggccgggtcgactattgctgaagacaacggggacctccaaatggtcctggtttaataggtggccacgtgagattttttcagtaacgtcaaaactaagttgctgggcttacaaacttaggacgtggagaacttcaatccttcctgtaacagcatccggatggggtccaccagtgagtgtcgttgacaagatgatattgataccctagcttctgtcatcttagatttattagtttgcactaaagtagcaagtcgagatgtaaaaggcttaagtcactgttaagttttatttagagagtcatcaggcatggcatcactgtgttgcagctcgaggacgagctgctcaaatggaggggtgtagtgtcatgggcattccctagcggatgaacagtaccacggccactgtagcagttggttaggagatggataagattagattgagttagtttcttagggtcaagtcacatcatctctatatagggaagtat

SEQ ID NO: 16247 - DNA, 1216 bp, Oryza sativa
  unsure (1)..(1216): unsure at all n locations
nnnnnnnnnnnnnnnnnnnnnnnnnnnnnnnnnnnnnnnnnnnnnnnnnnnnnnnnnnnnnnnnnntcatcttagatttattagtttgcactaaagtagcaagtcgagatgtaaaaggcttaagtcactgttaagttttatttagagagtcatcaggcatggcatcactgtgttgcagctcgaggacgagctgctcaaatggaggggtgtagtgtcatgggcatcccctagcggatgaacagtaccacggccactgtagcagttggttaggagatggataagattagattgagttagtttcttaagggtcaagtcacatcatctctatataagggaagtattgtattcatctcaagtgaagcaatgaatatcaattagtctaatgtctccctcccaacaatgttcttctccctagcctaaatctacatcccttctccaggagccgacgccgcccggctatcttcccgacggtgtttatcctgtcatggcctcgggtcatgacactgatgacctaaatttcacactagaaattgaaaaataataatacattgagacagtaatctattgttacgactgaataaatgccaagtcacattaacatggcaagttgtaacataattacaaatccatgtaaaattttgtgcaacaaacacaactaaactattacgtgcaagagagtacaaaactaaggggctgtttgaatcagggactaaaattttagtccctatcacataggatgtttggacattaattagaagtattaaatgtagactaatgacaaacccattccataaccctagactaattcgcgagacgaatctattgagcctaattaatccatgattagcctatgtgatgctatagtaaatatgctaattatggattaattagacttaaaaattttgtctcgcgaattagctctcatttatgcaattagttttattattagtctacatttaatacttctaattagtgtccaaacatccgatgtgacagagattaggtttagtccctggatccaaacaccacctaaacacattagtatagcatgtgaatgttatatcgaaacagaacaggcagcccaagggccaggtaaatatgggatatctgttacctgttaaagtaaggggcttcctgattctctttaatctgcannnnnnnnnnnnnnnnnnnnnnnnnnnnnnnnnnnnnnnnnnnnnnnnnnnnnnnnnnnnnn

SEQ ID NO: 16248 - DNA, 1345 bp, Oryza sativa
  unsure (1)..(1345): unsure at all n locations
nnnnnnnnnnnnnnnnnnnnnnnnnnnnnnnnnnnnnnncataaaataattcaggttaggacataataaattaacactgcaatgtgacaaagttcatgcagttccagaaaaatattgaacttgcaccatttactatcatatcatacgcaacctgatcatttgcaatgaatacttcaggacatcaaaagatgccaagataacatatttccctcaaacaattaatggctgaagtagttcatacactaaggtccaagcaggatattttcatagcaaaggcggcatctcaaaagagcaccgaaaaattaatgcttaaatacagtgtttgacactgggaactactataacagaaaaaaaatgtttcattagtctctgggttaatatgtagggtaccacttgacaagaacaaccgccaattcaaattattatataataaaaaaaaagctatgctccttagtaagctggaaatgtgggttaatatgtagggtaccacttgacaagaacaaccgccaattcaaattattatataataaaaaaaaagctatgctccttagtaagctggaaatgtaggctgtaattctatcgctcatcatccaaacaagaaaagaaagtagaaccttttttttttccatgtaaagggacaaaaaactttttgtttgcaagattacagcactttctgataactatgcactatcatttgacctgagcgcaatatgagtgcaaaaaaaaaaaaaaagaagctaaaacagcagtggggatccattggagtttgagttaggcttgttgatcaaaggaactgggaaatattcgtgtactagatcatgaactataagtcactcgtatgcaggggcggatccaacttgggacatggggattcaattgaacccgcaaacttttgggcgaacaaaaaaactgttattacttgaattaagagaggtttaaggctatcaaattaaggaggaggagaagatctagaagagaagctagtagggttcacgaacgcaagcaaattccagtcccggtggggtgggagagagagagagagagagatgaatcagaaggaggacgcggatgctcaccaggatcccctcccctccgctgctctgctcgccagatggagatcgccgcccggccctcccctgttcagccgcgacgcgactcgtcttggcggcggcgcaaggagcggaggagacaacgagaacgagacggggagatttctttttcttttacgcgatactcgactagagatggcaatgggaaacatgacacgatatccgacgggtttttactctatcagggaaaaaatgttctaacttttatatctacggatctactaaataactcttac

SEQ ID NO: 16249 - DNA, 737 bp, Oryza sativa
agaatgaatgatgattaataatttacctcccaaataccgattcttcagagaaaagatttgggtatttctttgcaggctgatacaagatagaaaatgcacaatattagccaacagattcagagcaatcttcataggttgcgaatttagttaaacttgattccattagcactgttttcattaaaaggatgaaactaaatagtttttaggaaaaaaattgtcagatttatgtttctttttctcttccactcgcacaagaagtcagctctgatgaagtaaggcatggcgaacggcattttagtaactatacaaagtttaacttggtttcatcatcaaagtgtacttaagctcacctgcgaaagaaatcctccaatagctggtccaacaaccagagctattgctcgcgaggatgtgacctataacatataatacgaccaataagtagccagtactaaaatataatcagtaaaaattttaaatcctcatcctatagagataaacaagaagcttgaaatgcaaaacaagagtataactcttcttacaagggaaattccaagagcttggtgctccttcctgcagacctctgaagcataggcctggacaatacatgatgctgaacatgagtacgcaacaatccagtgtcatgttcttagcatcagccatcaaactgtaaatttaccttgattggtcctagtataccacagagtaatccaaggggtaccgagctcgacttcgcctat

SEQ ID NO: 16250 - DNA, 1275 bp, Oryza sativa
  unsure (1)..(1275): unsure at all n locations
nnnnnnnnnnnnnnnnnnnnnnnnnnnnnnnnnnnnnnaaagcatagtacaccatgtcacatcgaacgtttgaataattacatgaagtattaaatatagtttaaaaaaataactatttgcacatattacgactaagttacgagacgaatcttttcaacctaattgctccataatttgaaaatggggtgctacaataaacatgtgctaatgacgaattaattaggcttcgtcacgcggtttactgacggattctgtaattagttttttattagtgcccgaacactctatgcgacaccttatataatatccgatgtgatacgccaaaactttacacccctgaatctaaacaccccctaatttagaatggaatatgatgttttctaatataataaattgttagaaaacgtcacgtctcattttatgggatggatgcagtgtgttcagattaatcggcaggattgtattttttaatgacataatgtgtaatgtgtagatatctactttcaaaacacggtattttcattttatttgcatggggaattaattaaaccattggataccgtttgtaaaagccttgtgaaatttccctgttttttaactaagttttctgtgatgaaccatataatttctcacattttaggataaattttaaatacaatatataggttgttccatcctccagattgataacacttgtttttttagaaggatacgatctctaaaaataattttgatcactatttttttttattataatacatatacaaatatcaataaatatatgattttattgaagtacttttagactaatctatatatacacatggcctccatatttctaagacaaatattttaaacattattcataatcatatatttcaaaacttaacattagcgttgcacaaaaccacaagtaatattaaactggatgaagtatatttagtacggagcgtgcctcggatttaacatagacccacgtagttgctaactccgtcggtaaaggtccattactagtctattaggcaagagaaggcaagggaattgagagtttggacaagggaattggtggaagaattggtcacccaagttttttttttactctgtctcttgtttgatagtaaagatgatagttatgtgagtacggatgggaattgaattttaactaataatgtacaccttagatttatctgtcgtgcctagaagaaaattcccctnnnnnnnnnnnnnnnnnnnnnnnnnnnnnnnnnnnnnnnnnnnnnnnnnnnnnnnnnnnnn

SEQ ID NO: 16251 - DNA, 456 bp, Oryza sativa
gagaaacagatgtgtaagtatgattctacccctttaattttttcctttttctttattcttccttattcttttctccctctttcattctttctctctttcttttcttctctttcttcaaccaagcccgagaaagagggagagcgccggcaacggcgtgcgggtcggtgcggtgctacgcggcggaggtagcgccagagcaggaggactctgcaaggtatgctctccttctgctccgtctccgtggtgcgcgcatcgttcggtgcgcgatccgaccactaggacaaagtccctgcacgagctcaacgaggcagtgctgcatcgcaggtgagaaggtggcggcggctgccagggcagtgtagccgccgcttcgttcgcccatcgcttgttgctcctcccagactcgcccgctgccaccgctcctcctaagctcgcccgccgcatccgcgaccacgatgg

SEQ ID NO: 16252 - DNA, 1006 bp, Oryza sativa
  unsure (1)..(1006): unsure at all n locations
gtatggtaaaattcacgtagccttctaagggtgtgcaaaaattttgagcacctacatgttaagtaattgttggtaaataagcaaaatatgactgaatcaagcaagccaagtctatgattttcgatttatagctctaaaagatgggaacgtattacacaagttctcacatgtacacacggtacatatgagctagtgattatcaaaaaaattatccatgtgctttcaatagtattgcttctacaagtaaagtcccatttttaaattcatcgtaccggagaccaacaaaaaagataaaattctaacagacttgtagtataaaatagtaatatttttatagctaaaatataataaatttgaggttaagattttatatgtaggtataaaactattgaaactatatgcacaaattttttttagatttttcgatgatatttgttagttcgtgtgtacggagtgtgcatgtgaaacttaagtgtacatggtatatttacctgaaagatatggattaaatttgttagcacctaaaattctacctatagttttttattttgtgttttcgtcgtggcggctaacatatttttcctgtttttgacctatcttgaccgaatccatccttaatattggccctattcactgcaacttttttgcatggctgtgcagccgctacaataactatgttggtgtagttgcaacggctgcagcagcaagctgcaccgaacagggccattaaggtgatggaaatgatttgcagcaaaaacataaacaatcgctatatatattaagttttttttccgacaaagctaacctgtaactttgtatgatgttataaaactgaacttttgatcttctcataaccaattttgccaatggattatagcacctcgtttgccaagtccgaagagattttttggctgactccagtgatattttacaagttacaaaaatgtggtccatcatgcatgcacatatnnnnnnnnnnnnnnnnnnnnnnnnnnnnnnnnnnnnn

SEQ ID NO: 16253 - DNA, 3413 bp, Oryza sativa
  unsure (1)..(3413): unsure at all n locations
attttttttattgtatctcctagccgatacagcgtgaggcgctgtgcaagcaccggcttctttctcaatatgtgattttctttccttaatctcgttttaggatgattgataagttttagagccttcctaatagcactattgtacttgctcttatctccttaaaatatatttatagctgacttatagcttgctattgtatacctactgtaataaggtaataaggttgttcannnnnnnnnnnnnnnnnnnnnnnnnnaactacaagtgtgccacagttagccaaattccttgaagacacccacacttgaacaagttacatggatgcagcgcagcgaacagtcctagtatatgctgtttgcgcaacttgccaacttctcaagattttgatatagggtgcgctcgttcccacggacaaacgcccccaccacctcgtttttcacgcgcacgcttcccaagctgttaaacggtgtgtttttttgttaaaagtttatatataaaagttgcttaaaaaattagataatacttaattaatcacgtgctaatggcctgctccgttttccgtgccagaggggttattcccccaccctcactctcgatcgggcccatagtctctccatagatgagctttgaagaattgctatccaattgctatatgctcaaaaagaaaacagtaagattttctcctaaacaaagaaaaaaaaggggcaaaaagagcattctcaaaaaaaccagcaaacacaacaacttgttttgcccagaaaaacaataaacactattccaacttgtaaaagaaaccaaaagaaataatattttaaatggaggcaataataataatgaaaagggaaggagatgagctagcggttagattgcactctgttacacatggcgagcccccattagatagccgtagattacacctcatctctcgccaccttatctcatccatccgtcccaccatgtatatacccgcccaccacctcccctcccccaaaactcttcttccccctcccgccccggccaggtgtttgacgaaatggcctcctccgccatggagctctccctcctcaacccggcggcaatgcgcggcctctccgccgccaagccccgcgtcgtgtcttccaggcgcatcgtgcggttccgcgtggcgtcgtcagccgcggcgccgcccgcggcgaagcccgggacgcccaagaagcgcgggaagacggagatccaggagacgctgctgacgccgcggttctacaccacggacttcgacgagatggagcggctgttcaacgccgagatcaacaagcagctcacccaggaggagttcgacgcgctgctgcaggagttcaagacggactataaccagacccacttcgtccgcaacccggagttcaaggccgccccgacaaatgaggggctctcaggcagatcttgtcaaagagggttttttttcccctcgaagcgctccctgcaccgcggagttctccgggttcctcctctacaaggagctcggccgcaggctcaaggttcgtagttgcagtctagcttcttgctttgcatttcaccgagcacctggtgggcgcttgctaatgctcctttttttttctttttttttttttttgcagaaaacaaacccagtggtggctgagatcttctcgctcatgtccagggatgaggcccggcacgctgggtaagtagtagtaacacactctaaattatttccttgcacaatgacacaatgtgattgcaagcagccattacaactcaaattgaactgtaccatgactagagaaaatatttaagcttcagttttagggcgtccatttcaactcaattgagtaagcaattcaactgaattgtctgcatgatttatgctgttcaggttcttgaacaaggggctgtctgatttcaacttggcactggacctcgggttcttgaccaaggctaggaagtacaccttcttcaagcccaagttcatcttctacgcgacctacctgtcggagaagattgggtactggaggtacatcaccatcttcaggcacctcaaggcgaacccggagtaccaggtgtaccccatcttcaagtactttgagaactggtgccaggatgagaaccgtcacggtgatttcttctccgcgctgctcaaggcgcagccgcagttcctcaacgactggaagggggagctctggagtcggttcttcaggcatgcggtaatctccgagctattccgttgtttgcatggaccaacagttcacactgaagattgttactgtgctcctcttctaacagtttttgtgtgtgatcctttgcaggtgtatgtgaccatgtacctaaatgattgccaacgtactacattctatgaagggattggtctggacaccaaagaattcgacatgcatgtgataattgaggtaagaaaatcaacttccttttcttgtttacaaaattaattatgtgccctactttactgtagtccagactgtttcagaagaattgctgaatattaaaacaatttcattatgcaatgggtgcagaccattttatgctttacttatatgcttaggagaatgtttttaatttttgtatactgaaatgaccacactgatgatacaatctgtgcatttttttggcagaccaaccgcacaacagcaaggattttccccgctgttcttgacgtcgagaaccctgaattcaagaggaagttagacaggatggtggagatcaacaaaaagatcattgccataggcgagtctgacgatatccccctggtgaagaacctgaagaggattcctcacgttgccgctctggtgtctgagatcattgctgcgtacctcatgcccccaatcgagtctggctctgttgatttcgctgaattcgagccccagcttgtctactgattctgtagaagaccatctccagcttttttttccttcaaaaaggaatgctgatattttctgcctgaggggcttcgaacggtgagatgatgggtggttagcagaatctgcacctcgtgtgttcctttgtaaagtattgagacttcaacaatgtaccatttggcaaaggttttgttatgatctccatttaagtggcagtgaactgcatcacagtgggggttacagttttccaacagaagggtaattatatgatgttttggggttgttgatacttcatacttaagttccttagcatcctaagtatctcttagctgtgctctgcattatggcataatgtttggtcttggtgaaggtgaatagtgacgccaactactgaaaacctggacaatgcaagtgttggaagatgttgtaaatgttggatctaacatgacacgcacccacctattgttgccatagttcgtgagccgcaatnnnnnnnnnnnnnnnnnnnnnnnnnnnnnnnnnnnnnnnnnnnnnnnnnnnnnnnnnnnn

SEQ ID NO: 16254 - DNA, 1028 bp, Oryza sativa
atgtaccatttggcaaaggttttgttatgatctccatttaagtggcagtgaactgcatcacagtgggggttacagttttccaacagaagggtaattatatgatgttttggggttgttgatacttcatacttaagttccttagcatcttaagtatctcttagctgtgctctgcattatggcataatgtttggtcttggtgaaggtgaatagtgacgccaactactgaaaacctggacaatgcaagtgttggaagatgttgtaaatgttggatctaacatgacacgcacccacctattgttgccatagttcgtgagccgcaatctctatttttgtcggaaaggaaaagagtattaatctttactatcacgaccggagaagaatgccgttacagtgcgatatggtgccgggaacattcctgacgtgatagcacgttcaagtgatagacaaactattttttcaagcaattgcagggagtttcgatgtaatattagtagctttcatgagtttttgctatgaagcctcaacaagttgaaaagatactctgagcaattcaaacaaatctttgcggatgttgaagagtttgtagcaagaacggcatcaccacagcgtattttagtgttgatgcaaaatacgtcgtgacgcatgaaggcctgggaaatgtgttttactccagtgcaggtcctaaatttagggctcagagcgtgttagttagttttgatcctgcaactaacaaggatgatagaaagaaatgaaccaattaaccgatactgatatagtgtggaagatgcaggtccgatggttaaagcatacatcgtcaggtatgttttcatgcaatgtttcattggagctcataataataataactcattggttagaactccaatgaaattttgcatgaaacatatcagcttactagaatttaacttattatagcaacaatctaatagatcggacctaacgagacaatataagattgaagacaataagaaaaacctatttagccgatagatctacacaaacgtaatgga

SEQ ID NO: 16255 - DNA, 632 bp, Oryza sativa
  unsure (1)..(632): unsure at all n locations
nnnnnnnnnnnnnnnnnnnnnnnnnnnnnnnnnnnnnnnnnnnnnnnnnnnnnncagagttcgggcttttctccaaacttcttgggctgttctggctgagcaggcagagctggctgaaatgactgagctggaatcattagaagacttggagtagggttgaggctgtgctgctcactgttgtagttcttgttgaagctacccgggtggtagggacggtgctgccggataatcattgtggaaggtccaccctgatgtcccatcgtgaagcaaggcttctgactgatcccctgggaagttctgagctgagctgccttcctcttacggttcattttgttgcactgctcttcctgacggatagctttgtccaccagcttctcaaagtcctcataatctctgcagatcaactggttggtcaattcgtcatcaagaccagacaaaaacttctcctgcctctcggcatcagtgcgcacgtcctcaggggcataacgcgcgagacggttgaactcatgcaaatactctataactgctctgggtccttggtgcggagaacggaactctctcttcttttgtgccacgattccctcaggaacttgggctttattgaaactctgacaaaactctgaccaggtaac

SEQ ID NO: 16256 - DNA, 1001 bp, Oryza sativa
  unsure (1)..(1001): unsure at all n locations
nnnnnnnnnnnnnnnnnnnnnnnnnnnnnnnnnnnnntccaaattaatctacatatattttttttatgttatttctaattgatttacatatctgtgttcatcattaagtctattcgttatttgtgcattggagtaaatggatattgatgcatgcatccatgcacacaagtatttatacccatatgcaatatcttgatttgctattggctactccctccggttttattttaattgacgctttggacaatgacacgctttactagatatacctttgaccttatttctctattataatatatacaataaataaataaatgtatgtttacttttattatagtgttttgaaagacaaatctataaatttttttatagtttctttaaactaaatacttttaaagttatcgatggtcaaggttataaaagtttaacgtcaaccttgtccaaaacgtcaattaatatagacccagagggagtaggaaatagtagggatgatgcatgcatcgagtttattgctagagtaaatatagtatgagagagttattagttttttttagtcttggtgtacatatgaaatatgtaaattaatttggaatggagggagtagtactgtacccgttcgtctcatagaaattcaatcctaaccatgaaacttcacaatacatctacgggatcatcggaaggcagccatgggcatagtgacacgtggagcacatccagtggcatatatggcacatccagtacgtacttcgcgtcagcaaactaagagaataatagtataactcacttcctactattagcttattttaaagccaacatatataatagattagttatatggttggctataattttcatcttctctctgtatctctcacttatacatttaatgtatttgtcttagattttgtgataagctagctcttacatgagaaccaacacccttgatttttcactacctctctcctccacctaagtttatagtaggcttatagctcactatt

SEQ ID NO: 16257 - DNA, 686 bp, Oryza sativa
ttttttagataatggaagttttataatctcagtaaactctatcaagtgatacaattattttgagagcacctccggcttctgcacccaaagaatgcacacagccaacaagaaagaaccaaaagataaactcatcatcccaatagcagggacaataagaacttcaggcgccctctaacggtagcttagaacaccacccatccgccggggtagaaaactccatggccactagctccaattgttaacaagccgcaatgatagtaccccacaaattgaccttctgaaagatagcccatgaccggagccaatgtgtaatcaaaaagataacctgcaaaggagaagatatgtttttcctttcaaaaaccacatcatttctgcaaaaccaaatagaccaaatagtggtagttgcccctaataagaccaaagatctcaaattgtgtggttgtcttcttatccaatgcccaaacatatgagttgtattattaggtaaactaatattcgaagcaaactggattaaagaccaaactgcgcgggcaaaacgacaatcaaagaacaaatgattaatagtttcatctttgtggcagaaataacaagacttgtttcctctccaatttcttttaataagattatcttttgttaagactactccacaacgtaagtatcataagaagatcttaatctttaggggg

SEQ ID NO: 16258 - DNA, 725 bp, Oryza sativa
actatagggcgaattcgagctcggtacccattggttaatattgattaattactacaacagttttactgctttcaacttctgcttttaaatgctagctttgtgcaaatgaacccctagccttctttggttatatcctgcatcatacctcctcttccggtaagacttgctgagtacagtgggtagtactcagccatgctctcttttcccccacaccagagttgaagttcttcccagttggagctatctcgaagaagttggtctcgtcgctgccgtcaagggatgcctgtggagtggagtcggccgctgcagaagtcaagtgtccaagtctagctcgttttatctttccgctgcatttgtaatcttttctatttttgtaagacgtggatctgtatgtcaacaattgtcgtttgtgtaccctggctggtcctggacagggatttaatgcacatttagcttagaaattctggttcgtgagtttctgggcgtgacaatgatcttgtgctatattagttcatatgcatgtgggtgcatttggtgggcttgtctagccaagtgtggtgagttttctcaagtcccaaacaaagagagaagtgggcacatcttataggtttgggtagcctcatgtggttttgtccggtggagtatcctttggagtgtgagcccttttctcccttataaaagttggggatttctagaatggatctgcagtgtgttggataaccctt

SEQ ID NO: 16259 - DNA, 574 bp, Oryza sativa
  unsure (1)..(574): unsure at all n locations
nnnnnnnnnnnnnnnnnnnnnnnnnnnnnnnnnnnnnnnnnnnnnnnnnnnnnnnnnnnnnnctctaggttattatgtcattcaaaaactggtttgtttgaaatcagttcccttttgtttgaaatcaattcccttggtgttggtggtggtatcttaccagcactaagactttgttatgatcttttgccatcacgtctgaaacagtgcatcaaattttgttccttatttccaagaaactatgtttttgtcaagcatcacctcgtccagttatggatttctcaaggttttatcaaccctgaagaagacagtcaaccagaagacactggtctgcagtattttaatgagttgttctgcagatcattttttcaaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16260 - DNA, 431 bp, Oryza sativa
atcccttctcctcgtcaatggcagggaattgccatcaacttctccaaccagagcatcaccggaggccagtacccgctggtgttcgggccacaggtggccggccggtacacgccggtgtcggaggcaaggttagtagtagtagactatactagcaaccttctttcccatggaggcaaatcgccgagcagttgagctgcgtcgctcatcacaccatgcactgtgcagcaactgctaccccgggtcgctggacgcgcagaaggcggcggggaagatcgtggtgtgcgtgggcacggacccgatggtgtcgcggcgggtgaagaagctggtcgccgagggcgccggcgctagcgggttggtgctcatcgacgacgccgagaaggccgtccccttcgtcgccggcggcttccccttctcccaggtcgccaccgacg

SEQ ID NO: 16261 - DNA, 1114 bp, Oryza sativa
gttgagtgtccttcctttttttggaaaagcaaggaataattcagattttgagtgtatttacagatttttaattaaccattcacaattgctagtagctgctatcataagtttggacaacctaaggctaatataataacctccaccaatcttagagcacaagtgcacaaccctctaaacctaccagataaaaatcaacaaacttgaaacccattatatcgaatcatgtcgacagaatcatccagttgttgccacttgccaggtgattgggtaatcaacaggagctatacaagattacaagtggaggctactgattgaatttatcccaaaaagttttgcccacagaggattaattagttgcagttgatctcttcgatcaaaactagggccgtttgtcttcagcctaattgcccaccacccgtgtccaaattaagctcaaatcacatgggctaaaagcatggaaaccaaacatttacatatgagcgactactaattttgtgaagggtttaaatatttaaattagatctggtcctgcaagtcccgcaaattgtaggattaattgggcaaagatagtactgcccaaagcatcaatccaatatcaaaatcaagatcatgatctccaaaaaatggaaaagattaaacgttagttgttggcacgtactaccgtgggctctgcttcaattttgtttcgattatttttgtagactaagtcacgtacgtgcagaccatgacctgctctcccaacatttgcaatatttgacgaatttaatttttccgagccctctctaaaattgtctgatttggatcagagcaaagaaaaaaagatagtattatcatagtaaacgatatcacatttcctgaaaacagaaaggagattgcagtttttctctgtgaaacaaaattaataaactcgttaattttctctaatcagatttttttttggcgaaataataagctctgatgagtgattggctaggtgggagagaatatttgaacgtgaaggcgggctagtgcaccgaccgacaggtgggccacaatctacccgcgccggccaaatggatccaccctgtcgcagcgccagtgcaggcgggcacgttgggtgtgtagccggcaggta

SEQ ID NO: 16262 - DNA, 1232 bp, Oryza sativa
tgataatccttgtgaaattcagatcaatattttttttgtttacactttgagatgacagacagctttgctttctccatttttttctttttcagaaatttctctgcggcggacgcctgattttcggtccggatgcgggttctctgttcctgtccaccgtgctcatagtggctcctctggtaggcctatgctgccaatgcatcacaaagatgaactcgatcagttcagagaaacaagttcttggcctccctgtcctcattgccaccatcgttcttggcctagcagtaagtcacaaattctgaaattcagcaatcatcaccactaactacagctgtttatttgtctgaataatctgtcacaactgctcgtgttttttcttgtctgaataatctgtcacaactgctcatgctttttttttgtctgaataattgtaacacaacagctcatgtttttttcttcccctttcatggatcaatttcgagttcaggatttggcattcctgctgatgacatcgagcagggacccggggatcgtgccgaggaacgcgcggccaccggagtcgtgcggcggcggcgacgaggagggggtcgccggagacgtgacgacgccgtcggcggagtgggtgacggcggcgagccctcacctccggctgccgcgcagcaaggacgtggtcgtgaacgggtgcgtcgtgaaggtgaagtactgcgacacgtgcctgctgtacaggccgccacgtgcctcccactgctccatctgcaacaactgcgtccgcaagttcgaccaccactgcccctgggtcggccagtgcatcggtctggtgagcaccatactgttactgatgtagtactgtacattattaagctgatatattgaattactgaaacaaattatttacttcatgcttcgaaaaacaagtttccagctatttcaccggattacttaaacgaattatttacttcaagcattaaaaaataagtttgggggtttgctgaaagtacagtgggctcctctgcctctgcccttccttgctattttttttcctttttaagtagcctttttccttagtatcagtcttctcctttttcggttttttctttctttattctccaataatggcaatatagccgttttgtgttgtgtaactaaactcttttttcttttgatatattgatgtgtaatcttttttcatgttcgtgaaaaaaataagttttcttaaaaaaacttcttctactgcg

SEQ ID NO: 16263 - DNA, 862 bp, Oryza sativa
  unsure (1)..(862): unsure at all n locations
nnnnnnnnnnnnnnnnnnnnnnnnnnnnnnnnnnnnnnnnnnnnnnnnnnnnnnnnnnnnnnntggcatgaaattaagatacaagatttatgagggaatcatcaaatgtcttacggcttagcctcttgcccatcaaagggattcacttcagattccatcaacatatttgcaagaacaagatatctaatatgcagtacaataaaaaaggatgaggaagttctaaatttatcaatatacgaaattaaaatggaaaagaaatgcagatgatttgattacttcaggcattgaattctccgcggattgccagcttcatcatagtttttgaatgcttcaaagaaatcagttgcagcatctgcccattgcctctcagccatgtgcatctttccaccacattcacgaattatacccatgattcttggatgaggtatcgctgatttgatggaaagagcttttgtatatagttcctgcagcagaggttcacttcagaaagtgcatttcatgctaactgcctaaggcaggagaaaggtttgaacccaatatgggtcaacatagtactataaatgaaataggctaaatatagtcaatgctcttataaacatattgtccaaaataggtacaaaagacaggcatcagctttgtaggttttattttataaagctgtagaaaatcaataatttagcaaggaagttgtgtgctcactataccacctgatttcaggcaagcatattatgcaaatgtataattgtatactcagtggcaaatatcctggtatcagtaacatatcaacctatacaaattattgtcaaaggaataaaccggcaaaacagcagaaggatgaaaagttatctttatatctgcgttc

SEQ ID NO: 16264 - DNA, 749 bp, Oryza sativa
ataagatatttgagcaatgtcatatcataaagcagcatatacatgaagtagcatttgtaattgtgtggtaacaaaagacaaacacaatttatgcaagaatccccatgctcccacctcacagaccatatgaactagctttccatttcagaaacaagaaataggagtagccataattcatctacctctgttggctttttagggcatattttattttgaaaaaaaaaaacttcaagattaaactttgactattcatttcacataataaaatataatcataatagccataaaactaactttttaaaaatattttgactaattgttgaccaaaatctacgaaattttacttctcgaaagcgggcatatgcctaataaaaatcaatagagggagtttttttttttctgccagataacactatttgtgatcaatttgattccaaggtcgtcatgggacaaaccgacagccacagcacttgaggatgcaacggcgtccaagcggccaccttggcatccccaatgcaaggtaaggtgagctttagtagaggagaatacatgagcaaagctgagcagaaagaagaaaatcaagcttagcaggttagcagagcaaatgagaagcagcaatggataatggagacagtgacagcattgctgcgccaacaacaccagccacaccacaccttcccttcttcggttattccttctcttaaccttcttttctctatagggtaccgagctcgaattcgccctatagt

SEQ ID NO: 16265 - DNA, 112 bp, Oryza sativa
tcaacgaaatcccacatgaacagcggcagaggggggggggagagacaggggaggcgcggccggctgtacctgagggggttgcccgcgcggcggagcgcccacatggcggcgg

SEQ ID NO: 16266 - DNA, 1349 bp, Oryza sativa
atgtggaaaatatggaaagagttgattgtataacatacacatggtccagatacatgatgatgaaggttgtattgtacatatgagtcacagatttgtgagcttttaggtgtgatagaggaggacacaataaatatacctgtacagggctttgattgttgaatgtatgaacatgggcatgatagtgagcttgggcaaaataatgatggtgctgccattcctactagtgatgaggtaccgggtgagatgctcatttcatatgataagaacaacccatccatggctttaggaacaatgtacccaacaatggaggagttcaagttggcagtgcggcaatttgccattaaggaggagtttgatttaggagtagagaagtcatgtaagatgagatatagggcttattgcaagtccggtgatgaagattgcccttgcacttggaggataaatggcaccaaacaaaaaggccaaagcactgtggaggtaaataaatttattttttctttcattaattctactttttatgtaaattaacatgaatctctttgattttttgttttgcatgtaactgtcgtagtcgatgagcatacatgtgtgtctagcatgaggcagatagctacaactccaactctgaagtgggtagctagcaaggctgtgagtatccttagagatgatccaaatattggtgctaagagattgcaaaacaggttgcagacagatcacaagtgtgaaatttcatatgacactgtatggcggggtaaagaaagagctcttgaagaggtttatggcaaatgggaagagagtgttgagttgttgtttaggtggaaggccgaggtaatgaagcggtgccccgagagtgtcgtttaggtggatggtcaagtatatttccaccgttttttctgtgctcttaaaccatgcattgatggtttcttagaaggttgtaggcctcatttgagcatagatgctacaacacttaatggagggtggaatggtcacttggccgcagctgtagcagttgatggtcacaattggatgtatccactcgcttatggcttcatagcttctgaaacaacagacaactggcttccataagaaatattgcatacaggctacctgaaggcaggatacttccagctataatgcatcagctaaaggcaaatactagaggcttggggcatttgaaaattgtaccatgttctaattggagtgcagaggtgtgggacaagagcagcaacgttgagaggcatattgtcaagttacaccaaaggacctgtacatgtcttgaatggcgcacactggtaagccatgtcaacatgtattggcctatgtaacccgccaacggggagttaaccttg

SEQ ID NO: 16267 - DNA, 366 bp, Oryza sativa
  unsure (1)..(366): unsure at all n locations
tatagggcgaattcgagctcggtacccatcatagattcaggccttcgatcgtaaagtcataaatggtacgatagaatcgagaatttgacaacctggtcactaagtagtgatgagcatgataattttgtcgcgaaattggacatctttgtgacaattcttgcgtgcattttcttcaggaaagaactcaacaaacaatttaacaacatggcttgatgcggcctacctggtttgtgctcatgaggtagaggtggaacacggtgaggccgccgacaaaccacaccgagacgaaggtgtacacgatcagcannnnnnnnnnnnnnnnnnnnnnnnnnnnnnnnnnnnnnnnnnnnnnnnnnnnnnnnnnnn

SEQ ID NO: 16268 - DNA, 1296 bp, Oryza sativa
  unsure (1)..(1296): unsure at all n locations
nnnnnnnnnnnnnnnnnnnnnnnnnnnnnnnnnnnnnnnnnnnnnnnnnnnnnnnnnnnnnntgagaaaggatgtcacacccttatatcttgtgtctctacttgtgtagaattacgagatcctcttggactacttcgtgtagcaggagagttgcgtaatacgttatcagcacgacgttctaccggagaccgagaaggaaggagggtaagatctaatcgcgaaaacgaagtcctctcccacttctcatccatttttgcttttcccggagaaatccgcaacgccgacttgaagtcgccggtgaaaaccgttttgggatttttcggaattgttggccaagccgtgctcatttttcactgcgccacaccggccacggacgtcgcatcgcgctgaaacggcaagccggcgatcgcacgcgaagcctgagccaccgacgcacgaaccgccgtgcaccgacggcaccctgcaaggcgttgtagtacggcatactacgccactgtgccagggaggcgttggcaggagaggaagaaaaacaagaaaaatgaagaagaacaagaaaatgaaaaacgaagaagaggccatcgatggagacgacgtgccgtgctgggtttttcgagccgccgccgtgcgccgaccgcagcacggccacgcagccaggcaggaaggggaatagaaggaaagagagaagaaaaggaaagagaaggaggaaaaggaaagaagaaggaaaaatggaaagaattggtgattttgcacaaatgtccccgtgttttctgaaaatcatgcacatactcctctgcattggaaggtttgcattttaaacactgtattttccagaaaatacacaattaaccctcagcattgggctatttgtttgaatggccttcataatttgcaaatatctccaaaaatcatattttcgcacaaaagggaccacaggactctggacttcgaccctaactttgcattccaggtacctttattactgacttatgtgattatgaaatttatttatcgcatttacgattattgattatttatgatgtttttattacttataattaatatcgttgcggtaaaattgtatagaatagcatagaatatattggaactatttgcgggaattttgtgtaccattatattgcaacacttgtgcattttaccagcgtttaatttgcgcatattgaataatggaagatgactggcatcgcgaattaaaaattcgctaaatctagaatatctctgacatatgcactcaatgtcgaaattatagtggaccttgcagctccattacataattaa

SEQ ID NO: 16269 - DNA, 1646 bp, Oryza sativa
  unsure (1)..(1646): unsure at all n locations
nnnnnnnnnnnnnnnnnnnnnnnnnnnnnnnnnnnnnnnnnnnnnnnnnnnnnnnnnnnnnntaattaaaaggaatgaacagtgcgctcctttggcttcccatctttttattgcatttctgatggtttccggctgtgataccctgggtgatcaaggagtgccgatctgagccacacatggctatcatacaatgcgagcctctggtagtcaatcaggtgtttgtgtacttgcgtggggaaagaggagataggcagcctggctgggctgggcctcaagtatgaccttgattagtactgcaagtttatctaacggctgataatcgagagacatgttgatccaatggctgaaactgttgatgacgtggctaaacttggtgacttctttatggtaattattgctgtcagtgggttgtaactgtatagaaagaaaggattttgtgatggcacagtgcacaccatatattgctgggggcaaatagaatggtaaattgatttatgtaggggttactaaacttccattttttatatcgtagtaagtattttgtgtatttgtctggtgatttttaccagtattttgcacaaaaggtctttagtgggtctgcttgttaaatcttggaaacaaaaggagggaaaaataatggtcagtgctagttggcttactgttcagatttcaatgaatatacttttaaagtttctgctgatattgttacattatgtaaaaagggaaaatggttgatgcaagttattcttttcagcttttgtacaaattttcatggtcatgatgcaatattgaataacttcatctttttaggcatatgttcaacaattggagaatagcaggctaaagcttacacaactagaacaagaattgcaacgagctcgtcagcaggtttgcttctattgtgtctcgctgttttgagctctggctgcaagagttcatttcaagtaggcttacgggaatttctcacagggcatttttatatccagctcagtggaccagactcattccatgagtggaaatggtatatatcaaatccttcaatgtttaatatataatcactcttttttgcagcagcaactgtttggttgatcattacaatgggatatatgaaagcaatacataaacattctgccttgttgacagagcaattatactgtattttcttgcaggggcattggcttttgatatggagtatgcacgttggttggaagaacacaataggcaaattaatgagctaaggtctgcagtcaatgctcatgcaggtgataatgagctccgtggtgttgttgacaagatcatgtcacactatgaggagattttcaagcagaaaggaaatgcggccaaagcagatgtctttcatgtgttatcaggcatgtggaagacaccagctgagaggtgtttcttggggctaggaagattccgaccatccgagcttttaaaggtctgtaaagtcttacgatgttcttgttgtttatttgagccatccttctattgcaaagcccctcctattaccaaaaccaatgtttctaccataatattattagcatatcaagaacaaattatcagtctatacctatttttccttctatttcatatactcatatcaccaggtcattgtaaacttgtgctgtaataggcagattgta

SEQ ID NO: 16270 - DNA, 1851 bp, Oryza sativa
  unsure (1)..(1851): unsure at all n locations
nnnnnnnnnnnnnnnnnnnnnnnnnnnnnnnnnnnnnnnnnnnnnnnnnnnnnnnnnnnnnncatcataaataagatgagacacgcagcatacagaagaaaaaaacagtcaaattactctattaacctaaccaactttatataaaaagtctatagtgctattcttgtttttaacattatacttccactaataacacattcaaggttgtttctcaccttgttaattacaatgatttcttgtgcaaattggatatagtaacagagcatgaaacataatctcaaaccaggaaatataaaaaaatatacagaacatatatgatgaattttccagttcatgtctaatgagtgtcctgttctcatttatggcacttttttcttcactattttcatatttgccactaccacagtgacctcctaaaaatgtcattttccttttcttacagggcagggtaactgttaagagaattcaagcataatgcatggaaagttcagaaaatcgtaacagaaaaatacaaggacgatattttctatagaatttgtaaactttcagaaaacttaagatcttaaggatgttgcataaatgataaataaacttatcattgtcacctagtagaagttttcatagatttttttcttagtatatcaattttctgagccttttttttcaaatgtgatccttcaatattctgtactttatgatatttttatgctatgagttttgtctttttctcatttttacttttcaaccccctgacagtcaaaccggaaaaatgccttttttttagaagactgctaatgtcgcaaatgtcaaagaccacaaaaattagtggaacaaatgagaatgggagtttcatttgtggcaaacaatttttttccccaaacatgcttgtcttgcaacatatagtctacttctaaatagactatctacttccacaaaatttgaacttgatacctttggaaaagtgaatttccatagtaaaatgtgtcaatgggggattttgcactgtttcttacaaagtccattcaaatttctatgttcaaagacttcaaacaagccctaatatttcatacttacatcatagcgaatagtaaaaacttatcccataatctggtttgatcagagtatagcaactgcagttaagacacactaaaggcacaaggtgaaagaataccttgcaccacagccaaaacgaagaaacaaaaaagaatgcacacagaaccccaaaccggccaattaaagcagctctcctctgtgttcgataaaaaaaagccaaataaagcaccaggcccagccccatagtcaccggtaacccgagtacaacaactggatgggacttgaagaccatcaatgtaaaaaattacaaggggatagttttcttcgaaatgctagttcaggatgcaggatatgacccgaccccaacaaatcagtgtcgatgaattatagaattatcaaataacaaattaaggccccactatttttagcctatagccccagattatcaataggattattcgtgccacacttccaaaagtacgatttctgtcagcgttgcttagttttttctaagttactgtaactttattttatatatatatatatatatatatatatatatatatatatatatatatatatatatacacatacacacacacacacacacacacacacacacacatatatacatacctataaacaagtagatcatccatcaactttcatccggatttcagctaaaaagaacatgacctaaataattataaaatacctacaacacgtattatcaataatcacataattgatagtactctacaaaaaagatcctaatgtaccgctataataaaaccataa

SEQ ID NO: 16271 - DNA, 2497 bp, Oryza sativa
cctccctgccacacttcatgaccatacagcaaaccaagttaactactaactcacggatccacaatgaccctgggtcttgaaatgtggcttcaaccctcatcttttttgttctgtccactaggccaacccacatatcgtcctctctcactcccaggcccttatatgagcttgttcagagtgggaaatggaatagcccccccccccccctaaaattctaaaattaggggcaatttttttttgcttaagtatataatactatggcacaagaaagacttaatggattgcaattataacacttgcttgcatcattttttttaaaaaaaaaattcttacgtaaaaaaaaatataacagttgaaaaatatgtttggcagaagattaattattatcagatatatattgttgaagaatttgtttcaagtaattttagacggatgtcgcttttcagtataagttaagatatattaagtgtttacaagcaatctttactattttagcatgaatgcgtaatataattcttaacattgtgaaatgaaaacatatattgcagtaatataatgagaaatatatattttggttattgacacaaatatatgtatactttgtgttttgcaccagggtctcaaattgttgggtacagcctgctcgctccctcaacctccctggcaccctgcccctctcagtgtctaagcctagctgccacaacagcaagcagcgacagcatgattaggtggggcaagaagcaaagcaaagaaaggatgggggagggagagcagcaaatcaatgttagatcaggagaaggagcagcagaggacggactgcattgtaacccaaaaattgcaagaatatggtaccaagctggccgatggggatgagctggggaggaagatgccgcaacatcaaggcagggagaaaatgctggctttgaggcgggtagcacatatccactacacagcgagaccctagggtttccagggtaagcttctccctctcattgtctcccaataaatgcttaggtcacgcctatgtgacgtcttaataatcatgatgttagccaccaaaaatcttggtattaataacttaatctgtaagcctttaacttagtctaaaattgtgctgcttagtcccaataaacaagttagtaaatcccatcctatcttagcttgtttgacgtcacgttccagaaccagaagggaaaccaacaagcagtgatgggtaataggtgggttcagccccaggcctcactggccagttgccagttgccacaatgcaaggccaggcagaaggaaggacaaaagcaggaaataggatggatcggtaactgtggctttaccactaatcaactgttgtatccagttgtttagaggatgagtctccctaacaagggctaaacaatctctctaactggaaattttaacaagctgcctaattgaagatagaatctcaggtaaacatacaaggacagtacagctgctgactggtggcctgcctgattatggtactgacacagtaaaagaacaagaaaaatgtgcaagctggcactttgtacatgatcacaaaagaagtggttgcataatacatgttctgaatctaatatattaccagattgacccaggaaaagaaagttcatcctgtaaaacttttggtctaatgctatgacatggtttttgctgcgttcagataaattactttcttttttcttgtttctgttcagtgcaataatggaaaacacttcagtttactacaaaattaacacgaaggctcctttaaaaagaatcaagtgcatgctccatgtagtgctccaacatactacaaaaattaaaacattagggcaagcaagaaagggaagtttgtttgtgccggtggtttgcttttcgtttttgttcccctttgcttcttccaactcatgttcaattcaaacttgattctaagtagatgtatgctaagttaagaacttcattcagtttcctttggactttttatgctgattttgtagtgaaattaaataagtgtacaggtttaaaccaatgccatggtttgcaatacacaaaatggcatggctcctcatgttaatgtttgaagatgccagaaaaaaaaggagttcccttgagaatggtaaatatgtaaactgattgtcatgggcatcccctagcggatgaacagtaccacgggcactgtagcagttggttaggagatggataagattagtttgagttagtttcttaaggatcaagtcatatcatctctatataagggaagtattgtattcatctcaagtgaagcaatgaatatcaattagtctaatgtctcccttccaacaatgttcttctccctagcctaaatctacatcccttctccaggagccgacgccgcccggctatcttcccgacggtgtttatcccgtcatggcctcgggtcatgacaacttggtatcagagccactcaccatggcttccaatgcccagtgagttctccgtatcacggtgagccatctagtgt

SEQ ID NO: 16272 - DNA, 1062 bp, Oryza sativa
  unsure (1)..(1062): unsure at all n locations
nnnnnnnnnnnnnnnnnnnnnnnnnnnnnnnnnnnnnnnnnnnnnnnnnnnnnnnnnnnnnnaaatttgaatagtatatagaatgatgatttaaatgtaaaagtatggtgatatgactttatgaaagaagaaaagtattgggatagtttggaccgtagattaattatctaaaggctaaaaataattaaggtgatatggattaatgagagaagaaaatgagagagataatttggaccatagattattcatttaagcacttaaaaaaaattgatgtgatatggcttaatgagagaagagagaaataaatattaattaagtgatgatgaactatatatgtatatagcatattataaaaaaataataaatatatattaaaatattatgtgaattatgtgcgatgatgatttaacatgcttacatttttgaaagctcgaaaatttaataatttataaaattatagataatataacatgtttgcatgttgtttaaatttaatgattgttagtggatgatgatgtgacatttttgcatgttaagttttagtagttagtgggttacaattttatagtaagagatgatttggtttattgtcctattaaaaattgataaagttgaaagtggcaacaaaacaaatataccgggaaatgctacgctgactagtggaattatttttcaataaaaacttcatacatgtatgcctgatatatttatgtatatggttagcagttgacaaaaagatataggaatcaatccaccaactaaacgtttgttaggaaaattattattggtgaacaaataaaaagcgctagtcatagctctcaccattggggttttcttcaaaatatttgttaggaaaaatggttgattaacaaatataaagtccttaccatagctctcactactgtatctttcttcaatgtttgttaggaaaatagttgatttaacaactgtaacgtgtttggtattgctctcaataatgcatttttcttctacagtcatgnnnnnnnnnnnnnnnnnnnnnnnnnnnnnnnnnnnnnnnnnnnnnnnnnnnnnnnnnnnnnn

SEQ ID NO: 16273 - DNA, 2496 bp, Oryza sativa
tgaagtatttaatagcaacgaaattggtataacgtcacaggttttgggccggtttatgacgaaatcgataaactgtcacggtattatgggccttgtatccatagttgcatatccgtgacaatatctaaaaacatcacgaaaatttcgtcacagattaaatagattcttgtagtggcggttgcaaagcattttattgagcgaaacaataaaacagttgattaattaaggtaatattaaatctccactgatcaacgctacaccacgttgaacaggcccaaccaaaccacctaaactacctagttcattaagccagttaaaggtgagactaatcacggtgaatatggttgatcgcccataaccgcgggcacggctattcgaatagttttactcttgccagaggtgcacaactatacccacaagtcacaatccaccggcatgtcaccgtgcctacgcagacacatcactatgttgagtgattgtgacaagacccttcacataaccctcccctaaccatccacaccacgcaaaggtttcacccccaccccctaccccggaggtgggcagtcccctcgtgcatcgcggtgaatctggcatctggaaaaccggacaccccgttcgacccaactccatcacgcccaccctcgccaccggtgcctaggaaagggtcgagctatactacagatcaagcagttacctattcccgcttgtgttaagcactgtaagtcttccagggtttcccgtgaaccggtccttaattactatgggcgcgactagcaaaaccatgcacctacagcccacattcagccgcattttagttggataattatgaccaatgaaacatggccggatgtctcgagcatgcagctcgtcaagatactagatgtctaaaactgtaattatcccattatgtgagctagtggtaattaagcatggctaagcatgtagttctagctaggtcaacataagtaacacaagctagtcgaattatcacccaagtttgacaaaggacggacatcaaataatatggcacaagcgagcagataggttgtacccttatcccatgtaattagcaaaacatgcatatttatttgcaaacggtaaaacatttataaagtaggctcaatatgctcaaggggggaatgtatgacttgccttgcttcttcaaaagatcttctgaactcttttcctcgcgatcgcgaacttccgaaatgacggattctacacactggcatgcaaaacgatgaaaaaccctaaaaaccaagtaaacaatacatcaaaagtaaacaaacatgtagagctcaatttaagatgaattttgcaatttgaatggcccaatttaaagttcgaatgaattatatatgaattttagaagttttgagccatttaaatggatttctacaattaaactcgatttattgcgtaattattaattatttttaaagggaaaataggtgatcgctgacgtcagcaaaagggagaagcttttcgcacgtcagcggctccaagggaagggcacacggtggaccaagtccaccgcggtctaggtggcgccgaggaccaggagcacaggcggtccacgggcagcgccaaaataggcaacggaggaagggggctggctcgtcagccggctcgaacaggcggcggcggcacccggccggacggccagcagcgacggcagcacaacgcgggcaaggggagcagcggaggaggggaaaaaaggagaggcggagggaggcggcggcgctccggtgactgacggcgacgacagagggacggccgaggatcaggacgacctaggaaaggtggtggcacggccgggcgaaacccctctcgcacgcggggagcggctgaaggcagccaaaggcggctgtggcttgggagcgcgagggagaaggcgtttaggcggtgggttggaggagcaaagcagcccccggggtggagcttgatgcagcgaagtcgacagcgcaagcggtggggcgtggtcagagtcgagctgcaggcatgcaacggccggccggaggcaacatatggtagtggcggcttgggttggcggtggaagcagcgttcgggcggtggaatgaaagaggggcgcgtcggttgttctgcaacgtgaagtggcggagctggtggtgcaggtggcgtagggcggcggcggctctagcggcggcggcgcgcggccagagctcgtcggttagcggcggagcacgggctcggcgtggggagaacgggagggggcgcagggagctcggggagaatagggaaaaatggagagggaggtgctgggagtgtttttatagggctcggggatgaagatcgtggccggacgtggcggatttgaagggggaaagtgggggtagcgacgtggggtggtggcggcttggccgatgccgatttttgtgggacgagtaggggggtttggtcgaggaggtggaggggatgggcggcgtccaagcctgcatgtgagaaggcgcgaggaggctggaggaagcggcaatg

SEQ ID NO: 16274 - DNA, 2355 bp, Oryza sativa
  unsure (1)..(2355): unsure at all n locations
nnnnnnnnnnnnnnnnnnnnnnnnnnnnnnnnnnnnnnnnnnnnnnnnnnnnnnnnnnnnnnctcaaaacttctaaaattcatatataattcattcgaactttaaattgggccattcaaattgcaaaattcatcttaattgagctctacatgtttgtttacttttgatgtattgtttacttggtttttagggtttttcatcgttttgcatgccagtgtgtagaatccgtcatttcggaagttcgcgatcgcgaggaaaagagttcagaagatcttttgaagaagcaaggcaagtcatacattccccccttgagcatattgagcctactttataaatgttttaccgtttgcaaataaatatgcatgttttgctaattacatgggataagggtacaacctatctgctcgcttgtgccatattatttgatgtccgtcctttgtcaaacttgggtgataattcgactagcttgtgttacttatgttgacctagctagaactacatgcttagccatgcttaattaccactagctcacataatgggataattacagttttagacatctagtatcttgacgagctgcatgctcgagacatccggccatgtttcattggtcataattatccaactaaaatgcggctgaatgtgggctgtaggtgcatggttttgctagtcgcgcccatagtaattaaggaccggttcacgggaaaccctgaaagacttacagtgcttaacacaaggcggaataggtaactgcttgatctgtagtatagctcgaccctttcctaggcaccggtggtgagggtgggtgtcatggatttaggtctgaacggggtgtccggttttccagatgccagattcgcccatatgcacgaggggactgcccacctccggtgtagggggtgagggtgaaacctttgcgtggtgtggatggtaccgcatgtttatgtaaggagtcagatcacactcacatggcatagtaggtggactttgagtgagagggggaggggaagtgagctgggccggcctgagaggaggcggtttttggcccaaagcaaaggagaaggattttaattcgttttctctttattttaattgattaaatgaactttgttctattaaaattatttcttgagctccgaaaattcgcgagaaatttcagagagtattttaggacaccgagaatattacaaaatatttttggccatgatttttaaaggaaattttaaagtccctcattatttcacttgattaaattgctttaatttttatttattttctagaaaatgcattatttaatgatttttaatcccgaatgaaaatcggggcgttacaatacccatcgggttctcttgccccatacccacacccgcgatggataaatattcccacttaaataccacacccgtcgcgggtacagaatcgtcccgtacccacacccgtgtaggtaacgggtacccatacccatataattgacttgtagaatttatagttttgtactgtaattagccatattagaactgtaaaccattaatattttctctagcaacaatgctattaagattatcattcaaaggcgagtaaaaagaaaattctacaacgcgagtaaaaagaaaattatacaacaacattacgtaatcaagaaattaaataataatttcatataactaaattggaataatgcttaatatatgaaaggagttttatgctataatttagtagttagagggacttacgttatttattgttttaggttcaatctacgagtttctttttaggttcaatctatggttttctttcaccaacggatggtgggtacatataggtataggtaaaaaacatatccatacacacttatttaataggtaagagttatttagtagatccgtagatataaaagttagaacattttttccctgatagagtaaaaacccgtcggatatcgtgtcatgtttcccattgccatctctagtcgagtatcgcgtaaaagaaaaagaaatctccccgtctcgttctcgttgtctcctccgctccttgcgccgccgccaagacgagtcgcgtcgcggctgaacaggggagggccgggcggcgatctccatctggcgagcagagcagcggaggggaggggatcctggtgagcatccgcgtcctccttctgattcatctctctctctctctctctcccaccccaccgggactggaatttgcttgcgttcgtgaaccctactagcttctcttctagatcttctcctcctccttaatttgatagccttaaacctctcttaattcaagtaataacagtttttttgttcgcccaaaagnnnnnnnnnnnnnnnnnnnnnnnnnnnnnnnnnnnnn

SEQ ID NO: 16275 - DNA, 2107 bp, Oryza sativa
ctgtatttaagcattaatttttcggtgctcttttgagatgccgcctttgctatgaaaatatcctgcttggaccttagtgtatgaactacttcagccattaattgtttgagggaaatatgttatcttggcatcttttgatgtcctgaagtattcattgcaaatgatcaggttgcgtatgatatgatagtaaatggtgcaagttcaatatttttctggaactgcatgaactttgtcacattgcagtgttaatttattatgtcctaacctgaattattttatgcagaggaaatgcaagttaataaagaggcacctctggggtgcctcaagccaatttctcagtataacctgcaagagcagagaagcaacgggtttcctgagaatagtgaaaaaaagaatgatagtattgcaacagaaagagtcttggaggcatctcctcttccaaatcaaggctttttcagacccgttcaacggacagaatattatgcctatccatttatttatgctgattaccaaatgccgggacagccacaaccttacaacttagataaccaattttatcaaataaacagggaccacagttttcctattgagagtagagttcaatatcttccattcaagatgccccctcaaggttaccctcctgatgcacaacttcaggaatttcaatattttgtggttattgactttgaagcaacctgtgacaaggagaacaatccacatccacaagaaatcattgagtttccatctgtcttggttaacagtgcaactggacaacttgaagcttccttccaaacgtatgttcggccggcatataatcaacttttgactgacttttgcaaggagcttacgggcattcaacaaattcaggttggtgcctattatagttttgaatattcgttatctttgataaccacgcaagattaaaaaggtttcaacatgattgcttggcctaatagccttcattgctaagtgatcatttatgtacttaaaagtgtataggaaaaaaagagccaatgtttcatgttactgccgattgaaaaaccagtgtacagttgaggcactaggctccaagttgggtggcttaccagcttgcatcacctattagccaatttagagaactggtataagcacactaaaattttcttagaattcagtaaaatttcttggtcaaatgtgtctcctgtaggctagattagataaatcaccatttatgtatttgttccttaggtgctttgtatgacaaagatcaatttacaatccatagtccaaagatgtactgtggtgttctacttatcctatcaatccatgattggtcgaacacagtcctttcacacctggatcttctctctctttgatatgaagctttgtttctttggctaagagctttactgaatcatcttcttccaaatattccaactcactattttacctgaaccatccatagagccatcacatttctgctgatattgtcttcagagccatccaaggagagatggcagttgaacattatgagcagggtcttgttgttttctgtttcttgtttgcaattgatgatctgtcaagaaaacaactaggttctgtatttcaggcaacatttgatttgacactgataaagtggaaactgtaaggaagtatgcatttccatataaatttagatttggttgcattatgtcagctattcttagctatcatatttcaagtttagcacatgacaggcatagttacttataaccttttgtttacgagctcttcaagttgtgcttaaagtttatgtttaaagatggtttttttaatggcaaggttggctctggagtctataactcaacatatttaatccatttgatgacaaatcatacctaatatgtttagtgaacaaattatcgttctttattctttcatatatttaaactcataatatttacatattaatatgtgaattttgttatcttattgaaactgcattttacccactttgaaaaattatgtcttactcacacaaatacgatcgatagttttaagtattctttcattcagaggtaatatagttttttccatgcatgtctaggtagacagaggtgtggggtaccgagctcgaattcgccctata

SEQ ID NO: 16276 - DNA, 934 bp, Oryza sativa
catttgatttgcattgataaagtgaaactgtaagacagtatgcatttccatataatttaagattgggttgcattatgtcagctattcttagctatcatatttcaagtttagcacatgacaggcatagttacttataaccttttgtttacgagctcttcaagttgtgcttaaagtttatgtttaaagatggtttttttaatggcaaggttggctctggagtctataactcaacatatttaatccatttgatgacaaatcatacctaatatgtttagtgaacaaattatcgttctttattctttcatatatttaaactcataatatttacatattaatatgtgaattttgttatcttattgaaactgcattttacccactttgaaaaattatgtcttactcacacaaatacgatcgatagttttaagtattctttcattcagaggtaatatagttttttccatgcatgtctaggtagacagaggtgtgcctctaagtgaggcattgctcatgcatgataagtggttggaggaaaaagggattaagcacaagaacttcgctgttgtgacatggtctaactgggattgccgtgtaatgttggaatctgagtgcagattaaagagaatcaggaagcccccttactttaacaggtaacagatatcccatatttacctggcccttgggctgcctgttctgtttcgatataacattcacatgctatactaatgtgtttaggtggtgtttggatccagggactaaacctaatctctgtcacatcggatgtttggacactaattagaagtattaaatgtagactaataacaaaactaattgcataaatgagagctaatttccgagacaaaatttttaagtctaattaatccataattagcatatttactatagcatcacataggctaatcatggattaattagg

SEQ ID NO: 16277 - DNA, 1179 bp, Oryza sativa
  unsure (1)..(1179): unsure at all n locations
nnnnnnnnnnnnnnnnnnnnnnnnnnnnnnnnnnnnnnnnnnnnnnnnnnnnnnnnnnnnnncctcgtaccctggctgcgcgcaacacgcgccatcactgtgctccaccttcacgcaaaacgccgacccaccttcgtgccatgccattccgcccgcctacgaggaccacgctggcgctgcctcttgctcctttgagttcgagaaaccagcctctgatggaggaaactgagacgatggcaccactgctggcaatgtcctcgtcgtgccctccacggtcttctgctgtgttgccatctcttgctccaccaaggagtccgccggcggggacatctgagttaatggcatagcaactggcgccatgactgctaggtctaccgctgccaccttctgctttgtgcgcccatcttccacctcttttgatgcattactctccttcaacatggccttcaattcaagcacatttgctatcaattccttagtgatcccgacaagaggtgttgccgctgcgggggtgctactagaaggttgcgcccactgtatgttcagccaacaacagccgtcatagatggcacggccattgagtttccaagcatgctcagcggccgctctagtttggaacggaatagaagcctccacatgtgttcccatctggaacactttgatattcttttctgctccgtaaccatcaaacaactggtggagtagatactcatccaccgggtacactagatggctcaccgtgatacggagaactcacttggcattggaagccatggtgagtggctctgataccaagttgtcatgacccgaggccatgacgggataaacaccgtcgggaagatagccgggcggcgtcggctcctggagaagggatgtagatttaggctagggagaagaacattgttgggagggagacattagactaattgatattcattgcttcacttgagatgaatacaatacttcccttatatagagatgatatgacttgatccttaagaaactaactcaaactaatcttatccatctcctaaccaactgctacagtgcccgtggtactgttcatccgctaggggatgcccatgacaatcagtttacatatttaccattctcaagggaactccttttttttctggcatcttcnnnnnnnnnnnnnnnnnnnnnnnnnnnnnnnnnnnn

SEQ ID NO: 16278 - DNA, 1259 bp, Oryza sativa
  unsure (1)..(1259): unsure at all n locations
nnnnnnnnnnnnnnnnnnnnnnnnnnnnnnnnnnnnnnnacttgagatcatatcaccctaggattgctaaacattgacataggagtgtgatttacttttctagagatataattgagccactatcaccctaggtttgcaaaacataacttagttgcttcgttagagttgaccatcaccgagcctagcaacttaggttggttttgattaggtgtaatttagttttaaatcgcctattcacccccctagtcgatatctcgatcctacatcgcctcaacggggattaggaaaccggcgagtttctgaatctcggtgaaaaattccttttctcttgtctcatttatttgttgcatttacatttgtgcaatttacattcatagagatatatttgagcttatatcaccgtaggtctgtaaaacttaacttaattgcttagttaaccttatatctcacattgcctagcaatttaggttagttttgtttaagtgccatttagttttaaattgcctattcaccccctctagtcgacatctcgatcctacacatccaaagcaaacgttgtttctactttttcagattgaccaaagcgcaggagcagagttttacatccctcttgcaatgctatacacacacaaaaaagaaacacagttcgctatcgttaattctttttttttctttgattgatgtgcccatcctacatcctgatatcagaaagggataatggatgtaatttcatttcctcatgaaatgcttcccgttataaaaaaaaccatctgatcaactatatgacatttatttacgatataatatctcaaatgcttagttaaagatatggtatgcgtacatttatcttggaaggtgctaccataatactatttccgtttcacaatgtaagactttctagtattgtccacattcgggatatagatgctaataaataaataaataaataaataaataaataaattaattaatatatatatatatatatatatatatatatatatatataatgtctagattcattaagatctatatgaatgtgggcaatgctaaaagtcttatattgtgaaacgtttcacaatgagctcattcaaattaatagtgtacaattaacgaataaaattcctaaattttcgatcatttattcaagatggaattccggttcgctgaacgttaaatattcgtgtcgaaaagggcgcctacaaatcccagatcggtcacgccggcccatattcccacttgtaaggaacctccggccc

SEQ ID NO: 16279 - DNA, 597 bp, Oryza sativa
  unsure (1)..(597): unsure at all n locations
nnnnnnnnnnnnnnnnnnnnnnnnnnnnnnnnnnnnnntgagtctaattaggccataattagtcataattaagtgctacagtaacccacatgtgctaatgacgaattaattaggctcaaaagattcgtctcgcggtttccaggcgagctgtgaaatcagttttttttaatcgtgtccaaaaatccctttcgacatccggtcaaacgtccgatatgacacccaaagattttcatttcaccaactaaagatgcccttagctatgggaaacctcgggagaaggcgcgtgcacctataaggtaccactttgaacgtacgtgctctccaagaactaataatagagaaaaaaaataagaaaacgcaagagtagactaaaaaggttattgaaatataacaacagaagattaaggagtaaataattaagagcgtatctgatcgtacgcatggcaaaatggatgaaaaacaaatttaataaaaggaaaacaaaaaggaaagaagaggtagcttaattaattagctatagctgtagctcttacaggcgcatatgcagacgatccagatgtagaagaagttgaggtaagggatgccggggtgggcctc

SEQ ID NO: 16280 - DNA, 607 bp, Oryza sativa
  unsure (1)..(607): unsure at all n locations
nnnnnnnnnnnnnnnnnnnnnnnnnnnnnnnnnnnnnnnnnnnnnnnnnnnnnnnnnagctgacctgcctcttcgtcggtcatggccgcgttgtgacggcgccggcggccggaggacgggacgaagctacgcgcgctgcggcggcggcggcgatcgactgctggtgttgatcaggattcaagggagagaaagatagattgttcatgggggagccaaaccagaggaggttgtaccaagtctggcagggaagcaacgtacgacacgatacgatcatctcgcctctctcttccttccattacttctctttgaaaatcttcttgcaacctgcaatttttgttgcgataatccttgtgaaattcagatcaatattttttttgtttacactttgagatgacagacagctttgctttctccatttttttctttttcagaaatttctctgcggcggacgcctgattttcggtccggatgcgggttctctgttcctgtccaccgcgctcatagtggctcctctggtaggcctatgctgcccatgcatcacaaagatgaactcgatcaggtcagagaaacaagatcttggccttccctgtcgtcattgccaccatcg

SEQ ID NO: 16281 - DNA, 1775 bp, Oryza sativa
  unsure (1)..(1775): unsure at all n locations
ctgttactgatgtagtactgtacattattaagctgatatattgaattactgaaacaaattatttacttcatgcttcgaaaaacaagtttccagctatttcaccggattacttaaacgaattatttacttcaagcattaaaaaataagtttgggggtttgctgaaagtacagtgggctcctctgcctctgcccttccttgctattttttttcctttttaagtagcctttttccttagtatcagtcttctcctttttcggttttttctttctttattctccaataatggcaatatagccgttttgtgttgtgtaactaaactcttttttcttttgatatattgatgtgtaatcttttttcatgttcgtgaaaaaaataagttttcttaaaaaaacttcttctactgcgttgttttaaactatttgttaaatttatttttctaaatatttgattaatccctacaaccaagtagataatccactcgataaaataccaatgatgatatatttgatgagacggaggattgttttcgcattttgtgcagcggaattaccggttcttcttcctgttcatctcgacgtcgaccctcctctgcgtctacgtcttcgtggtgtcctggctgaacatcgtggcgcataaggacggcaacgacggctcgctgctgaaatccatggccggtgagccgttgtccgtcgtgctgatcgtgtacaccttcgtctcggtgtggtttgtcggcggcctcaccgtgttccacctctacctcatgagcacaaaccaggtaggccgcatcaagccatgttgttaaattgtttgttgagttctttcctgaagaaaatgcacgcaagaattgtcacaaagatgtccaatttcgcgacaaaattatcatgctcatcactacttagtgagcaggttgtcaaattctcgattctatcgtaccatttatgactttacgatcgaaggcctgaatctatgattatttacgattttatgattgtaaccttacctagaactatgattatttaccatttttaatatattttttaaaagaaacttccgattccgatctaggatcgagattttaatgaacataaattgcacattttgatttcaagtaaatcctgatctaggattgatttacttgaaatcgatacaaaatttgttctgaaaaaaatatttgtgatcactgatgtgatgcttctctactgcagacaacgtacgagaacttcagatataggtacgacaagaaggagaacccgtataacaggggtgctatatcgaacatagcagaggtgttctgcgctgggatcccgccgtcgatgaacaacttccggtcatgggtggcgccgccgccgctggaggagccggacgacgtcagcgggcagcttccgccgaggaacggggccgatctcaccggcggcgtgaaggagaaggtggacctggagatgggccgcaacggcggcatcatcccggcgatcttgcgggggctggactacgacgagatggagaagaacgatgtcagcgtgcatatcaaggatcggggagcggcaccggcagcgccggacccattcatggccggccggtggcacaacgaggactgtgagagtactccgacggcggtgagccaccatgtaaattcagaacgattatgacgtccccagatgcctctagttgttgcaaatttaaattattctttttgggcgttttggctctaaagcaagttnnnnnnnnnnnnnnnnnnnnnnnnnnnnnnnnnnnnnnnnnnnnnnnnnnnnnnnnn

SEQ ID NO: 16282 - DNA, 1087 bp, Oryza sativa
  unsure (1)..(1087): unsure at all n locations
nnnnnnnnnnnnnnnnnnnnnnnnnnnnnnnnnnnnnnnnnnnnnnnnnnnnnnnnnnnnnntacacttctaaaaaaggagaataatagcaaggctgagtacaataactgtactcagcaagccacaccagtgatgcagacgtgcaaggggatacaacggagggcttgtggctatttgcatgaaggcgcgttgcaaagcattttattgagcaaaacaataaaacagttgattaattaaggtaatattaaagttgcataaatcatcgatatctacaacttttattttggtcattttgctatatgactctatttcaataatttgaatttgaatttcaaattatgacaacttcaaacaatattttcaaatactaaatgatttcaactgaaaaagttatcaacatcaaagttgtataactcatcaatatctataacttttattttggtcatttcttcatccgatgaagtgatagtaacattgttcacaaaatttacatatctcttatatggttttgaagtatttaaatagcaacgaaattgctataacgtcacaggttttgggccggtttatgacgaaatcgataaactgtcacggtattatgggccttgtatccatagttgcatatccgtgacaatatctaaaaacatcacgaaaatttcgtcacagattaaatagattcttgtagtggcggttgcaaagcattttattgagcgaaacaataaaacagttgattaattaaggtaatattaaatctccactgatcaacgctacaccacgttgaacaggcccaaccaaaccacctaaactacctagttcattaagccagttaaaggtgagactaatcacggtgaatatggttgatcgcccataaccgcgggcacggctattcgaatagttttactcttgccagaggtgcacaactatacccacaagtcacaatccaccggcatgtcaccgtgcctacgcagacacatcactatgttgagtgattgtgacaagacccttcacataaccctcccctaaccatccacaccacgcanaggtttcacccccaccccctaccccggaggtgggcagtcccctcgtgcat

SEQ ID NO: 16283 - DNA, 713 bp, Oryza sativa
taaattaggccgaaaaaaataccgcaatgaccggctattttctttcttttttttagtccaaagtcgaaaacaaatcagagtcgaattggcagtcgtttaaatagcctaacggttcgtacataatttcacaaactacaaatatattgatcaaactaccttaaaactacatatttaaggtgatgtatcacaaaactacaaatttaacactaaatttttatagtgttcctcagccaattgttggtgttttttatttttaatatcattattaccatgtatgccacaagctagaataatcaagaataatatttttctctctttacgttcttaatataactataattgtgtgtgtgagagagagagagagaggagcaatatgcacacttgtacttggcagagaagccgtttcaaaggagagatttaagccgaccctctaatgccactgcctaaacttagccggacaaaattaattaagacaaaacacccaaaaaaagtgatctcaacgctttagcagatcaatgcttgcaattaaacccccattgcttacttcttggcgaaagagaggagaatgcccggacattctcacaaccaagcatcatcttgatgtggattcagacaactaaacctgcaaggagaagaggagcaaacgtccttgcccgccattgcggcgatgaccggaggcggcgatgggtaccgagctcgaattcgcctatagt

SEQ ID NO: 16284 - DNA, 763 bp, Oryza sativa
gctctgatgaagtaaggcatggcgaacggcattttagtaactatacaaagtttaacttggtttcatcatcaaagtgtacttaagctcacctgcgaaagaaatcctccaatagctggtccaacaaccagagctattgctcgcgaggatgtgacctataacatataatacgaccaataagtagccagtactaaaatataatcagtaaaaattttaaatcctcatcctatagagataaacaagaagcttgaaatgcaaaacaagagtataactcttcttacaagggaaattccaagagcttggtgctccttcctgcagacctctgaagcataggcctggacaatacatgatgctgaacatgagtacgcaacaatccagtgtcatgttcttagcatcagccatcaaactgtaaatttaccttgattggtcctagtataccacagagtaatccaagtaatcccctggtaacaattgccatccagtaagtcgtgctgaggccaaagagtgtgttaaacacaatcctggaaatggtaaaacaagatttacttcagtccagtcgaatgggatcaagtatgatttaaatagtctaactgagtgtttcatacactgagaggatactgatcacaatgcagggcttcctcccatatttgtcagcaaaaatgccccatggcactgcactgatagttcttccaaggaaataagtagccccttaaacagagaaattaccgtttagtcggtaacaagtaatccacaataatcatagtgg

SEQ ID NO: 16285 - DNA, 1849 bp, Oryza sativa
tcaacgaggcagtgctgcatcgcaggtaacaaggtgccgccggctgccagggcagtgtagccgccgcttcgttcgcccatcgcttgttgctcctcccagactcgcccgctgccaccgctcctcctaagctcgcccgccgcatccgcgaccacgatggcgtgccactgctagagcgagatgaggacctgctcagtgtggggcccacgttggactaatttaagccaaggaaaaactggttttaaatgattatttctctctcctattccttcgaaaataataaagtaatatcacggggccagcagctaattatctttttttcgatgccttacaacaaatacgcattcttacggtgtctcctagctaattacactttttttatgtcatgtagcaaagtttgccaaaattgtattggttgatgtgtattgaagtaataaactttctggatttgcggattggtggaaggagttggtttattttgggacaaattttaaactctaggagttgatttattttgggacggagggagtgttaaaaaaaaagtaatgttagattgtcattgggcaccgggccgtagcactcgataaagggcctcctaccaccatacggttaggcccgggaacttccaattcccgccgtttcgatcgagagagctttgggccgatgacttccggccattccatggcacgccgagctgccacgctcgcgtcgcgtccagatgcgcgcgcgcgcatatatcttctccccgctcaccacagccattcgtccccgggcctcgccgcgccgcgccacgccacgcctccgcccgcgttcgcactgactgacctgtcacgcgcgcgcgcgggggggagagcgcgaggaggaggagaaaagatcttcgcgcccccccgtcttgtcctctgtggagccgaggccgaggccgagctgagctgagctcgcttccgtgctcggccagcgcacccgcgcacgcaagcaagcaagcaaccgagcaagaagacctgcgctgcgcgcgcgcgcgctgacgggcggaggcgaggcgaggcgatgctctacctgctgccgctctccgtctcctgccgggtccccggctcgccgccggcgccgcgctcgcggcgcttcctcgaccccggcggcggccggggagttggggatgggttaggcggcgtcagggtgttccggaggcgggcgctgcgagggaccgacgtccggtcgaacacctcgtcgtcgtcgtcgcggaagggccgccacgacgacgcgcgacacgacgggggatacggcgacgacggcgacgctggggcgctgctggcgtcggtgaggaggctgctgctctccgggtcggcgcaggacgacgcggcggagggggaggcggaggaggacgagcagggtcagttccccaagcgatgggccatcgtcttcctctgcttctccgcattcctcctctgcaacatggaccgcgtaaaaattcctcctcccttctctaacgccctgatgaaccctagattcccccccccccccctcctcaataattccatttcgttgatattgtaaaatgcactaatgcccaaatgaaccaaagatgcagtttcttgatcggatccaaaaacataaacttgtcaaatgccgattcctaatgatgattggtagtagtatatgttaaaagcttcaattctttcttgggagattcatgctttcaacattttgcaggtaaacatgagcattgccattctgccaatgtctgcagaattcggatggaacccacaaactgttggcctcattcagtcatctttcttctggggctacctgctaactcaggtctgtgtgcagtactaatccagggaaatctgtaactagg

SEQ ID NO: 16286 - DNA, 3861 bp, Oryza sativa
  unsure (1)..(3861): unsure at all n locations
tcttctactcctttgggtctctgggtgtattttggttttcgacatgggcgagcaaggtatttctcggtgttctgttcaccatttcactcggaattggtgaattactgtattacttttctaatttttttttagttatctcttaaatttgtgatctgcttctataaaggcgtatagtagtccaattgaggatccaggaattagtgctgaagagaagaagcttataaccagtcaaaccacaggaggagagcctgttaaagaaattccatggggactaatattatcgaaaccccctgtttgggctcttatagtgtctcatttctgccataactggggggggggggggggaaaaaaaaaactcttatagagtctcatttctgccataactggggaactttcatcttgctcacatggatgccaacatactacaaccaggtatgatcagcatcatagttttctacctgaggatcttgaaccgcaatcccttgtgtataataatatttaaaaacaggttctgaaattcaacctcacagaatccggccttttctgtgttctcccctggttaacaatggcagtttctgcaaattttggtggttggatagcagatacgcttgtcagtagaggattatcagtgacaacagttcggaaggtaaattaatcccttcagtcgtgaaatttacccatgcaatgaggtgctatcaaactccaacggaatattcaatatgaatcattgttctaccattggcaaaccatgcttgaatatgtgaatttgtgtgcggcataattaatcaacataatgcttagaagtgagaatgaagagctaaacctaattcattgtgcatgactttctatctacttcgtgcagatcatgcagtcaattggattcttagggcccgcattttttctgactcaactgagccatatcgattcaccagcaatggcagtgttgtgcatggcttgtagccaggtaaatggcagtttggcttcttgtcattttcctttattctgtcatagaacagccatatattatgtacctctttttagaacaactgtgatttgtatctgaatggccattttgagatctatctcagtatttccagcataacatgttgcatttcttattctcagggaactgatgcattctcacagtccggtctatactcaaatcaccaagatatcggtcctcgatacgctgtaatcaactctctttagcacaaaacatttcttcaaatgacgcattttcggagttctgtctgaaacattatagcttcaggtgaactcacatgttgtcttgcagggtgtactgcttggtctttctaacacggctggggttttagctggtgtgtttggcacagcggcaacaggatacatcttgcagcatggtttggcctgaaatccccatctccctagtgacataatgcacatcaattttacaatcttttacatgattttttgttgctctgtttaataaacgcaggttcttgggatgatgtcttcaaagtatctgttgtgctgtatctggttgggactttggtctggaacctattctcgaccggtgaaaaaattatcgattgatgcttgtatatagcctgcttacagttcaaaatggaaagtacatacggttcagtaactggtgagatgagaattgcattcgatcaacatccattccatgtgaagctcaactctttgcagaaacagaactacagactgcaaacttttccgcgcagcgttagacatgcaattcttggcagaagaagtttcaagtgttcgaatttttcacatgattcaggatcttcgcacaattttgcaaatgaagcatgtgcaagaggtttgagttgagcaattaccaacagccagttttttaggactctgtaagtataggtatttctgtacagcttagatgaagaatccaccatccaccgtacacccctattatttttgacttgttacacaattttcttgaacatcgtatttctgtaaagtttgtagttaacaagtttaggaattcggcaatcttacctgattcttgtgaatttaactgtttgagatatggcccttggcatttgatgggcatggtttcatctacactttgtgtgacatgtgttcctaagtatagttttccaactatggtcaatatttgtataattatattaggcaacgcatgtcagaagaaagaaaagcgccaaagaggaattgaggcatggctacaagtgaacaatttaagcataaacgaatagaataatcagtagtaccagcgctgcttattatttattttaaaaacatatttcggcatatcattttggaccataacaacatggcatctcaacagtcaacaatgcaaaagtaaagagaacttttgaaccagtcccttataatagggcaactaaatcaaaactggcaataaatatcaagacttagttcatcaaagcaaccatacattaccaggtattatcagtcaagagggcctcaggcttgcgataaatattatctacactacaagggttgagctgcagcctagtctttacttgcagtatctcgtacaagcaaagcaaccaagcttgcacatttaccaggtactccgataaagctaatttgctattgatctatatcacacgagcgacagggactgattggcacgttcagcagtttgtgtcatatgttgcaagcccttgcaactcgggcccctccaaccttggatttttgtcaaagctgcagagagaaaaacaatggcttagaaacaatgcaaactggggcgatgagttctgcatatgccaagtgacgacaattaatggaagtccacaatacatagaaaacaaaatatggcacttagtgagtcatttgttgtgtcgattaattctgattcagcaattagcgtatatggaaaagaaataaaaaaataaactctggatctatggcataccacagaaaaatgagtagctcttagaagataaagaattcaagaaaatgagtagagcactctttttatctggtacatagatatgtgctacataacaaccaaattagtattatggcaaaagatgagctgcactgtcaaatcagaaaaacttagccgaggttcactagtaatcaattttatgacttcgggtgttttggtttttggctgatggaatagtgtggctaatgtctcaagtcctctcatttatacagaagcacaacattggatgtgcaaaagcaaaaaacaagtcaacataattgtaaaataaattggtaacaaggcttttagatcttacttgttcaggggtatatgctcaaaaggcccgctagtaggaatcgtgccgcaaagatcattgttcgagacatctctggaagcaagaatagatagacaaataaaagatcatcattaatatgtacagaacataaaaattatgtgaaacagcattgttaactgagcacttacatcactttgagactagatatttttgccagatccctcgggattggaccgtttaaactgttgtcattaagccgcctaaagaaacaaaaataaaaggattaacatagcgtaaaagtaccagtgtaccatagcataaaaagaattaaaaagaaagtgatgcttgcatatgtggcaaaatggtgcaaaagtggatatatgttaactaaagtatagttgcttaaaagaataagtacagctaatcacaagaataagtatagttactcacaagaatactaaggaactcagcttgccaagttctttcggtatggttccagtaatgttgttgttatacagatccaagctaataaggttcttcagactcccgagctcagctgggatagtgccctgaatattgtttttgtacagctctctnnnnnnnnnnnnnnnnnnnnnnnnnnnnnnnnnnnnnn

SEQ ID NO: 16287 - DNA, 2853 bp, Oryza sativa
  unsure (1)..(2853): unsure at all n locations
nnnnnnnnnnnnnnnnnnnnnnnnnnnnnnnnnnnnnnnnnnaaattagtattatggcaaagatgagctgcactgtcaaatcagaaaaacttagccgaggttcactagtaatcaattttatgacttcgggtgttttggtttttggctgatggaatagtgtggctaatgtctcaagtcctctcatttatacagaagcacaacattggatgtgcaaaagcaaaaaacaagtcaacataattgtaaaataaattggtaacaaggcttttagatcttacttgttcaggggtatatgctcaaaaggcccgctagtaggaatcgtgccgcaaagatcattgttcgagacatctctggaagcaagaatagatagacaaataaaagatcatcattaatatgtacagaacataaaaattatgtgaaacagcattgttaactgagcacttacatcactttgagactagatatttttgccagatccctcgggattggaccgtttaaactgttgtcattaagccgcctaaagaaacaaaaataaaaggattaacatagcgtaaaagtaccagtgtaccatagcataaaaagaattaaaaagaaagtgatgcttgcatatgtggcaaaatggtgcaaaagtggatatatgttaactaaagtatagttgcttaaaagaataagtacagctaatcacaagaataagtatagttactcacaagaatactaaggaactcagcttgccaagttctttcggtatggttccagtaatgttgttgttatacagatccaagctaataaggttcttcagactcccgagctcagctgggatagtgccctgaatattgtttttgtacagctctctgtaacaatttttcaaaaactagttagagcactaacatgaatgtcaagctcaattgcagtaaaatagcatcggaaattaaggatgaccaaagcatattttataaatcaaatggatacaagacttaatgatgcagtcttggcacaaatcacgagactgaaaacaaacagttcgttggaaaaactgtacaatatattgtcttatagtggaccatgttcaatgctggtgtttattttgcatatgaacagctcatatcagattcatatgttctgatatagctgagattcccagcatttagatttagttcatcattttacttaaaaagaatcatctctcttgctcattaaaataacactccgaaaatgctctagtttcactccactaggaaacggaagctgcaatcacataacaggaagtgagaagatcaaaacagtaagtcaataattacgtgccacaaggaactgttgaaaaccacaaattgtgttctagatttctggtaatgtgagagtttccatttttcccccagttttttcaccatttgccatgatatttgcagtttaattcatgaagcctagctgtttaaatgactttacaaatccagcgctgaagctttatgagttcaaaaaagaagtgatgaaagaaaggaagctaggtctaacatagtattccagctgtaacttctacatgacaagcagttggcagtgttgctgaatgctgaccatatgtaatgcaaacttaacaggacatgtgagtttttagcttatcagtgtcggtgatcattgccatcagagaacctttgctgaatgaactctacattttaacacttcagaaaataaagtgcatcaatatgtagaaagacttacagatattggagatgctcaaggtgtcccagttcaggagcaagatggcctgacaaatttgagttacccaagtctctacaagatacaaaattgttagaaagtatcagaaaaatgttaagatggacaaagacaatgaattgaaccaagaacataggtaaccataacaaaatatatctcttgtatggtaatggcatcatggtgaacgctgcatcgaaagaaaccacttcgatgaatcaatttctttccttcagcaagcaaacatatataataggtaccctaagtccaaaccaatggaaggatgcaagtggaccggtccgcaagcccccatataggccatttttgcaggccaacctatgggtcagcccacgaaaatgtcccatacgcaggctcgtgagtcagcctgcttgcatccctacaatggagtacataaaagactacaaaaatctagtcgtacagtgaaagcagtaagactctatctagggtggttgattgctaagtactccctcgttcacatttgaccagcgcattccatcttgacacttccatttaatccccatgataatatctgtattaattggctacatacacatcctcgctacatgcggattggatacacaactttttttttctttttttaagctgaccattagcaggcgatgcattgttcccgagatgcatggcgtgctagcggagtaactcacgtgcgaactgtgcagccaatgggtaacgcgacaatcatcattggataattgctttttggttttacgtggatcaattgcgcacatagagaatatagcttgcatcagcgatatttccatgcaggatcaaggagtactccccggttccatttatagctatcatcagcataattatgcaaatacatgatgacatagctaacgtgcaaagtattgatatcaaactactacatgcaagtaattagtagatattatatagtgagtagctttactgttgctacaaactaactagtaacatttactattacagacaaactgtattgcaacgatgattccacatgggcagaacaaaatcttttaaaaaaaattaaatgacaatctacaaatcacgttctttgccagtagatcacggtctcaccagagggtaccgagctcgaattcgccctatagt

SEQ ID NO: 16288 - DNA, 3241 bp, Oryza sativa
  unsure (1)..(3241): unsure at all n locations
nnnnnnnnnnnnnnnnnnnnnnnnnnnnnnnnnnnnnnnnnnnnnnnnnnnnnnnnnnnnnctcggatcttctgcggcgtaaatacgcgcgagtgagcttgttgtgtgacggtgtgagggtgagatgggacacgcaacgcctcgctgtcgaggggtacgtcgcctatcactgaaagcacaacgccgttaaatcctggaaaattcgctctcatggggagtcgaacccaggacctcaggtgctactgaggctcttgtaaccaccaggctacaggcccgtggttataaatgaattactctatctgttttatattttaagttatttgaattttttcctagtcaaactttgttaagtttaatcaagtttatagaaaaatttagtaacatttaaaatattaaattagttcatatattctgataatatgtttgttttgtgctgaaaatactactgtatttttatataaacttgatcaaacttaaagaagtttagctagaaaaaaagtcaaatgacttataatataaaatggagggagtagctgttactccataaagttataaataagagtaaattttataaaattacatgtattttgacatcacaaaactacaaatttaatatggtatatcacaaacctacatatatggaagatcaccactgcatatttaataataatattatcggttttgcaccaacctaagtacaagactacaacatttataactctcaccataatagtagtggtagggatttaaattgtaaaatttgtagttttatgataactccagtattaaagttttatttttgtgatacttgataaatcttatgttcaatctgtagttttatgatacaacatctcgtagttttatgataatttggttcaagtgtttgtagtgttgtaaaatttagtctaaaaataaattttaaataactttctaagaaatatatttatacatatgtttttaaagaaaacacaagttcagaaagcatgtgcattcatccatcattccattaatgagaaaaggatagcccaaggtaaaaggattaaagtgaaggcattgtattcgatagggaattttatgtttggaatggaggattagcttttgcttttcctttggaatgagataatgagaatgcttttacagcaccatactaaattatttgttgatcggtggcataaaatttgtttatttaggtctgaaaagaatatagcataattaacacccatataatttccagaatcataagggccacaatacaattttgtgtggcttactaagaatgccctagcttcattcagatttccatctatttctctctcacatgtatgcaacggtttaaaacatacaaaaaaaactgaaggaaacatagaggattaaaaatcctatggaaaattgtcagggccatggataccacatacctaatagtagttgactaaactcggcagggcccaccacataccatgtcttatacggatacaaacctcgtatataaaaggagttccggataaggaaggacaaaaagagttttatatggaaacgacagggattactcggatcgtatccatatttatctccctagttctacttggacaaggggtcatctatgggtataaatacaagccccccaggaggagagaggggacacccaccacaatctacgacgccacaaaaccacaagccaatacacatcgccagatctcgacatcagagattagcctagccataccccatccggtgtctacggaaatcggcaagagggatctagcgccatctctgatctcgacgagttcatgttcgaggaggaagactacctgttgtcgactacgagttggttatctagccgctaagtcgacaacagatagataggttatcccaaatattgtatttgtgtgatacagatgaataaagagcaacaccggcttcggccaacaggatgtanggctattacctgtaagataaggggcccgaacctgtataaaaatccctgtctccatctcttttacctcaatctcgcatatactctggtaccaataatccccataccatccaaataccctagtcgtaactatcaaacgtcgacaaaaataatcctactccgtccttagaaaccgtcctttggaattcctatggaatataccatttcatgggaatttttgaggaaaactaaggttcctataattttcctttggtgttgctaaactacatttgttccctatcgaatacaatgccttcacttgttttttgggacatttatcagatcacaaatcaaatatatagtttaggtagaaacattttactttaaccatgctaaaaaaaggtgaagccacccaacctacaagagcatgccacatcatcacatacaatatatgaatggcttcatctagttgttttgatcggattttgccatccaatatatagatggaatatgctatgggtgacaaccatatcctcaatcgcccatgaactaaacaccactaaaaatgtaactgctatatcatgattgttaaaatggtacgacgtcctaaggttgtgttctttacccccatcttccaatttctatcctctcatcttttatacgcacgcttcccaaactgctaaacggtgtgtttttttaaaaaaaaaatctataggaaagttactttagaaaatcatattgatccatttttcaatctttttttgtctaatacttaattaattatgcactaatttaccactctgctttatgtgcttgaagggttagtttccaactctctataacgaacacaacttaaagcgatcccgaattggcactcccaaactaattaggtgccaagccaaaaaaaatcttatatggcagcaaatcaaggctacattttaagagcagtataacaaacatatatatctcttattcttggcaactgagtccatatagcatccaccaccttcatggaccatggtagcatctgtccccttaggaccatcaacattataaattgggcttttagattttcgggcctttcccgtgtgcaaccaatttgccttgcacatcagccattcaaatcaaatcgaacaactgtcattttgttgctgacgtggcttaaccacaaggcaaaggattcctattaactacaccaggcgtggatgaactatataggtatataagattcacatagaaaagttatttgactacaataatgannnnnnnnnnnnnnnnnnnnnnnnnnnnnnnnnnnnnnnnnnnnnnnnnnnnnnnnnnnnnnnnnnn

SEQ ID NO: 16289 - DNA, 3126 bp, Oryza sativa
  unsure (1)..(3126): unsure at all n locations
attataaattgggcttttagattttcgggcctttcccgtgtgcaaccaatttgccttgcacatcagccattcaaatcaaatcgaacaactgtcattttgttgctgacgtggcttaaccacaaggcaaaggattcctattaactacaccaggcgtggatgaactatataggtatataagattcacatagaaaagttatttgactacaataatgaaaagactggaaaccaaaacaatgaagaggttcctcgactagcaatcataaaagcattttgattggtatcctattagattgactcagatcatgaagctgttgaaggtggatcaccctcggagccaccacaccgtcttcctttatgcttcattaacatccatagctttatatacgtcactaacaatcatagtagaaaaaaccggactagcggttcaaccggaaaaaaccggaaccagctccctgaccggctcggttccctcaaaggatcgttcacgcaatcgacccggtgtgaaccttgccgaccactaggctaagtaagttgctgtgactggaagacaacacaaaatatacttaggaaataaaccgcggttcaaccagtgacccaacggttgaaccgatagaccggtgaacccaacactccaccgggtcaagcaccggtccggttttttctactatgctaacaatctgtgttgttgtgtacaacctgcaaggaaccaagcaacacatgtcctatattatgtatcttttactatgcttactcaaactaagttgaagtatctttagcaatcattagacaatatgatttgtactataattatgtttccctcatgttatttgatttgctttgaatactactcaatcttaccctacaatcatccataagtaacatgttgaaagttcatgtgccattaatttggttttggtgattaatgataaatccaaatatgtgagactaatgtttttataagcatttctttgcctagtctcatgtggatatgaaagtagagtgtgtgagaggtgattcccggacttcatatgagttgagatagaaacattcattgatggtggacctaaatcacaaggatgaaatgcatggagatcaagatatatgtatcactctttctctccatgtacatattgatatgttcatatataatatttccatgtgattgacatatgcatgtgagactaatgttttgtttgagtcttatttcttatttagtctatttacattgagaacatggagatgatgaatgtatgtttttattttaatgtctatatttgagaaatgccttctattcttgtataggataagctctccatgtttcatatcttgttatgcatgctcttgcttcacacaaacattttgtatgcatacatttagggggagcaaatcctataccttagttatgcatgtatctgatccaagttattcacttttatttaattgggatctttacatttgagcatatatttgagtatatgacacttatggtgttgattaatactcatcatttattcatatccttttatacatgcgatcggttagtcaacatgtggaggttgacaaccggatcattgagactaataatttcactaagttgaatgagaaaaataggttccaagtattgaaaaggtgttgacgctcaagtgatatgattacacctaaaatacaaagaataacaaagcaaagatattgaagatgattacacctaaaatacaaagaataacaaagcgaagatattgaagatgtgggatacgaagtggctactatggcaagacggtgaagggcaaacgatgctcggtcgcgatggaccatgcggtggtgaagggcaagcaaggggcttggcgctgaagaaccaaatcctgtggtgaagggtgagtgatggctttgtcatgatggaccgtgcgagaccatttgaagctacaagtaaccgcatcaatcatttgaagaatatacggtgaaacggttttggcgttggcgtcccttaagacaaaggaaggaaatagaaagaaggcattcctattggtataattctcttcctatttatatttgattataggaatgccgtactattaaatcccgagggatgcaacgtcgatgcgtttgtatatgtcccctctcggtgctcaaagtgacctatcatagtgctaccttgagagaaacccaagctttaacctatcatttgagtggttttagatcttgttcttggttgagttgggtagtcctctaagtgagctttccatagagtccaagattataaaaaacggactcccgagcaaaaagttatggtcgttttactctgtgcttttcggaagttccgaaaattatcgaaagttccgaaaatggctgcgaaactgagttttgcttctgtaaattttcggaagttccgaaaattcctgtctttgcctccaacggctagtttttgagaggctcaggtatataaactcctccaccccttccttgagtggctgttgttcttgggcaacattagacacatccaaacccaaatagccatctctatttcccatcctttgtggtgcctctttgtgaaggggatttgagaagggaagaaagttggattgagagagtgaggagttgagacctagttagcttcactccatcctttgtggtgcccctttgtgagagggatttgagaaggggagatagttggattgagagattgagaagttgagagctagtgagcttcactccatactttgagcactcgggttcatagcaagcaaatcttcgattgtgtttgttactcttggggactaaggtctcctagacggctaggcgtcgccggtgagcaccgaaggttgtggtgtgccacggaaagtttgtgaaggcttcaatttcgcctccgcaagggaagaaatcaagagtgaaaccgaggagtgcatttgtgcaacctcgtgaggaaatggttgaaataggcccggcccttgtggctcctcaacggagatgtaggatccgtggatccgaacttcgggaaacaaatcaacgtgtctcctattttggtttgctcgtttttgccatcttttatattgtgctcgagcttattttnnnnnnnnnnnnnnnnnnnnnnnnnnnnnnnnnnnnnnnnnnnnnnnnnnnnnnnnnnnnnnn

SEQ ID NO: 16290 - DNA, 3162 bp, Oryza sativa
ccctttgattcatatacattttatttgttcgagctacaagttcatagctagtgttttgaggagtttggttggggcaatgagccagttgaagatgctcatggatgtgacattacatgggatgatgtggatgaagctgttggtacgacacactatcttcgaggtcacaatgttccaaggagagctcacaatcgtgttggtctaataacctttcaaaggcgtcaaaggaatacaacaacaactgaagaagatgagtaaaatatgcaatctgaccaagaagaatatgaggaggatacacatgatgatacaaatgtgagtgattgtaatgaacctcccactagagtgaagagaatttggatgctaatgacaattttaatgagtttgatgatgaatactaagaggcaatgagttggacttacaatacttttgtttagagtgtggaattgtggaccactattatctatatatgccattaggcgtatgataactcccactattttgctatgtcttttgttttatttgcctgctaggctggactgcttgttagttggttatgtatttgttgttgctcaaatgtttattttgttgtctctattttttttgtttatctaattatcttgcccattatccgcgtgcctggctgcttggaagaatgaatggcagggcatcaacaaggtatgctactcaagtaaatataaacaattcattaaccatcaatcttcaattctgaatctattatcttcgtaaaaaaatatcgatgcttctaaggaggatggatactgccatggaggtggtggatgctacatgggctcatgagttaccaataacaaggtatactaggactttaggcgcacttcgtggcgcgctaccgttcgttaaagagacatgtgaaaggaccttgatgtcgcctagaggggggggtgaataggcgttcctaaaaattatcacatcacaacttcatagcatattagagtgatgaaaactttcgattcaagttggaacttccggtatggggttggaagttttggtctcaaccaaaaagttcggcggataacggaataaaaagtttatgaaaaactgaactgtttatagattttctagccgctagcttatacaagaatctgcacttggaagaagctcccgaaacataccctcgtttctcacccccaaattcacctcactccgctagcgccgctctccctcctcacgtcacgcgtgccaagtgcgatcccccctcctcgccccaacacaaacccctctctcatctctcctctctctctctctcgcaaaccctcctcctctcctcccctctccgcccccgccgccggccgtgcccctcctcctcctactcctccggccgaagcgcgccgcccacgagcatcagctccccctcttcgtccctccctccctccccactgtccgccggactgacggtggggggcgcctctcccgcccacgaggatagaaagccctagcttcgtctctgctctgtgcctccgccgctcttcccccgctggccggacggcggctgcccctcccctcccctcccctcccctcccctcccattcgtcgctcgtcgacccctctccgccgccgaggctcgctgtcccaaggtattcctcttgtccccttcctcggctcctcctccccctgcgccgcaactctgccgtggcccgcccggccgcccggagatccgtccgggctcggctccgcctcatttctttcgctggcgatgaggtggtctaacttgcgatgcgtccagagtaggctctgttcttttgtgttcttttggttgagttgggaacccatccctccggtacggaaaacgaagcagtccattagcacgtgattaattaattatttgctatttttttttcaaaaatagatcaatataatttttttaagcaactttcatatataaactttttgcaaaaaacacaccgtttagcagtttgaaaagcgtgcacgcggaaaatgagatgggggagttgggaactccaggaaacgaacagagccttaaatccagatggatgtttctcttttacctccagctaatccgtccgcttcgttgaggattccattgaatgcttggctgtggtggagtgctacacgactgctagtagcagcttgcttctcagcaatttgggtgaaccccccacattcttgaggtatcgctgcattttatttggcagcgcatttataattgctgtcttactaaaaaaacacatgtttttattttctccttttaacattacattttatatgcatagccatgcaaagttcatggtacagtagggtctactttcaccttatttgcttgtatacctgaaaagcctgactgttggacatagccacgcaataattgtaaagaagaggttagaataatctatatgctaatattgatccttttatgttactgattctgcgtgtatttcaattgtacctcctgttggacataggcatgatgaagcaaactgtttacatttagagtgtattagagcataggaattctatcatcgcaaatggacagatggacatgctatatgaaaatgtaaaatgcattagtctggagtagctattatgtgtgctccatttcaaactgtatatgtggtacttattctggttgactcatcatgtgcagtgttatctattttcaccaaattttaattttttaatagccaacctgtctctttgacatgttgtatccgtcaatacaggcagtaacaattggatctacatcttgccactacaaaaggatcaacgatctgtactagccttcatttgtgggttcctcattgggaattgggattctttacaatggcagatatgagccctaggacagatacatcaacagatgataccgatgataaccacatggcaagtctttctttctttcttttttctagactaattcttgttaaccttgatatgattgggcacaaagcatcaattgtccagtttcatgtttggaggaaactactaaactattatactaattatcattcaaaagtgagaaagagcatcaattctagcaatagaaaattaaaacagcaaggttgtctgaccaagtaaggatgtatactgtaaagggatgtttatatgaaaaataggctatccgtggcagctgttcaggaataatctccaaaattcatggaatatgtatat

SEQ ID NO: 16291 - DNA, 1555 bp, Oryza sativa
  unsure (1)..(1555): unsure at all n locations
nnnnnnnnnnnnnnnnnnnnnnnnnnnnnnnnnnnnnnnnnnnnnnnnnnnnnnnnnagcaatagaaaattaaaacagcaaggttgtctgacgaagtaaggatgtatactgtagaggatgttttatatgaaaattaggctatcgttgtcagctgttcagtaataatctccaaaattcatggaatatgtatatattgaaacgttcagtatatgttggcattctctacatagaaagttagtttcatacgaaaatcttgttatcagagaatgccctttgctgcagagtttgatatgttggcatttaataatccaattgagctactgagcaatgcatatgtgctgtgcatgggacctacacataggtctatcaaattagggactaccagaaaacaatataaacagttgggtttccccattaagaaagctggcaaagtttgcctatggcacgtttttgtgagatttgtggaattcgttcatgcgatttggatccttatgcaccttgaattcgcttgagttccttgaatacattttgtttgatattttatcccttccaatagcttgtgtaatttaacttttggtatatagcatgatcaaaagatatagacacgtttattgaaaaatatgaaatgcaaatcgtaacaggcctatttataagttgcgtaatatgataaagatgtgggcttttttgcattgagaaatttgttatggcagaaagtaatttaatagatactaaggctgtgttctttcccttaggtgttacggagattttcagtgcatgcaaaacgagaaaccattataaacttgaaaaataacaatttatatatagattttttttttgcaaaaaaaggcaccatttaacagtttgaaaagtgttctaatggaaaatgaggaagctaaagtttggagttgtgcaaaagaacgtggcctaagtaataggatgcataaacaaaaattacatgctaatgcctgttggtttacaaaattaaagctaagtgatcaaattcatttttttgaatatgttttagtccacagacatttcaaaacaaactgatctttctttttcataaaagttggagtcttattcatttttttatgtaaaacatcaggaatcaagaaggtaaaattcattattatataaaataggaatatcgggagcttgatagttatgttgtcacctgcagcttgaaccaggtcagcttgctcttgctgctgcttctgactctgacagatccaaggacaaacatgaagatcaaaaggtaaaattttgcaagtagctctctcctttttgtttcatattatcgttgttgcaacaaatattttccttatcactttgtagacattgcgtcggctcgcccaaaatcgcgaggctgcaaggaagagtcgtttgaggaaaaaggtacttgtgttctgctgtagcttttatactaaagaagtttattccttttcaagttttgaaaattgatggtttataccatgttctatttttttcattctgttactaggcattattaaactgtattcttgtattaggattccactatcatttctactagaag

SEQ ID NO: 16292 - DNA, 1236 bp, Oryza sativa
ccagttgagttggtcagctggcttcatcaatttttggaaaagtatgcttgttgctccagcggctgagctagcaaaataatttattacctgcaattagaaacacaaacgagaataaggatgccacagatgttctcttacctgttctgtaagctgattcagattgattgagctgacaccggccatgattcttatactcaaatctgtggaacaatccacacaacacaaatatacacggttcaatttaattaaggcatgtagcttggcagtgaaaggccacgatggtgatgggtgatcataggcatctaccatcaggttggaccaccagagatgatctctctgctgatgacgtgtactaatctacaatctatgagaactaaacatgtttaagaggatgaagtaacatatttaaggcattatatgcgtgattgcctgtccttgctggagagattggatgctggtcgggacatggcagagagctccaagggtatataggcatgcaagacttgcagtctcgcacagtgccctccaattctgggcagttgcaggtaagaaccacggctgtctccggtgggatgatccattgcagtgaaccatcatatttcattgacttattgaaggaatggagaaggattgattgttgagcttaagaggagattaattaaaaggaatgaacagtgcgctcctttggcttcccatctttttattgcatttctgatggtttccggctgtgataccctgggtgatcaaggagtgccgatctgagccacacatggctatcatacaatgcgagcctctggtagtcaatcaggtgtttgtgtacttgcgtggggaaagaggagataggcagcctggctgggctgggcctcaagtatgaccttgattagtactgcaagtttatctaacggctgataatcgagagacatgttgatccaatggctgaaacttgttgatgacgtggctaaacttggtgacttctttatggtaattattgctgtcagtgggttgtaactgtatagaaagaaaggattttgtgatggcacagtgcacaccatatattgctgggggcaaatagaatggtaaattgatttatgtaggggttactaaacttccattttttatatcgtagtaagtattttgtgtatttgtctggtgatttttaccagtattttgcacaaaaggtctttagtgggtctgcttgttaaatcttggaaacaaaaggagggaaaaataatggtc

SEQ ID NO: 16293 - DNA, 1233 bp, Oryza sativa
  unsure (1)..(1233): unsure at all n locations
nnnnnnnnnnnnnnnnnnnnnnnnnnnnnnnnnnnnnnnnnnnnnnnnnnnnnnnnnnnttgggtcgaacggggtgtccggttttccagatgccagattcaccgcgatgcacgaggggactgcccacctccggggtagggggtggggtgaaacctttgcgtggtgtggatggttaggggagggttatgtgaagggtcttgtcacaatcactcaacatagtgatgtgtctgcgtaggcacggtgacatgccggtggattgtgacttgtgggtatagttgtgcacctctggcaagagtaaaactattcgaatagccgtgcccgcggttatgggcgatcaaccatattcaccgtgattagtctcacctttaactggcttaatgaactaggtagtttaggtggtttggttgggcctgttcaacgtggtgtagcgttgatcagtggagatttaatattaccttaattaatcaactgttttattgtttcgctcaataaaatgctttgcaaccgccactacaagaatctatttaatctgtgacgaaattttcgtgatgtttttagatattgtcacggatatgcaactatggatacaaggcccataataccgtgacagtttatcgatttcgtcataaaccggcccaaaacctgtgacgttatagcaatttcgttgctatttaaatacttcaaaaccatataagagatatgtaaattttgtgaacaatgttactatcacttcatcggatgaagaaatgaccaaaataaaagttatagatattgatgagttatacaactttgatgttgataactttttcagttgaaatcatttagtatttgaaaatattgtttgaagttgtcataatttgaaattcaaattcaaattattgaaatagagtcatatagcaaaatgaccaaaataaaagttgtagatatcgatgatttatgcaactttaatattaccttaattaatcaactgttttattgttttgctcaataaaatgctttgcaacgcgccttcatgcaaatagccacaagccctccgttgtatccccttgcacgtctgcatcactggtgtggcttgctgagtacagttattgtactcagccttgctattattctcctttttagaagtgtagcgcttctgagctgaagacgatgttagaggaccaaggctcagaccccagttgagttttgcctgtggagtggagctgaagcccccgataggattgcctgacatgg

SEQ ID NO: 16294 - DNA, 3290 bp, Oryza sativa
  unsure (1)..(3290): unsure at all n locations
atttgtttattttatatcgtttcaagcatatgaatttctattattttttattggtcttagtattatttacctttgtagatattcaccgaagtgtagtttcttaggagtatgttacaattttcttttatgtcccatcctgatagaaaggaaagcatatgtagttggatgttgatttagtagctgaatcaataattgataggtatgaaaaaggaagatcaatgcatgactgtagaagaaaaatccattattgagagcaataccaaacacgttacagttgttaaatcaactattttcctaacaaacattgaagaaagatacagtagtgagagctatggtaaggactttatatttgttaatcaaccatttttcctaacaaatattttgaagaaaaccccaatggtgagagctatgactagcgctttttatttgttcaccaataataattttcctaacaaacgtttagttggtggattgattcctatatctttttgtcaactgctaaccatatacataaatatatcaggcatacatgtatgaagtttttattgaaaaataattccactagtcagcgtagcatttcccggtatatttgttttgttgccactttcaactttatcaatttttaataggacaataaaccaaatcatctcttactataaaattgtaacccactaactactaaaacttaacatgcaaaaatgtcacatcatcatccactaacaatcattaaatttaaacaacatgcaaacatgttatattatctataattttataaattattaaattttcgagctttcaaaaatgtaagcatgttaaatcatcatcgcacataattcacataatattttaatatatatttattatttttttataatatgctatatacatatatagttcatcatcacttaattaatatttatttctctcttctctcattaagccatatcacatcaattttttttaagtgcttaaatgaataatctatggtccaaattatctctctcattttcttctctcattaatccatatcaccttaattatttttagcctttagataattaatctacggtccaaactatcccaatacttttcttctttcataaagtcatatcaccatacttttacatttaaatcatcattctatatactattcaaatttaaattatcataaaccacgttaacttacgtaatcttatattatctagaaatcctacacattatttttatttattgttaccatactaaagtcccgcagcaacgcgcggggtttcacctagtatactataaccatcattaccaaactaaatcaaacgtattccaaccattgttaacatacaaaattttggtagttttgagatctcccaccctttaaatcacatcaaaatctgttcgaaccaaatatatctcctcatagtcaaaagagtaaaatacagtagcggtccttaaacttgtcatgaggtttcacttaggtccacgaacttgcaaaacgcacatcaaggcctctaaacttggtttattgtatcatcccggtccaaaatctagtttgaccatggtctaacctacgtggcatgccacgtgtgcgtgtgccacgtgcacgatgagatgggattagtgagaggggcagggtgggtgccgcagctcctgcacgccactaccgtcactcccttcttgcgctgccgccgctccctccgtgtgccaacgccgccgtcgctgccccctccgtgcgccgccgtcgctcccactgcctgctgccccctccctccctctgcgcatcagcgccgctgtcagaatccagacagcattcagaggcttcctggtaagcaatgggtgctcgtgttctagctctgcttcgatggagtaatcatgccgtgtgtttgtgcaggcgaagaaggcgctggtgaagctgcaggcgctggtgcgtggcttcctcgttcgccggcaggccgccgccacgctgcagagcatgcaggcgctcatcgcgcgcaggccaccgtgcgcgcccactgcatcggcgccggcgccgccgcccatctccctcacatccaccacgctcccttttggccccgccgctcgctggtacgccgctggcgaaatctcgccgacgacatcaccatgtatatattcgccgtactagttctgttcgatcttgacgttgtgtgttggcgatggatgcagcaggagaggtgcgccaccgacgatacgaggagcgagcacggcgtagcggcgtacagccggcggctgtcgacgagcatcgagtcgtcgtcgtacgggtacgaccggagccccaagatcgtggaggtggacattgggaggcccaagtcgcggtcgtcgtcgtcgcggcgggcgagatccccactgctcgacgccgggtgcgcgagcggcggcgaggagtggtgcgccaactccatgtcgtcgctgctgccgtgctacctccccggcggcgctgccgcaccgccgccccgcatcgccgtcccgacgtcacgccacttcccggactacgactggtgcacgctggagaaggcccggccggcgacggtgcagagcacgccgcgctacgcgcacgcgccgccgaagcagcggccgtagccgcggctgccgctgctcctcatccctccgcgcaccaaagccgtccctccctcccttccgccatctctgctgcatttgtcggtcgccgtgcagcgttgtcgttgtcactaaccatggcgaccggatctggcgacctcgctgtcctcgtcgccaccacggtcccccgacagtcgtgaggagagtggagagacctcgagctcgccaatggagaggggagagagctcgagcttgttgtcctctgccacacggagctcgacgctgccgataccgtcgcccttcgcctaggagttcgttggggaggagagaggtggcccgatctgcgcagagagagagagagagaaagagagagaggaaaggcgatgccgccagggatgagagaggcggcgctgccgccggcggtgagcggagtgggaggggaggcgtcggtggcgtcaggccatctccgtcagtggggaaaaggaggtggggaggggatgagaggggaataagaaggaagaaaaaaaataaaaaaagtctatgttatcgtccacattgcgtgccacgtaggcaacaccatggtcaaaccagattttagaccaggatgatacaataaaccaagtttaaagatcttgatgtgtgttttacaagttcgtggacctaagtgaaannnnnnnnnnnnnnnnnnnnnnnnnnnnnnnnnnnnnnnnnnnnnnnnnnnnnnnnnn

SEQ ID NO: 16295 - DNA, 948 bp, Oryza sativa
  unsure (1)..(948): unsure at all n locations
ctatagggcgaattcgagctcggtacccttttcaaattgctaaacaatatgtttttgcagcaactttctatatgaaagttgcttaaaaaaattaaattaatctatttttttaaaaaagttaactaatacttaattaatcatgtgttaatgaactgttccgttttccgtgcggagggaaagagtttccatccatgatctccaaacaatactgccggtgcttacgtactcaccggacagcaaggagaggacgttggcgacgctctcgttggccaccggcgccggcgacgcgccgacggtggcgaccgggcacaccgccactaagctgatgccgttctcctccgccagcttgctcgcttccttctccgagagaaccttggcgatcgcgtaagcctgcagcgcaaacaccaccgctgtgctctcacgcaagcgactgtactatcaactctgactgaacatgtaaaattttgtaagtttgtgtgtacctgagcaggagatatcccgttggttgatctgaggtagtcgaggtcggaccaggacgactcgtccaggacatggctgctgccgttgccgtctccttgcagcggctggccggagacggcggccgccgacgatgtgaggatcacgcgcttaaccgtgccggctttcacgcacgacctcagaacgttcagagtgccttggacgccggcttccaacagttctttctgccattaccaaataatactctagatcgttatttcagctggttattatggagaggatttactagacaaaccaagtaaattaatcgtgacgatacaagtaaaagtactctcccgtttcaaataaaacaacatagtattggattggacacgtacataataaagttgtttattattattattattatnnnnnnnnnnnnnnnnnnnnnnnnnnnnnnnnnnnnnnnnnnnnnnnnnnnnnnnnnnnnnn

SEQ ID NO: 16296 - DNA, 768 bp, Oryza sativa
  unsure (1)..(768): unsure at all n locations
atagggcgaattcgagctcggtacccatttatgtgcaaaccaaaagctcattcaccattgacatcgcaaatatgtttcagaaagtaacattcttaacacatgccaagctaacgagcataacagccgctacatgcattatcgataattataaatgtgcagaaaggacataacgtttgctatcatggaaaaaactaaaacatgtaaaggccaagttaaacacctgcaaggctttggtgtagagcttccgcttccgaagactaagaaggacataaaagagttcacttctttccaatgtattgccatcattaagccattttttcgttgctccagcgacatcaacccttggagataccagcaaagccttaagaagagtggattgtgacttctttatcggctcctcaggttttgcatcagcctccacttgagacaagccaattgcatcaatggtgtcctcatcagaactctcatcggatgtcaaatctaaatcctttttatcagcttctggtggaacctccagatcagaaaacccttcctccaactcatcctgcttatcaccagaacttgcaccggcctgagaagagaaaaccctactccacatgaaacggcctgatgagaatgatgattggcagaccaatggtttggttgatgacagcaatccaatttctgacagtcccgctcatgatgcttttttacattcttggcatctnnnnnnnnnnnnnnnnnnnnnnnnnnnnnnnnnnnnnnnnnnnnnnnnnnnnnnnnnnnnnn

SEQ ID NO: 16297 - DNA, 483 bp, Oryza sativa
  unsure (1)..(483): unsure at all n locations
nnnnnnnnnnnnnnnnnnnnnnnnnnnnnnnnnnnnnnnnnnnnnnnnnnnnnnnatatcgccaataccagccacaactcagcctgagtagagttatctgccgagtggaaatgccaaactcagtgacagctaaagcagcacaatggcagaataatcatctaagaagaactttttgttggaattgactaagcatttctagttcataacacgcttaaatgagcactaacacaaacatatgcaacagttacagcacaagtaacggaagcattcgtgagtaacaaaaagcttcgtgctacattaggtaagctgtttcatactaaagcgcgcgcaaacatgcacctatattacatctgggccggaagtgtagcacgcgaagacaagatgaaaaaggacaatcatgttagaagaaaatacatgccacatttgtctcgcaatcctaccgcaaaaacaacataaacatgctatccgcatgcatgcacatca

SEQ ID NO: 16298 - DNA, 3511 bp, Oryza sativa
gccaaactcagtgacagctaaagcagcacaatggcagaataatcatctaagaagaactttttgttggaattgactaagcatttctagttcataacacgcttaaatgagcactaacacaaacatatgcaacagttacagcacaggtaacggaagcattcgagagtaacaaaaagcttcgtgctacatttggtaagctgtttcatactaaagcgcgcgcaaacatgcacctatattacatctgggccggaagtgtagcacgcgaagacaagatgaaaaaggacaatcatgtaagaagaaaatacatgccacatttgtcacgcaatcctaccgcaaaaacaacataaacatgctatccgcatgcatgcacatcagcagaagcatcacacggagttccaaacccctaatcaccaatccgattgcgcagcaaaagcatccgtacagcgaaatcgccctatcgcaaccacccctccaaggatgtaggcacgcaaacgcacatcaggcagcaagcacaagatccaacaacaacccgcgaaccaaaccaagctaccgtctacccaccaccaaagcgccccacaaaccaaacccaacaccgtcgagagatccgacgagcagagcgccaccgcaagatccccctaaccccccccccccaccccacacacacacacacacaccatccacgagcaaccaatccacgacaattccacggtattccgatcctaaaacccccacagcgaaggcgcccggagcccccgcccggggcccgatcaacgccgcccgccggcgaatcgccagcggcaaccaacgcccggaacggatgacggcgtcggcctcccccaccccaaaccttcccgaagggagcgatcgggagggggggaggaggccagcccaagtataccttggttgtctcccccgcgcgcgcccaccggaatcgggagggggtgtgtgtgcgcgacggggggagggctcactttccggcggaggcggcggcggcggcggcggctaggtctaaggcgagaggatcggaggcgtgcgcttgggaggtcggggtgggtctgcatcgtctgcctaactgcctttgaggctaaaggcaaattttaccgttggcttcatctggtctatccgttgcatctatacgtcatcaacttttgtttatctgttttcatccgcattgtctttatttttttacattttctgtaattacccttcctatagctaaccattatctatcctgaaaacatggattgatctgcaaaatagataatgtcccaacacttgtctaatcaaatattaaaaaaatttagaatccctagattattgatagatgtaaaatatatatatatatatatatatatatatatatatatataatttgaactgtgaagtgaagatgatgttggtagatatatcgtcaaaacattgtcttatggttttaaattttcgtaacagttagttagaaagggtaattataaaaaatgagacattcaaaattatgtcaccggtgttcaagagatcgattagcttacaaaatataggtagtaataattagcagtacattttattgtacaagaagagctatttgtttatgtcaataattaaagaacaaactggcacatttagttcactacgtgattctccgcgctttgttgtagaaattactatgtgacttttaaaaaaattaataatcgagctaaaagtaaaaaattatattagttcttaataacaaataaaactaatttgtcaaactatattaatattaagagagataaatttagtaggctcagtataagattatagatgaaatatgatatcacgcactttgattatatggataaatatatgttaaatattacaaaaatgatggatatatatgtgtgtgtgttaaatattgtgaaaaataatgtgaaggaagatgattggatgttgatttgtagaattcaatgaattataaatgatgttgtatacttgcataagttttgtatttaattattgctaatggatgatgaggtggcatgtctgcatattgagttttagaattagtgggctatagctttataactttatagtaagataggactagctatactccctcttttaaggaaaattaaactcggtaactttaaggaaaattaaactcggtaacttttgactgataattattactatatctagacaaaacattatgcatgttatatcactgtattcatatttttaatatacttttatgtgatgctaatttcatatttattgggatcagaataaaataaaataccgatcaaaatatattattgaagaccgtgtaaaaaaatatataggagataatttgggagagagggagtactatcaatcaatcggtcgttaagcgatttagcagagctaattatgatgagttaattagttgttaattagttcttgaagtggaccaagccatgcagcgctttgatgaacaacggacagacccgatgaaaccaacggctttggttcctttttttctccaacaagaattggatgaagattaaaatttttgtggcacgctttttaaactgctaagcggtacgtttcgtgcgaaaactttgtatacgaaagttgctctaaaatatcatattaatctatttttcaagtttgtaataattaaaactcaatcaatcatacgttaataccacctcgttttgcgtaaaaaacttaatcttcattttcatcttcatctttaaaagaaaaagaacaccaccaaagtttgcctttgaggaggaggaaggcatgacggcggatggggaaggggcgatgcgggaggggagctcctcggcaagggcatcggcgagtagggcgcgtatccgctccgcacgagcacgagtggggcgatagccatggagcccgagcccgagctgcaccgcgtcgacggtcgtctcattccccccgctgtcatggttacagataaggcatatatctgttgatgcgaaaaacacacactggcatatatctgtttagctccagtgcaggtccaaaggttggtgggatgcgagtgtgccagtcagtttcatcctgcaactgacaaaatatgtaaacaacagatcaaacagccgatcggctgacaagccgatggagtaatcccagccgatgccgatatcagccgatgtcgatagggttttgagctatcggctatatgttcaatgtagatgatgatatgaaggcaatcggctgatataataaaatataccaatataatccagtagaaaccaattggctaataatgatatgatagataagcatcgatccgaagattaaagcatacatcggttggaggtctgatgtcataaaatccacaagattagatagatcaatgaaacctttgttgcgatcggctaaatccaacttatatgtatatgcaatccttataagccgatgcaatgtccagataacttatcggctagcaacctgataaaacattagcatgaacctatcggcttaacaagatttatattatcagcaataatctagtaggtcggacctaaccgat

SEQ ID NO: 16299 - DNA, 7623 bp, Oryza sativa
  unsure (1)..(7623): unsure at all n locations
atattatcaacaataatctagtaggtcggacctaaccgatgcagcacgacattatatgtggtaatctaatacttgatgagccgatagatctgtctaatgtgatggatataacaaatctatttataacagcattgtgattgtagaaatatatcagctaagatagaagatcagacctaaccaagacagttccaactaaaccgatgcgtctctaaacacaatgcaattagagatagcactaagatatcaggtaggcaaatatatcaaccaaactagagtgatccaaaagatcgaagcgatgcagccttgaacaacaccaatacagccgacagattcaccagggtcggcggaacgtaggacttaccccttcgccggagaacgaactgaaccgatgcagccccgcatcaggtgccaaattccaccggatggtaagtaaaaaccacggtaaagagggtggcgatgcgccgagtagttgtattgatcgagagattcttacaatgaccctgggtgtacatatttatacccatgggtagatactagtccttaacaagaaagaaactttcctaaagataaaaggaaaacataaagttcttattggacactaaacacactttcccaaagataaaaggaaactaacaaactattcctaattaatagataacttgtcatgctgtatcctccttgaactcggtcacttctagataagtttcctttaatagattaattttcttaaccgaatatagtaagaattcgacaactggcgacttgataactctcatcggccgatcctaggactctgaagctgacactgactccaggtctatggtgacttcgggctttacaaaattttggtgttaacaacctcctatcctacgacttatgaaatatacggatatggcataccttcacgtacacagattgttcccgtgtacgccgtaggaatctgttacaaattatggaaaatatctctacgaatcaagcgatttccaaagtcctgctcggaggggatagagtttttgttatattatacaagatccgatgtctccgagtcttacttggagatcaagatgatccacggtataacaaggacccctagggaggggtggaaggcattgaatctcatcgccaacacacccaccatagcttatgaagctggagtacacgaagtcaagtcgccgggagatctcgtcgaataccacgactacgatcttatcggtatcattgatttcgtctacttctattgtaatatgtggttttccatcatcaatcctatataaactggagtagggctattacctgataaggagcctgaaccagtataatctctgtcttctatttgcttgatatcggattacatagatcctcgttccaacgtaccccaataccctaatcatccgctttacgagtatcactccaaagcctagccgccaccaactactactccagccgagcaagtcaacgtccttcaagcgctcctttgctcgcccgcctgtccaccgaggaggacgcggacgagcaaacgcccgcccatcggagtaggtcgctacgccagagttccttcgtgggctgccgaagtagctattcccgagccttcccgcatggatctgtcgaggccatccctctagagttccgtcacctgctcaagctccatcgtcggccagattcgagacctaacaacgtcaccctcatgtcgtccagtgttcgctggtccttctcgcgtcgttggcgtcgtccggtcgtcctccatgcgtcgccgccactgccgtccactctccatcctcaagccgctggtgggagcccatccgtcctgctcgcgtcatcgccgtagtccacttgccatcctcgcgccgccgttgcttgcttgtcctcctcgcatcacatcctctgctcgtcctcagcgagtgggcgggcgcaggagcgcctgaagggaggctagaggtcggaggaggaggaggagctccagtggaggcctgggcttcactaggcatgagaggggagaaagtgaaaggaagaaaaggaaagaggaagaagcaaatgggaacaaaaaagaagagatggatggaaaacgtgacggcagtggcacggtttcaattttgtaaaattttagtgacacgactacgaatagacgaaatgtagtggtatttttctaaattgacatatttgtaatggcatggatctaattaaccctaacttttattaccactttattctttcactcatcactttttgtccaatcacataatatccttttattatatagtaaaatcccttatattcacggatagagggagcatagattaacgtagaagcagtttcacccgaatagtaataatattgttgtgaattgtacggattcaactagaaaaaagaaactggtggtcagattaaattgaagataatcttgctcctctggaactggtgggataaccgaaataagataaatgtgggtgaacaagctagaacccccaggggtggagctacattgagaatggggttcctaggcactcggttccaaagatcattttatctatagtaatcctatgtttatcaatcccctcagttcagttaagtgtaccctcaacacagcaggcaaagcaggctgtgtacattctttgagtgtagaagctggtttaatccattatctaaaaaaacacagcgggcaaagcaagaagacaatagagactgcatacttgcagccttgtgctgtagaatgatactaatacttgctaatgcatgcacaccataaatcaataatagccaatgcatgtagcccagcgcttgcctctttcaacttttcttaattaatcacttcaaaatcaaatcaaataaacagaatgcccttgttattttctatggccagagaagagcaacactggcagtcatgctgtcaaaagctggtcaccagctctggagggaaatctgaagctcaactttgatggttcctacctggaagcaaccaaagatggaggatggggttttgtggtacgtgatcatagtggatgctgtatacttgctagggtttacaaaaccgcgtggtaaccatgcggttatcacggttaccatagacggtaactatttcagtttttgaaattatggtttgtctcgtggttaccacgcggttttcgcggtaaccgcgggggtgcggtaaccacgccaaaaacggtaaggtgaaccttgatacttgctggagctggacgaatgctgcactgcgagcccttgtagtgcagtgaatagttgatattggaatcgaatctgattcggcaatgctagtagcggcgctaaaaacgcaggactatgagccagctgcgagcaatcctattttccgagtaataaagctcctcatccaattaggacatgttcagattgtagctaaaatgaaccttaccaaattttggcaataccaaaattttgtcaatttggcaatattgctaagttttggcagaattttttatgtatttaccagagtttgtttaaaaactaaatagatgcacatatttgacaattttactaaaatttgataaaatttattttgcctataatataaacaggcccttagagtttgtcaaggctgatatttcttttattccaagatcttgtaatgtgtgtggtcataatttagctcaatctgctgtttggttcattggttggacccctcccagagtttgtaagcgactgggtggctcgtgatatcgctgagcacacggtttaaaggtcaaaaaaaaaagaaaaagaaaaaaaaaagaaacgcctacgactagcccaaacgcaccgacctgtcctccgaccagaattccgatcgccaccccgcggttctgctctcgccggccgaacaacgcgtgctcacgctcgccgccgccggtcgccgcctccaaatcgtcgccagagaatccgcgtcctccccagatgacgctgcgcacgggagaagcaacgccgcctccccaggcgcatgccgaggaggagccggggcgggggaagcgccggcgcgtcgtcgcccgtgagacgaggctgcagcaggaggaggaggaggaggagggcgcctcatccgagccggagaccagaccgcgccctccccccgccacccccgccactgcagaggagcccgccgccaccgccgctggggcggaggccagggctcagctggccataaacattcgccgtatgcttgctgtcgaggcagagagaaggggccgaatcgctgaaacgaagtatgtatgacatcttctgcctatcctgctctacttttaaatgttattaggatttgtcgtcgaactccagatatatagtcatcactaaaaactgtgataaaatgcccaagaaatttggattttgatgaacaaagcctatagggaaatcattgcttgcacaaataccggggcatatgaatgtgccttgtcaaattaatttactcttcatataatggagtatcggctagacagattaaccagcttgctcctcttattgttctatatgttctctaattcaggattttcagcttatcgatgaatatattgctaggattttcttgcttatatgctagacatggaagatcatttctgtatgtattacttgcagtgcctttgaagcttttcatgatttcaagtaccatggaagcatatgcatatttttatgtatagagggaggcacaattgaactcatgtttctactggaatgcaatttgtgcatgaaaattatatgcaagtaaagctattgatattctaattctgtctgagtaactaacggtaataatgttttattctagttggagttcaggctgagggtccaattctcactctggaggatacattttgtgatattgatgatggtagtgctaaaagccaagttgctcgaaaggttgctttgggtgtttcacagtcaattgtcagtttatcttcctttgcaggtatttttgtttctagaaacaaacctcttcataacatacatcttagacctccactaactttgttatgtaattcaggtcgaaaaaggatacgggtttgctcaggatttgtgatacggtggaacgatagtaccagcattggtacaatattaacctcagcagcacttgttagacctccatgcggagatgatgtcagggtaagtaataagtttctttttttctattttttttgtggggagggggtgtaaatttcacaaaataccaggtttgggggcactggtaacatataaccaccacatattttgaggcagtctttcacaaaatcacagaacccagctcaatcgttgcaacctcctgccatgaaccatgcatatccttaccgtgtaatcaagcagtagcaaaagcaattgaaccatctcaaactggactaccattttcctttggaataacagatgttaaaaccaattgaattatgcagtcctccggcctggcagaggcattgttcttaacatccccgagtccacactcccaagagtcttgaaaagcattaaccatcatcggacaggaaagatcatcaacaaagcaaacaagcagagcttgagcttgtgctggtggtttaggggaagaagttgtcaaccaacaggcagtacaacactgcggcggcaaggctgagccacagcaatcgtcgttgatagcaaatggcactgcggtgggaggtgtggagtggtggccagccaggtggttcctttccagagattgccaggctggctattgaggtggcacctgcaggtgggcctaatatgttgcaacagctgactaggatggaccctgggttttgtgaaacaaccgccacaaaacatgtggtttagtgataaaaatcacaaaattgcactattttcttgttaccaatgggccccagacatggcgtttatgaaatttactcttccttttttgttgaaatatgttaccacccacaatttatttttgtcctgattttttattacttacttaggtggaggtctttctacctagtggggatatatctatttgccagatttccatggtagatttccatcataacatagccttagttgaagtcacatccaatttcaagcttcaagaggctgttatccttaaatatattatcgacaagggagatgttttagcccttggccgttcttatgaaggtggtcttctgatgtgctcaaggggagaaataagcaacagagccagcatatttgagtgttcagaactgttagtatcaagttgcgagataacaatggtaaataatatctgaacacaatttgctctttgttgccgatatgatacatgcctttttttccttgcttaattcattagttggttatgcaaactactgattcaaattaactgagactcttttaattccttctctgtcagaatttactactaaagcacacacaatcttcacacaactcatgtatgcaaacttgaatgaacatcagaatatgcatagggcatccaaaaactacctgaactaatttaatcacatatagaagagccaaacagaaattgtcagctgtttctgtggttttattctgtgaaatagtttttgttctcaatttatagattctgtcaatactgagatgatgttatatgcttctctgtgtctttcagtactgaacaattcaggtttcatttttgctgatgtgtccatcatagagcaggttggtctatgtgaatgtttaattatcgtcttcttttaagtagttgaaacacttggaacttgaagcatcgtccatcacatcaatctgtgtgaatagtttctaagcatgattgacctgtgtctcttaagatcattttaccagcagttactagtgtgatgtttgttttgaggaatcaaatcatttctgtgctggtggatgagattgcttgatcataggatgatcccatgattttggtgggacaacccaccaattcattgtttttcacatctggttttgaggcatgtttggtgattgacccatggcatttccaagaccaaacaactcgttaagtagagagtaggattgagtggatcctttgacatcttttttttaaaaaaccaaacatcctatagctagattgttccatagatgaatatcattttgtcaaaggtttctgtatgcaatgtttttcttttttcaaaggtagctagaattcactattctctagttaacttgctagagaatctcactcttgccggatgcaccagtgtttttccatgtgagcatcatccaacagtgtgatctagtttctgtactgttcttttcctcttgttcaaattgaatacctattctccattcagacaggataattttgttgttgctttgtcaaagcttgttttgtttttctttggacactaagaattaatactgaattgatctactgaagcaaactcagctactgagattagttgataattagggccagggtaacacaactttattaactgagcaaattgtgtgaacacttaatatttcgtggaggtgcaatccatatttttgtttaaaatgtttttttgttgacctcctctactctgcgtgtttttgcatgttctttgatgcattttacatggacttttccctttttacctcttgctattcgtgtacatatcttgacaatttattgtgattccttttttctaggctggnnnnnnnnnnnnnnnnnnnnnnnnnnnnnnnnnnnnnnnnnnnnnnnnnnnnnnnnnn

SEQ ID NO: 16300 - DNA, 2033 bp, Oryza sativa
  unsure (1)..(2033): unsure at all n locations
ttcacctctattcccctggttccgcttagtcatctagagcacatatacagaaaattctcggatgttgataatggcctatatatttcaaatgtgtgaacctcctctatcctatgtttatttttgcgatactttgccctagatttgtggacttccagaataggtatttaaaatttatatattgtcattccttgtaaattatgtttagaggctcattaacatttggatgagaactctataacatttgtttatactttgggtaccaaaaacttagatttttaacaagcttcttaacatgttgtgtctgctatttttttcaatgtagtaactgtatacaactttacatatccattctagcttatattcaagtgcattttttaatacatgctgctaattcgtcaactttttctcctaattattacttttaacattatctaaattttatggtcttcagaatgtttatagcagtgttattcttttagctatagttgccatcttaatgtttctctgctcaatgtatatacgagatgaactgaataaaaaaatgacaattaggtggctgagggatcacccgctgatattgctggaatatgtcagggtgatattctcatgaaatgtggtgggaaattcctctctactgcccctgaggtgacaatttgttttaataatttccagagtcagctactgctttttttgtttatatatgttgtgaacttttgattagaatcatgcttttgtttataaccatatttgtaatggcaccagttcggtgcaatgttgatggataaatgcaaggaaactatggaagagtatgaccaagaaaccaatggtgatttttcagcgaaaaggataacagttgaggtagctcatgatgtcatattgttctacatgttagaattatctgtcatatgttgtgcttgttaataatcagtaaacttgttttcacaattatggaaatttctactagattgttataaagcgagaaaatgatggaagctctatagagaaaactatatctgctggtttgatagaagagtttaactataacaggtgacttcctttttctttactcctgtagacgtaggagtattttgtttgttgttgataaaattttgttctcctttacattcaacccatttctttggctatacaggtggcctacaccgatccctagctataaggtcagacgagatactattggaaggtgttaagagccttagaggtgcagttcatctacgtgcatgcatgttataattaggtctgacccacacaatttggggatccggccagagtcgacctgcaggcatgcatccctgagcattttgcacatcccgttccaaaaaaaaaaaaacacgacatcatacaacagcgggtcgcccaaattattgatgaccgacgtcatcgctgaaacaaggaagttccatggcgccaccgctaattattgacctctccattacttgaactgctgttgatctttataggtgacttgaaccgctgctggtgttgtttatctgatcttgctcagttctgtttcaggatgtggccaggttgtggtcttgtgtgatgtctgtgtggctcgtgatctgtattgcaaaagtttgtggctgctaaatcctgggtgatgcagccaagttttggcggcatgatacttgtgttgtgcttgtggggatctgtgatcgatcatttcccaaatttcatagattactttcaaatacatgtctgtgctctgctctcttcgcagagaaaaagggatgattcccaagtttgtagagtactaaggctgtgtttagatataaagtttggatccaaacttcagttcttttccatcacattaacctgtcatacacacacaacttttcagtcacatcatctccaattttaaccaaaatctaaactttgcgctgaactaaacacagcctaaatgttgcctattcaaatcagggacggaatgggacatagtgtgtcagcccgcggnnnnnnnnnnnnnnnnnnnnnnnnnnnnnnnnnnnnnnnnnnnnnnnnnnnnnnnnnnnnnn

SEQ ID NO: 16301 - DNA, 1363 bp, Oryza sativa
  unsure (1)..(1363): unsure at all n locations
nnnnnnnnnnnnnnnnnnnnnnnnnnnnnnnnnnnnnnaaaattgcaattataggactccaaacaataagcttcgtagttacaggaccccaattgacgacttcgctaaaacgacccttaaaatgttggcactttgttttacatgacatttggtcctttaatcacttttccctactaaaatacatgtatttcaccttgatgtgaccgtatttccctcagcttcaattggcgtgctcccacgctgctagccggtcgtctggctggctagccgcagcctgggactgggatggctggccggccgccgcctgtccatggctagagcactggctcgcctgggatggctggtaagctgctagccgctcttgaacttgctgcagctgccagctgcatatgccccaaaattgtactgtacatggtcaatcatgcacaaaaattgcaacactaacccaatgaataaatgaaagatgatcaaagatgatccatacgcaattacaacgagatctcaattacaagtaatagataaaaccatgaattttgcacaaacaagcttgtctcataaaaccgagattctagcataaacaagttcatctcagaagaccataatttagttccaaacgaaatctaagtcatatgaaataaagtatgagtttacatctcatcacaactaaaattattcaaccaatgtatagctttctctttggagtcatcttttttggtgccgccgcggtaggtatcctcacgggactagtggtgttggtttgtgacgatataccttctcctagtaacatcgcaagcttgctacacataaataggatatgacaattagatgtttggaaaaaattaatatacagtaaatatgttaatatttctgactatcccgtaggatttcttctctagtcggcttccgtggagtgttaggttctgctgccacagcttttgtaacattcttcctaggttgcctacgcttcctacaagtaatcaaataaattaatattggcattttcatttaagttttttgataaataaaatcagtccttacctcttttttgctgtcctattgagtgggcacttggcactagcttgcctgtggcctttttctccgcatttttggcaagtcataggtcctctgatcatcttctttccctttccatttgttggagcagtatcattgtcacctcccttctcaccttcactctcattggtaaatggaccatctttggaaccatttttcttgtggccaccttccatccatcccttccttcttagtttccttcgtcttccaacaggtaatttagcaagaggnnnnnnnnnnnnnnnnnnnnnnnnnnnnnnnnnnnnnnnnnnnnnnnnnnnnnnnnnnnnnn

SEQ ID NO: 16302 - DNA, 1090 bp, Oryza sativa
  unsure (1)..(1090): unsure at all n locations
ctataggcgaattcgagctcggtacccgattaaaaggaccaaatgtcatgtaaaataaagtgccaacgtttcaagggtcgttttagcgaagtcgacgattggggtcctataactgcgaagcgcattgtttggagtcctataattgcaattttctccctcggtctagggtgttgaacagtatggtctcgtcgcctccggaaccatcggaacagtatccaactccaacgatcaaggagcccagcgacccggtggaaagagtagcggcggcgtggtcgtcgtcgttgtcgagggatggggggatccaccttgtacagtatagggtgaagggggatgctgtcggagtagtggtgcacggggaagtagaagcacaggttcgagctgtcctcctcgtcgccgccgtcggaagcatcgtcacccagatggaagatcctcttgtttcgccttggctcgccgcatctctcttcctcacttccacgtggtcgccggtgggatgcactgagagttggggcggcagcgtagagagcactaaagtagtcattggatcgtggtcgtgggctacacttcggatcactggtgtcctttgtagtgcggatactgggccgtgcgaccgatctaggaactgtacgcgccctttccgaccacgaatatttaacgttcagcgtaaccgaattccatcttgaataaatgatcgaaaattttagaattttaatcgttaattttatactactatttgaatgagcttataaaatctacttcctccgtttcacaatgtaagtcatactagtatttctctcgtgctgataacgtattacgcaaccctcctgctacatgaagtagtccaagagggtcccgtaattctacgcaagtggagacacaagatatgagggtgtggcatcctttctcatttatccattgcattctcaagtgtacaaaacctctcctccaaccctctatttatagagcaatgccttgcccactttccatattagtgatgggcccaattagtgggtaaccgggccgggccttcatnnnnnnnnnnnnnnnnnnnnnnnnnnnnnnnnnnnnnnnnnnnnnnnnnnnnnnnnnnnnn

SEQ ID NO: 16303 - DNA, 555 bp, Oryza sativa
ggtctgcacccattgcataatgaaattgttttaatattcagcaattcttctgaaacagtctggactacagtaaagtagggcacataattaattttgtaaacaagaaaaggaagttgattttcttacctcaattatcacatgcatgtcgaattctttggtgtccagaccaatcccttcatagaatgtagtacgttggcaatcatttaggtacatggtcacatacacctgcaaaggatcacacacaaaaactgttagaagaggagcacagtaacaatcttcagtgtgaactgttggtccatgccaaccacggaatagcttggaagataaccgaaaggcataagaaccgtgaccagagcttggccttccagtcgttgaggaactgcggctgcgccttgatcagcgcggagaagaaatcaccgtgacggttctcatcctggcaccagttctcaaagtacttgaagatggggtacacctggtactccgggttcgccttgaggtgcctgaagatgtgatgtacctcagtaccctaatcttctccgacaggtaggtcgcgta

SEQ ID NO: 16304 - DNA, 418 bp, Oryza sativa
caaatcacacctcacaacaatggatagcctcgtacccactcagcataatccaatccaagaaccaacaccccacaacccgagtaacttatgcgcaaaagtcccggtacggagaaggcgttcacggaggttaccggggatggtggaggcgacattggcggaggcggggagagctctggcgcgaggcggggaggcggaggaggaggcgaggaaagagacggtcggggagaggagcagcgccatggccacgggcagtgtgggattcggcttcttggcccgtcgtcagcctatccacccatcagcccggagggaggagataagcctgtgctgctgtgagcgctccgccgtccgatggagaatcaacggccagatttaatctccgtcaagtaaggctgcttggcagttggcccacatgtcatag

SEQ ID NO: 16305 - DNA, 2778 bp, Oryza sativa
ctattagtatgaattagttattaaattgactataaatgatttgaagctaatagttatctatacattatattaaacttggtcttatatagtaaaaagacagtaatgatagctagccctggcatttgcaaagctcggagactgtgtgagtacgttatacgtactgtacatctcacgggatcatcggaacgtgcaaactaatcgaacgtgccacacacctaataagcacgcggccccagcaggtccatcctcccagcacgtgcgacctaccaatttcctcacggacctcaccgctccgtacgtttgtgtttgacgacgtctagggctgtaaaagaaaaaaaaagctgggcactcagtagccactcacaagctgctcaatcgccacgagaggtgcagtagtaagtggctaatccataaactcacttatatattaaaataaaacaagtttataaataagtttcactagttaatcaattacacctttaaccgactcatcgtaggcttaatagttctagcttggctcgagcttctgacaagtcaagtccgagcctataccaaaatctcgtgagctttgtcgagctgagctcaagctattatcgagcctgacaatatatgtattttattttttactttacaaattagtagatcaaagtatatattatattatttatatataagtattcaacacaacgaagtagtttgtatcggtgccacatatttatattgttttgttttctccttatttatgtatgtatatgattaaatagaaattagttgcttttatttattgagagattcgatccttaaaatatatgtatagtggtactccctccattccagaatataaagatttttagggttgaatgtgagtactaagaaaatatttagaattaaatggaagaaaatgatgattggtcgagaaatagagttaggcgagaaaattgaatggtgaagtgttgtgattttggctgagaaaagaatgttatgaagaaattatcatattttgaacaaaatacaacaacatcttactctctcagggatactttacaacagaggtgacttcttcatgagttatgagccagctcggctgaagcttatatcgagctcgaacctgcacaggtgagctccgctcgttgacagccctagcgacagtccccgtgggcgccatcgccaataaaacgcgcgcgcgccatatatagccaagctcctgtactccgtgtagctgctcctgtacagtacacctctttcctcctctctgctcgccggagacagactagctaagctagctagtaggagatcgaggagggattgaccgattgagctagtaataatggccgccggagacaaggccggcggcgacgacgctgcggcggcggcgccattgctggtaccggcggcggcggggaggcggcggcggtgccccgggtgccggacgaaggagaggtgcgaggcccaccccggcatcccttacctcaacttcttctacatctggatcgtctgcatatgcgcctgtaagagctacagctatagctaattaattaagctacctcttctttcctttttgttttccttttattaaatttgtttttcatccattttgccatgcgtacgatcagatacgctcttaattatttactccttaatcttctgttgttatatttcaataacctttttagtctactcttgcgttttcttattttttttctctattattagttcttggagagcacgtacgttcaaagtggtaccttataggtgcacgcgccttctcccgaggtttcccatagctaagggcatctttagttggtgaaatgaaaatctttgggtgtcatatcggacgtttgaccggatgtcgaaagggatttttggacacgattaaaaaaaactgatttcacagctcgcctggaaaccgcgagacgaatcttttgagcctaattaattcgtcattagcacatgtgggttactgtagcacttaattatgactaattatggcctaattagactcaaaagattcgtctcgcgatttacatccaaactgtgcaattagtttttctttttatccatatttaatgcttcatatatatgtccaaagattcgatgtgatgtttttgggaaaagtttttgggaactaaacatggcctaagctgatattatctccatttcaacataagtaagaaataaattaaaatactttaattttatcaaatatcgatataattatttttctactttatctacattcaacacatttatcttttactttcataatcgatcttcaatataattttgtaaaagtaaatttattttgtgataaacaacagaagacaattaaataaatttattcagaggcggagggagtaatacaccccttgctatcttcatttgggaaatatcaagtactagtactttccattagtataacttcctgatgttctccctcacattgggtttttaactatttgcctatcttacggagtggcactattgagatgtcacttttctaaaattttttacacaaacaccgtatgagactgagagagatattttttactgagaaatttgaaatgacatttttactcctattttaaaaaatatgagagattatatataaacatattttttgaaatgacatttttacgaatccccgccaccgccactcactgttcacgcatccgggtgagtggggcccgccaggtcccctacgggggttgggcgggtgacatttttcacctggttgtgtctgtggggccgagggagaggccggggggagaatgtggggag

SEQ ID NO: 16306 - DNA, 2205 bp, Oryza sativa
  unsure (1)..(2205): unsure at all n locations
acatttctatccaacccggccccgccccgccctgttgccatccctaatcaaaactcttatgaatgcaaactcttatgaccagtttgcagttgaccgctactacgtacctcctgcagccgctgtgaaccgcgtcgaagccacggaggtcatgccaacgagcacatccgttagttgaagtttactaccgtagatgttggtatattattttaatataaactcgaccaaaatgtgagaagtttatatacagaagatttttcccggcgaggacccatgtagattgcagacggaccgtaaaggcaggcctcttaacatgttcgcttgtgaaaataagactattttcacatgcgggcctcttaaataatccgcatacgaaaatattcatctgttcccactctttttttatttctcacctcctttctcccttcactaaggcccgttcgatccctaccaatgttgtcaggacacccgaaaatcatattgtccagtgtttattgtgatcaccacataatttcgggagagtgggatccatacatgtataatagccactcaagcctcaatgtgcccgatgatcacaattaaacaccattcaatataatctgcagagtgtcgaatattgaacaaaagagagactgctgggacttagcgtgccagtcaacttcagcatgagatatgtccgtcaaaccacacgaaggcggtgaccggatgtttacacatcccagaagacttgacaaattgctaagctctacagcatctcgtttgttcaacactcatactcatgtctagctagtcctcaacaaaagactaactaaacactttcattaaagcattggcatagagtaataaggcactcaaaagattaactttagattacaactaaaattggatatacgtaggccaaccggctaaataaatagtggtttgcacggaagcttatctacccaaaacccttaagcaatccgactaagggtagactcttattgaaccatcctgagaagaacaacggaactcgtggcacacaactaatcctgcaaaacaacacgcgaaacaagaaaaatcattagtacatgattaattaaggattaactagtataaaattgaaaaatagaattatttgattctttaaacaacttttacataaaaactttttaccaaaaatatatcatttagcagtttgaaaagcgtgctaacgaaaaacgaggaagttgaagtttgaagttgagaaaaggaactaggcctaagtcctcatctcccctctcctccctcgctctcccggtccccactgctctcccatctcctctactcctctgccctctcctccgacggcgggttttggcgacgggggtagcggcgaagggtggaagcgttaggcgagggctcgggcgacggtggtggagcatgagggcagcgggcgtggactctggcagtggcggacgagtgggacggcgacgacgggtgagggccacggcggggcgagcgtgggcgacagcagtgacgatggccctcccccgcacgggatctgtcagtcgccgcccttcttcatcctcatccggcggaagccgcccttcccacccctatccggtggcggcagcacctcccgcgtggacccgtcggcggtggcaatggggatggtaggacgacactgacggcgacggcggcggcggttgaagaacgaggagaatggcagcggtgactggaggacgaggatgacagtggcggcggcgacaagatgattctagggatagggtttcagttattcaatttttgaaatttttatttttttcgtgttattttcttcacatgcggttgcgctagctaaatataaaaatctgattttcgtatacctttggatgcatgtgagccacctgtccgtatgtaaaattcgcttttaaccatatggggggaaaaattgaatctgtatatatatgtgctaggtagtactctctacattccaaattaatctacatatattttttttatgttatttctaattgatttacatatctgtgttcatcattaagtctattcgttatttgtgcattggagtaaatggatattgatgcatgcatccatgcacccaagtatttatacccatatgcaatatctttatttgctattggctactccctccggtttnnnnnnnnnnnnnnnnnnnnnnnnnnnnnnnnnnnnnnnnnnnnnnnnnnnnnnnnnnnnnnnnnnnnnnnn

SEQ ID NO: 16307 - DNA, 4359 bp, Oryza sativa
  unsure (1)..(4359): unsure at all n locations
aaaaaccgaacgaacttaagacccgactcaaatacatatacatattccaaaagcgaacgaaaattaaaaaccgactcatatacgaatgacgtaccaaaataccagaaaattaaaacaccttcaatttttatagtagttgatatttcattttctcatttattaatatgattaaatagaaattagttactctctttgtcccaaaatatatgaatctaggacaggatggaatattttttttacgaatctggatagttagctcgtccagattcgtggtagtagaaaatgttccatctgattataaattattatattttgggacggatagagtattttaattgggagattatattcttaaaatgttagtatactatttatgagtcagctcgagcatgtgtcaacctcgtcggcacaccctaacaaacgtccctggtgcatgcgcgccatcgctctatataagccaagctcctgtactagttcatcagtgtagttcagtcagttccacacctctccttcctttaatttctctctgctcgccggagacagactagcttagctagtaggagagggaggaactaatggccgccggagacaaggccggcggcgacgacgctgcggcggcggcggcggcgccattgctggtgtcggcggcggggaggcggcggcggtgccccgggtgcctgacggaggagaggtgcaaggccgacgccggcatcccctacctcaacttcttctacatctgggtcgtctgcctctgctcctgtaagaacccaagcttgagctagctactatacctcttctttctttttttattttttttgtcatggtttcatccattttgccatgcatacgatcagacacaactcttaattactccttaatccgctcttattatcttttgaaaaaaacattttgattaatttacttgcgttttgttttagatctattagttgttggagagtacgtacgttcaaagtggcaccttctaggcgcacgctcacttggccttcgatagggttcaatttttacccacatctcatatgtaatcaatacaaaatcaaaatctaaaatacttagactttatcaaatcctaaatttccttttttttacattttcaatatatttatcttatatttttataaacttcaatgtaatggttgtttaaagtaaatttactttaaggtaaataggatgagtcaaagttaaacttacttggagactccacgtgctatcttcacttggactaaaatatcaagtatactagtactttccactagtataactacctgatcttattcccttcactttgcctggctaaagcatctgtttattagtctcttgttcttcttctttcatgctgatgcaccatgcatccagaacgagcagttgaaaagtcatttaactggaggactaatttcttaagttaatcgcccaatttactgtgcagtaaaaacgtgccattgctttaaccatgggggttcaaagaagttaaagcagacgtaactacccagacgctcagtgaataagggatacttaagagtcgaccatcaggcacaagaaaacgtactactagtagtagtgccactggccggaaaggaatcattttcacttgtcacggttccagacaacggggctcattttttcgcttatgttcctacttattagccaaaatttaaaattttaaccttaaatttagaattgattttagggttttttttaatcgaagtttatttttcaacctttatttttatttttagatcgctaagaacacgtatataaagttttattcacaaattattttttatttgcaaatataccgaaatgatgggtctatctaatggggccccatggtcagtacagtatacagtactccctctgtaagaaaaacccaatctaaagttgtgatctaaatctagataaatgctagcttatctagatttattattctaaaatatatctttaattttttttctggacgaagagaatagtcctaaaggacatgagaagagtatttattgcacggagatgtttcagcagatgtagaatgtcagcatgtgagggcagcaggtgcggtgttgagagtccattcaaacttaagccaccaaagcgtatgcatccaattcccgctccaaattaaggcaaagttctttccagacgataagagagagaatatcggcttttgtgaaaatatttgaagagtacagacgaatgataaattagttattctaaatttaaaaggtaatttaaactattaaaaacgttaattgaatatatatgaaaaaaatatagaaaattgcatggtttagaatcttgtgagatgcatatatacgtgataatctataatctgtaagagaaaaaatacagagatttggcttgtttgtttcataggaaatatggaagaaaaaccattcctacaggaaaaatcactgtttatccattcgttttgtaggattatagcaaaggaaaagcataggaagaattcctttgtatgtgattcctatggaattttgtaggaaaattaacatccacttggacctcttttttctattcctacgcataggatcaaggcaaatcactcgtttcattatgtatttgaatctaagttacacaaattagagtattcaaatcttggttgtggtaacttaatacaaagattcctgtatttttctatctaagagttattcctatgattttcctatcctaagttttgcacatacattcctatgttattcctacgtttttccttttcctgtgatttgaaaatatgaaccgaataggcccttaataagtccaccatgggaatggaacagttccacttggtcgctcattctcccacccttttccttggaccatggttgcgatgctagcataaaggttgaaagaaacacatctatatcaatatcagattgacgtgacattttgatatgatcagtttgctctactactctgtcgaaactctcttatgaccgtaaatccagtgttaaatttttagtgatattgcatctacttattttgcatcggtcatataataaacactacggagtatatgctagatacaaacacatcttttccatttgtaaaaatggaaaaaaaattgagtgccaaaactcaggcattgtacggaaatttgctagagcaatagagcatcactaaaaaaaaacagaaatatgctgctcttgggaagggggaaataacagaattttacacagtgctgtatatgtgctgcacaacacaaatacacaaattctatgcaagttgagataaggtgattccagtcgagggaaatgcaaagcattgcacctcatccacacgtgaatacgtacgttttctgggagctatatctggcacacagcagggctaagctttccctaccgtgcgaagcttcctggaagtttacctgcctgtggccctggcagtccctcgtcgctaccgccctgcaaaaaagatctgcgatttttcagtgaaagcgatggctcatggccatcgacggtagtactatttcgttgcatactcaacacccccccccctctctctctctctctcttaaaaaaaccaacctataacctaaaaccaagtatgacacattctattactacgaatctagacatacctctgtccagattcatcgtactagaatatgtcatattcggttctaaatttgttttttcgggatggagggagtttgcatgaaattctcgtaccagataacttgactacttgaggtctattccctcccttaaaaaaaacatattctgatatttctaacaatacatctgaaagcatagtacaccatgtcacatcgaacgtttgaataattacatgaagtattaaatatagtttaaaaaaataactatttgcacatattacgactaagttacgagacgaatcttttcaacctaattgctccataatttgaaaatgtggtgctacaataaacatgtgctaatgacgaattaattaggcttcgtcacgcggtttactgacggattctgtaattagttttttattagtgcccgaacactctatgcgacaccttatataatatccgatgtgatacgccaaaactttacacccctgaatctaaacaccccctaatttagaatggaatatgatgttttctaatataataaattgttagaaaacgtcacgtctcattttatgggatggatgcagtgtgttcagattaatcggcaggattgtattttttaatgacataatgtgtaatgtgtagatatctactttcaaaacacggtattttcattttatttgcatggggaattaattaaaccattggatccgtnnnnnnnnnnnnnnnnnnnnnnnnnnnnnnnnnnnnnnnnnnnnnnnnnnnnnnnnnnnnnn

SEQ ID NO: 16308 - DNA, 3551 bp, Oryza sativa
  unsure (1)..(3551): unsure at all n locations
gtaagaaaaaccacgcatactatgagcggaggaagtaattgtctacagacatctatggctctaggcccacatgcacattactgtctgtgcagtacactgcaggtgacagtcccgtccatcaacaggtcccgaacttctaaggccatgtacacgcgtgaccttggcatgtggtttcaaacctccacgtcggacgcccgcacccatggcagtggggaccgtggctctgcaggccgaatccgcgcttgcagaggaaccactcgaagcgccgcgcctgggctcgggagccgcgaagccacaacccgaggccacgcgttggcggagccagagccccatgcgtcgcctcgtctggtcggtcaccgtggtagtcgtcgccgctcaccgtcgccaccgtcgccaccgccgctccccgtcaccgccagatgcgaagaggagcaccgccgacgccaccgttgctcctcgcttcctccccgccgccagatgcgaagaggagcaccgccaccggatccggcgagcccgtgcccggatctggcgaccttgggcgtggggcggcggtggaagaagtgggatgcggcggaggagggtgtgggcgtggcggaggaggaggagaggatggcgcggggaagagcgcggcagttgagaggaggaggaggcggcgttgtcgtggcgcacaagaggaggagcggcgcacgagaggggagcggcgctgcggcggctttgagaggaggagcggaggcgacgagagaggaggcgttagagaggaagaggataaggcagagccggttggtagaagagaaaataaaggggagaggattggagagactgacggtgggtccatatatagattaggggtatctatacatttctttttgttgttagaaggactaaaatagttaattttataataacaaatattatagggactaacacatgaatagataggggctgaaacacaaaatatactctacagtggtctccattgtagacattgtggtttttgtgtggccttatcctatgtggcaacctgagaccacagttgcttgtggctaccattgtacatgccctaaggtgtctgcatccagcatcctatgtgatcttatttctttctcattatgctctcatgaaatgacattcattacgaagcgtgatatttgaccttagtgcccctttaaatcacaagactaagaaaacatagaaatagaaaaaaaaaatgtaaaattttgatataaatgtaagtgtaaaacagaggattgcaaaacacaggaaaaacacaggaaaaactgtttgattagaccgcaggaaaaatacaggcattaaaggagagataaagactcagcagaaagtttccatgaggtagatcatcatggtttacctccaaaccttgcatggcattagacatttcatagtaattgagacgttttctaatactactaatttggacatgctgcctgtctagattcgtagtactgggaaacgtctcatccagttcgactcttatatatcccagatggagggagtaataaattaggccgaaaaaaataccgcaatgaccggctattttctttcttttttttagtccaaagtcgaaaacaaatcagagtcgaattggcagtcgtttaaatagcctaacggttcgtacataatttcacaaactacaaatatattgatcaaactaccttaaaactacatatttaaggtgatgtatcacaaaactacaaatttaacactaaatttttatagtgttcctcagccaattgttggtgttttttatttttaatatcattattaccatgtatgccacaagctagaataatcaagaataatatttttctctctttacgttcttaatataactataattgtgtgtgtgagagagagagagagaggagcaatatgcacacttgtacttggcagagaagccgtttcaaaggagagatttaagccgaccctctaatgccactgcctaaacttagccggacaaaattaattaagacaaaacacccaaaaaaagtgatctcaacgctttagcagatcaatgcttgcaattaaacccccattgcttacttcttggcgaaagagaggagaatgcccggacattctcacaaaccaagcatcatcttgatgtggattcagacaactaaacctgcaaggagaagaggagcaaacgtccttgcccgccattgcggcgatgaccggaggcggcgatgccgatcgcaatgcgccgttgctcgccggcggcaggaaggtgtaccatgaacgctgccccgggtgcaggcagcagaggaaggtgcaggccaatgacaggcttccctacctgggtttcctctacacttggatcgcttgcttgtgtgccggtatggtatgcaccatctttgagaggatagatgtttggttaggatgcaggtgttgatctgattttcatcttgtggatcagctatttggttgtcacttgtcacaagttgtggaatgtagaaatggcctttgcaattgttaagattgtgatagtggtgttttgatgatttatataatatttaggagtagacgatgaatcgatgatcttcatgatattgcgtgtttcgacaaactggtagatcttatcagattcagtagtctcattcttttgtcaaaaatagacatacttttatttgtttcggttcagttgtatcaaatattattttatctctattcctgaaaaaagaaatcccattttagctatagttgactaataccatggtcttttgcctttccagcgttgccaattcagtcgttgtttccgtatctgtacttcatggtaagaagatatgctttgaagttgaactattatcatgataaacatatagagagatcaaatatgtgaatttccatgtagtacatggtgattgacatgtattcaattttgttatgatgccacagatcagggacttgaaagtcgcaaaggaagagcaagatattgggttctatgccggttttgtcggtgagcactgtctcctctcatggttttgacaacaccactgagaacattatatgggcaagagttgaaccagatgtcttgtgttgattaatctaccattatcatagaatacttaatagttttggtgttcatttttagtccactatgattattgtggattacttgttaccgactaaacggtaatttctctgtttaaggggctacttatttccttggaagaactatcagtgcagtgccatggggcatttttgctgacaaatatgggaggaagccctgcattgtgatcagtatcctctcagtgtatgaaacactcagttagactatttaaatcatacttgatcccattcgactggactgaagtaaatcttgttttaccatttccaggattgtgtttaacacactctttggcctcagcacgacttactggatggcaattgttaccaggggattacttggattactctgtggtatactaggaccaatcaaggtaaatttacagtttgatggctgatgctaagaannnnnnnnnnnnnnnnnnnnnnnnnnnnnnnnnnnnnnnnnnnnnnnnnnnnnnnnnnnnnnn

SEQ ID NO: 16309 - DNA, 1905 bp, Oryza sativa
  unsure (1)..(1905): unsure at all n locations
nnnnnnnnnnnnnnnnnnnnnnnnnnnnnnnnnnnnnnatgcttcagaggtctgcaggaaggagcaccaagctcttggaatttcccttgtaagaagagttatactcttgttttgcatttcaagcttcttgtttatctctataggatgaggatttaaaatttttactgattatattttagtactggctacttattggtcgtattatatgttataggtcacatcctcgcgagcaatagctctggttgttggaccagctattggaggatttctttcgcaggtgagcttaagtacactttgatgatgaaaccaagttaaactttgtatagttactaaaatgccgttcgccatgccttacttcatcagagctgacttcttgtgcgagtggaagagaaaaagaaacataaatctgacaatttttttcctaaaaactatttagtttcatccttttaatgaaaacagtgctaatggaatcaagtttaactaaattcgcaacctatgaagattgctctgaatctgttggctaatattgtgcattttctatcttgtatcagcctgcaaagaaatacccaaatcttttctctgaagaatcggtatttgggaggtaaattattaatcatcattcattctgttcctcagaaataaatctttgtttatatacttgaagaacagaagataagcctatccaatgtacttctaatttcaggtttccctactttctcccttgcttcgtcatatcggtactagcagcaggagcatgtgttgcgtgtatttggcttccggtacgccactctctccccctaccattctttctttgaaatgctgaaatgcatgtaaaaaaatatactacctcctttctcaaaaggtcgacatcctagaaagtgtgcaataaaatctcaaactcttaaatcactaatatattaaaaaaatattaagatttgatccgtgaaaatggcattaagatttggcattaaaaatatggttatatttttttaataatttttataagtttataattagaaaaaacaataatgaggcatgtgtattggagattatgttgatgaccaaaacgacaagtaaaaacaatagaggtagtattaataaagtatctactgtaatatgtggagaaaagttacttaacattagccccttgttcttaggaaaccctgcacatgcaccatgatgacaaagaagtcattgatgcactagaggcacaagatgcgacttcagacttaggagaaacaactaaagaatcaggatcagggagaatgggccatacaaagagtttgctgaagaactggcagctgatgtcagcaattaccctctactgtgtcttctctctccatgatacagcttatcttgaggtaatccctatattctgaattatagattatcgcagtaataagaagggcgaaggtaggaagtaaaatgagtggaggtcagggtgctaggcaaggccccaactcaataatactctagattcacccctgggttaatacattgagaaacagtctagtttgttaagatgttgatatgccattgtattcctcctatagagaagttacattagcacaaacagcgaacttaggatgttaatgtactatgtaacttatattttcagatattttcactctgggctgtgagcagcagaaaataccggggcctgagttttacatcccaggatgttggtatcgtgctagctatttccggtatgtgatgttttttcaagtttttatgcatgatcaatacatacaagaaaccatatctcaaaaacattttttttaaagtaatcttcaaaataaattaaatcagcagcatacttagtatacctgtttaccactaatgtnnnnnnnnnnnnnnnnnnnnnnnnnnnnnnnnnnnnnnnnnnnnnnnnnnnnnnnnnnnnnn

SEQ ID NO: 16310 - DNA, 2083 bp, Oryza sativa
  unsure (1)..(2083): unsure at all n locations
aaaacaataatgaggcatgtgtattgagattatgttgatgaccaaacgncaagtaaaacaatagaggtagtattaataaagtatctactgtaatatgtgagaaaagtactttcacatagcnnccttgttcttagaaacccctgcacatgcaccatgatgacaaagaagtcattgatgcactagaggcacaagatgcgacttcagacttaggagaaacaactaaagaatcaggatcagggagaatgggccatacaaagagtttgctgaagaactggcagctgatgtcagcaattaccctctactgtgtcttctctctccatgatacagcttatcttgaggtaatccctatattctgaattatagattatcgcagtaataagaagggcgaaggtaggaagtaaaatgagtggaggtcagggtgctaggcaaggccccaactcaataatactctagattcacccctgggttaatacattgagaaacagtctagtttgttaagatgttgatatgccattgtattcctcctatagagaagttacattagcacaaacagcgaacttaggatgttaatgtactatgtaacttatattttcagatattttcactctgggctgtgagcagcagaaaataccggggcctgagttttacatcccaggatgttggtatcgtgctagctatttccggtatgtgatgttttttcaagtttttatgcatgatcaatacatacaagaaaccatatctcaaaaacattttttttaaagtaatcttcaaaataaattaaatcagcagcatacttagtatacctgtttaccactaatgtgtagctatcattgccttcaaaattcctttagctaatgacaatttcgtctgaatttgcaggttttggtgttttggtgtaccaacttgcgatttatccgcttcttgctaaatatgttgggccaatcaagccattccgttatgcagcggtagggagatgcatgttttgtcttaagatgattcttctgaaaattgaatctttttttttagtaccaatgcatgtttgatttgcaggtcttgtctatacttctcctttcaacatatccattcatggctaacctgtatggtctggagctcaaagtactcatcaacattgcttcgcttttgaaaaatatgttcgctgtaagcaattcctctttgcgatatatatcctgccctataatagggaaaattgcatttttatttgtaccaacataaaaatccatgtttttgattcaagcttcccaaattcagtgatgttgggcttgtttagtttgcaaccataccaaaatattggtaacgccaaatcatgggcgagtttttgctaatgccaacattttaacattgccaaaattactattcaaaatgtcaatattttggtatggcaagttttggcttcaaaccaaaccagcatgttgttccttttttttttttgcctcctacagagaaaaggattacaaattaaaaagttaattgtattcttagataaaacgagcttaatcgttttacaggaatttatcgtttaaagatttgtaatgcttgttttgaatggtacaggctacaattactattgcatgcaacatcctgcaaaacactgcagtggtatgtatcagaatcaataggacatttcttttttacttcaatgcatttcctcgttgtcataatcatgttgttatgctcttttttcttaactgttggaacatgcaaagacgcaagaacaaagaggggttgcaaatggaatctctgtcactctgatgtcaatcttcaaagccgtagctccagcagcagctggaattttgtaagttccttttgtggttagaagttcatgtttcttctctctttttttttccctcttccaagaataaaaaggagatgaccaatcaatcaatctctttgcttgatgcaggttttcatgggcgcaaaagcacattactgggttgttcttaccaggtaaaacaacaaggctcttccaagccatgataatttgcattactgttgatatagtgtcannnnnnnnnnnnnnnnnnnnnnnnnnnnnnnnnnnnnnnnnnnnnnnnnnnnnnnnnta

SEQ ID NO: 16311 - DNA, 1685 bp, Oryza sativa
  unsure (1)..(1685): unsure at all n locations
tgcttgatgcaggttttcatgggcgcaaaagcacattactgggttgttcttaccaggtaaaacaacaaggctcttccaagccatgataatttgcattactgttgatatagtgtcatcatatcactctctctgtcctagaaaaaaccaacttctagatatgaatctgaacatagatagaaaaatcaactttttactagacgttggttttttctgggatggagtacatattatcaggtgtgattagttacctgactcataatggtcatgatacatccaggtgagcagatcctgttcctgatgctgaacatggtgtcagtgattgggttcatcctgacattcaagccatttttcgccttgccggatatgcgatgatgtgtagttaggtaacaaaaaggccagaatttatcagacttcagcctggattctaacctgcaagaggaattcatgtactgtaccgcgtgtaatgttcagttgtgtaatcagtttggtggtatctttgatttctgtctgaactccgaaccattggatggtcgaggcatatgataaacagctaacgggatcttgtttcatctaattacctagctagcagaatcgttgttacattaatcgactgaagcaatatgactgccaaattaaacatgctcaaattccttccaagacttacggaatcaagaacattgtatttcatatatagtgacagtaaaatatgtaagaacatatttaaagatcatgaccaaaactcggggatactgatgagctcacagtaagacgagagaatcaagtgttcatcacattgtcaatatgagaatatgatcgtatatcacccaaattaatattggtagaatgaatatagcacaagcatggatggttttgattaacaacagaatggctacacccttgaaaagttgaaacaaacatagagtaattgaataaacaaaatcacaaagatcagagccatttttcacaaacagaaaaaatcacaaacaaacagaaagcattgtctacagcataggatgtctctgaatatcaagaatttcggtttggaacatatctatccccacaaaattacatctgaacataaaattaataaagataattttagcctctgacagtatggctactggaactccccctgtgttgatccaaatgatgcttcaacttacttggccatcatgactttaacgaattcatcgtagttgatctgcccatcaccatcaacatcggcctcacggatcatctcttcaacctcctcatctgtcagcttctcaccaaggttagtcatgacgtgacgcaattcagcagcagagataaaaccattttggtccttgtcgaacacacggaacgcctccttgagctcttcctcagaatcagtatctttcatcttgcgggccatcaggttgagaaattcagggaaatcgattgttccattgccgtcagcatccacctcattgatcatgtcttgtagttctgcctcagttgggttctgccccagcgaacgcatgacagttcccaactccttagtagtaatacaacctggaagaaaataactttatctatgtcactcaaagtctaaaaatcgttcaactcgaggtgtcagtgtatcactacatagtattcacagtactgctttagatcatcaaggcttgtnnnnnnnnnnnnnnnnnnnnnnnnnnnnnnnnnnnnnn

SEQ ID NO: 16312 - DNA, 8429 bp, Oryza sativa
  unsure (1)..(8429): unsure at all n locations
tcttcatctgtcagcttctcaccaaggttagtcatgacgtgacgcaattcaacatcagagataaaagcattttggtccttgtcgaacacacggaacgcctccatgagctcttccacaggatcagtatctttcttcttgcgggtcatcaggttaagaaattcaggaaaatcgattgttccattgccgtcagcatccgcctcattgatcatgtcttgtagttctgcctcagttgggttcagccccagcgaacgcatgacagttcccaactccttagtagtaatacaccctggaagaaaataactttatctatgtcactcaaagtctaaaaatcgttcaactcgaggtgtcagtgtatcactacatagtattcacagtactgctttagatcatcaaggcttgtcgctgtttacaaactgataaaagaaagagaaacaagaccaaaagctgagcactacttgaaatgaacagaatcgaagtgttatctaaaattgcttaattattactccctgatcatatatgtaaagattatcgaaaacagtagtagctcatgttagtgctaattgtaaacttcttatcctctaccaccacagatcttctgtagaaaatccaagaaaaacaccaggacagtgtcgtcgtattatcatacgagatgactaacccaaattactacactattgcaatgggaatgaaaacgaggactcgtgagaattatcccatctaaacctaatcaagcacgaatcattacgaacaggcactagccagtgccccaaatctcaaaaaggccagaaaattacgctggatcacgcgattgaccgaccagcatctactcccaaaccgacgagcaacgcctatattatcaaaagatccggagatttcagagcagctaaacgcatcccaaccggatccctacagcaaaccaagaatcgggacacggagacgacggatcagggcgttcgatttaattaacccccaagaaaaagatcgccgatctcgcttcggacagcctatcgatctggttcccgcaacaaaattacgagagggagggagggaggtgaggcaggggttaccgtcgccgtccttgtcgaagaggctgaaggcctccttgaactcggcgatctggtcgtcggtgagctggtccgccattggcgacgcaggcgcgcgcgagcgagagagagaggaaggagaggggagtcgtgggggaggagagcttgcccgagttggagacttgcagtgtgggtaggcttacctccttttttattgcagagataactcacgatttctactgttttttctaagactagtgctaggttaggcttccaacttggcacgttcttccaatggtttaggttgagggaattgcctgtaggaggaacggttcggtactaccttctattctatagttatcgatccaagttatatagaaaaaataatgcttaaaaaaattactgtaatacctatatttaaggggtaggatagagaaaattttgaattgatgtgataaaaggtacttctaaactcctttttttttgaaaactttttaatccaaaagcggcctctattttggaatgggaatggacagagtacatgcactagctaggtctcaaatactatgtattatgtgtatgtggtctcaagtaggatcctaaacaatcatagtaaatccaaaacgaaaatgatctggtgtcccaaacataataggatatcacaataaaactatctagtacttgacatatcaagcaatttatatttaatagtgatttgtagggtttgttattgtagagctaaatgttgccttagcaaaagtttggtagtacatgtttatcaagcttcaagcattcatcctccaaactctaccatttgtttatcaattgctttcaaatgaattgtcaaattagaaaccctatgttttgggggaaaactgattaaatgaaatccctaattaagaaactgagataaagatagctattataaataaattgaaactacattcaatttgaatgcttgaaacttgtttctctgcataagaaatagctagatgttgtcgtcgacataaaatatagtgtaaactgggtggccaaggtgggaggagggtgctaggggtctataggatccttcgctgagattgatcacgttgtcacttaaagtggtgtgttctctttgcaaattgagagcttgctggtcagtggtgtaggaaagaaaaggagactccttgccttcatcttcttgcctagacgaagaagaagagaactcgatcgagcaggcatcttttgttctttagtgcgtgtctggccattctaggctacttgatgggctttttcattctgcagtctgatagcacacgatttgctctaactattgggctagggggtgacgtcatttctcctatatgggctttagtaattaaaaacaaaaattagcatgtgtcatgtgcatcagacgaggtcaacaagtccatgtacacattgtctagagcaacttagggcaagaacaatgcaagatatgctttagctagacctcaacaagatgtagggccaatacactgatcgaacagacatatactccataatgtatgtggtctcaagtagggtccatgcacaagctacatagcaacttaaaacgagcagtgcaaagacatgctctagccaaacctcaagtgtcatgcaggagcaagacattaaatagacacatactccacagtccacactacatgtggtcttagatagggtccatacataggattcaaagcgaatcccacctaatgatctgccccgggtgagccatgaaacgtgtaggctccatagagatacacgactcctcactgagtgcgaacataggggtggaagtccaccctagcaccgcggggatgttaggaaaaaagcccactgtgtatagccttaagaagaaattctacttttgattctaaacattgtcatcggcaaacatagattttataggacagatatcatggcccgagaagggaagatattgtttagatctaaaatcatgattttttttcttagacaaagttttgaagtttgaccaagtttgtagaaaaatatactaatatttttaatacaaaataaatatactatcaaaatatatttaatgttaaatttgatgaaactaatttggtgttcaaaatgttactaattttctctataaacttgatcacacctaaaaaattgactaagaaaaaaaatcaaacaacttaaatatgaaatgaagggagtaattcagaagctttcccccgattcatctgaaaattcatgtgtccgattaatcggacaacgagggagcagcatagacaagcagcagtagtttagtttgatttgaaagtgattggttggcaacactatcagaactcggcaacggcacaatattagcagtatgtcttgtacctggtgcatattttacacggaaccaaacattctctctaccataccaaaatttgctagtgcggcaatgccaacaaaaccaaaagtttcgagccattgacgctagtatagtttcagaggggttggaatttgcagatagattcagttcaggacaaaatcccagcatcttcacatggcgcgcaaaagagtaccatgtttaatacacgagactgtttttttctttacctatccaagagcctatctcaaatgtaatgcacgcaccaaacactcgctgcatttacccaccacaacaaaacgtgcaagcaggtgccaagcgcagtgcagcccaggcatcctgctatctctctcacccaactctgttggacaccgtttggtagatgttcttcagctgagtattccacttgtctatggcttggtatttcctcattcccttcgacctgcgaaatgcgaatcggatcaccttcagaaaagcaatcgcatagatagaacaatgtgatggaaaaagcagggggaatacgcacctgtcaccacgttctagtaacttgttcacctgatctatgtggccctggattcggttatccagaatgagtgagaccaagagctgntcgactccttttctgggaaatttagctcctacatgcaaaacattgacagaacaatcgatgacaaggcatcttgtacactgtacgaaagcaaatttcacaaaaaactagacctccgtgaggaacagcatagggtctgcacgattaagcgcacatgatttcaattgaactggaatcacctagtttgggcacacgacagaaaaagatcaagcttcaaactatatttcttgcaacttcctaaaatagcacgagtatataccaaagttccatgttactaataattttcatgcaccatttgttatcacaagatattgtcatattcttctggtattgagcaaatgcacattatctggtgttggacaaagaacagattatctagacaaaatactaatctttagctcacatcaatttctgtcagcaaagattatcatgaacatttaagagagcgagtattcacctgtgaaatgaatggaatcctgattctagtatatggcttaataagcttgagcagaacttgagttctgatgttcttcaataggtcctcaatataattacggatgaaaggatcgtccattattgttcttctgttgctctgaattttgtttgtaacaatcacatcagaaatccagaatcaattaacagaataactagcttagaattgctgcagaaaatagcaagatggataatgttcaataacactgacctttagaatcttttcaaattccatgatgtcattcttctgatatgctgcaatcaagtttgtcatggcgaggatctcaggatcatttttgtacctgaaagcatcaaggagttacagggtggcatgaaattaagatacaagatttatgagggaatcatcaaatgtcttacggcttagcctcttgcccatcaaagggattcacttcagattccatcaacatatttgcaagaacaagatatctaatatgcagtacaataaaaaaggatgaggaagttctaaatttatcaatatacgaaattaaaatggaaaagaaatgcagatgatttgattacttcaggcattgaattctccgcggattgccagcttcatcatagtttttgaatgcttcaaagaaatcagttgcagcatctgcccattgcctctcagccatgtgcatctttccaccacattcacgaattatacccatgattcttggatgaggtatcgctgatttgatggaaagagcttttgtatatagttcctgcagcagaggttcacttcagaaagtgcatttcatgctaactgcctaaggcaggagaaaggtttgaacccaatatgggtcaacatagtactataaatgaaataggctaaatatagtcaatgctcttataaacatattgtccaaaataggtacaaaagacaggcatcagctttgtaggttttattttataaagctgtagaaaatcaataatttagcaaggaagttgtgtgctcactataccacctgatttcaggcaagcatattatgcaaatgtataattgtatactcagtggcaaatatcctggtatcagtaacatatcaacctatacaaattattgtcaaaggaataaaccggcaaaacagcagaaggatgaaaagttatctttatatctgcgttctggctgcagtcaactgtgttttttaacaaatatacagctagagtactgcaatattgaacaagaaactgacacaaaatcttgaacagtagtaacctgtaatccaaaataatcacgtgtaaaaagactgacaatatgtcttaccttcaattttttgttgttctttgtttcagtgtacatttggatctcaatagcatagacttccaaaagttgtgtgcctttcttctgatcatcagaaccatcttctctttgacaagatttatgcagctccttcagtatctacaggaagaagttacgagcaaaataattagagtaatgactgcagaatatgtaaagaaaaccaattgactagagaaacttgtataagcaccttgctcatccggccatactcccccatgtcaaaccaaattttgcaaagcttcaggtttgtcttaaaccataatctctgcgcagcaaagaatagcaaggtataaagaacaatcttttggtacataaaattctaatttggataaggcaagaaactgaacctcattctttgcctcttcaagtgctttcagtgttgtctggtagaactcttgcagaagagagaagttttgactagctgatccggagacaaaatccataatgttgtttatacatttctcactgtagttacgtgtcacagcagatttgatgtatgtcaacatctccctataggcatccatcatttctttgtacttcccaagcttataatacagcttcactgtttgtttcagagctttgaaacccctataaagaaaagagttacagaactgacgtcagatctctaaaatatgagtggctgttggatacagatacacttgatttcactgacaacttataacacattaccattgaaaaaaaaggatgtccatcaaaatatgcagccctccaaaaaggccactaatacttcagttagaattctatttgtggctcaagcatatcctatattgggaatctggggggattcctggtcaacataatatgacctgaggttttaagatcttaggtctgaactttgagaaggctcgagctgatggtttgtgataaacaattttcatacatctttactgcacaaagagtaggtgctagtgatgtcatgttatatcttaaattgttaatcttctgtggatggatctacgtaaacaagaatttgttgtttgtaattttttttctaatactgcaccatgcacacattcattcaaatatataaaagaccggttcatgaaaccttatttatttttaaatttttagggcaattatcttggcatttgtaggatcagaatacagactatatctaattgaaagtcttaacagcatacaggcactgtgctaccataaaaaacatacaagtacatgaaggtatggagtccctgaagcttaacgataacaagtagctcatatgggcatgttgacagtcgaatgccaatagaatttagagttcatatgtccaggaactttatattgtagatggacctatacagcaactaaaatcgacatcattatagatacaattgatccccagtaaatgtagttcttactaaatctatcttacatggtgaaagccatatcacccctcttattctctacctttgaatgagtactcagtggcacagatggataggtaggcgaaccacttaagctttgccttagactgacggaacaaagctaagaagtaggcagaatggaaaaaggaaagggacaagggcggtcgtcgcttggcgcgaaggctgctggtttggtacggtactaaaggtcctcgggtgtttgattcattctgctgagcccaacactttaggcaagcccacaagacaataaaatccaacatcttttgtgaaccgcacagaaggcaaggttttaatgtctaaccaataggatgcatacagacgttcaagaatgaaatattaaatgtgaaagttaaaaatacggcatcaccagaagaatgttttcaattatatattttatttcattttgcaaccatagaatttgttcaaaatgacaccttccttaccacatgcgtaataagatatttcagcagggtatcaactagtaaaatgttatataaggcttaccattcagccttttcaggctccatacgtactacttgatcgaagccagcaagtgcaccctcagggtctgtctcaaccatacctgtaataagatatttgagcaatgtcatatcataaagcagcatatacatgaagtagcatttgtaattgtgtggtaacaaaagacaaacacaatttatgcaagaatccccatgctcccacctcacagaccatatgaactagctttccatttcagaaacaagaaataggagtagccataattcatctacctctgttggctttttagggcatattttattttgaaaaaaaaaaacttcaagattaaactttgactattcatttcacataataaaatataatcataatagccataaaactaactttttaaaaatattttgactaattgttgaccaaaatctacgaaattttacttctcgaaagcgggcatatgcctaataaaaatcaatagagggagtttttttttttctgccagataacactatttgtgatcaatttgattccaaggtcgtcatgggacaaaccgacagccacagcacttgaggatgcaacggcgtccaagcggccaccttggcatccccaatgcaaggtaaggtgagctttagtagaggagaatacatgagcaaagctgagcagaaagaagaaaatcaagcttagcaggttagcagagcaaatgagaagcagcaatggataattggagacagtgacagca

SEQ ID NO: 16313 - DNA, 1195 bp, Oryza sativa
  unsure (1)..(1195): unsure at all n locations
cccaataggactaaccacacagtcggtggaaataagcaagtagtactttcactttattaagattctgatggtgtaggatattcatggtcaggtttaaaaaaaaacgtcctaagaaattcaagaaaaatatacatacatgcccatcaacaaagtcacagttaaaccggcaattacacgcaaaagcaaagcaacatacatacatgcatcatagaagggaaccctaagagaacagctaaaaatcagggatttggctggcacacaatcatggtggcctctcctcgaatactacactaccacactacatacacagggtccgagaaaacgcaccgccgaggaaacacaagaatgaaagagattggaagcgaacctttggagttgtagtactggttctcgatgtcaacatcctgctcctccggctcgtcgtcggagtactcgaacccgtaatcctccatgtccgcatctggaaaaggaaccgatcacggggatgagagaagggggtgcggaaacgacaatcgagcgagggcgcgaatcgggatatcggggattaccggagcccatgtcagcggcggcggtggcggcggagaggaggaggcgacccgcgcggcgacgggcggagagggaggggagggggcgagagctagggtttccgagaccgcagcggtttgcagttgcggaggcggatgcggagagagaagagaggagaggacgaagggagggggcgacttttgcgtataagcccctgggaagttagggattttaagacggagacggaatacacctgaataataggatgctctctctctcccttttttttcacgaaaaaacaggcaaatgtttggatttctcaggggatttttcatgttgtgtttttttaggttgattgatttttcatgttgggttaataaagcagaaattgatgattttgatttaaaagcgagtaacgattgtagtagagaagagtggttgcgttggggttatgttaaaaatagggcatgcacactctcccggtatttatcactctaatttattgctttcaccatatgcatgtccatgcctcttcaccgatgcaggcgatgattaaggttattatttgttctaattgcgtagtatactccagcatttcattcctttcannnnnnnnnnnnnnnnnnnnnnnnnnnnnnnnnnnnnnnnnnnnnnnnnnnnnnnnnnnnnn

SEQ ID NO: 16314 - DNA, 708 bp, Oryza sativa
  unsure (1)..(708): unsure at all n locations
nnnnnnnnnnnnnnnnnnnnnnnnnnnnnnnnnnnnnnnnnnnnnnnnnnnnnnnnnnncacaattttgcaaatgaagcatgtgcaagaggtttgagttgagcaattaccaacagccagttttttaggactctgtaagtataggtatttctgtacagcttagatgaagaatccaccatccaccgtacaccctattatttttgacttgttacacaattttcttgaacatcgtatttctgtaaagtttgtagttaacaagtttaggaattcggcaatcttacctgattcttgtgaatttaactgtttgagatatggcccttggcatttgatgggcatggtttcatctacactttgtgtgacatgtgttcctaagtatagttttccaactatggtcaatatttgtataattatattaggcaacgcatgtcagaagaaagaaaagcgccaaagaggaattgaggcatggctacaagtgaacaatttaagcataaacgaatagaataatcagtagtaccagcgctgcttattatttattttaaaaacatatttcggcatatcattttggaccataacaacatggcatctcaacagtcaacaatgcaaaagtaaagagaacttttgaaccagtcccttataatagggcaactaaatcaaaactggcaataaatatcaagacttagttcatcaaagcaaccatacattaccaggt

SEQ ID NO: 16315 - DNA, 511 bp, Oryza sativa
  unsure (1)..(511): unsure at all n locations
nnnnnnnnnnnnnnnnnnnnnnnnnnnnnnnnnnnnnnnnnnnnnnnnnnnnnnnnncgtatagatgcaacggatagaccagatgaagccaacggtaaaatttgcctttagcctcaaaggcagttaggcagacgatgcagacccaccccgacctcccaagcgcacgcctccgatcctctcgccttagacctagccgccgccgccgccgccgcctccgccggaaagtgagccctccccccgtcgcgcacacacaccccctcccgattccggtgggcgcgcgcgggggagacaaccaaggtatacttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16316 - DNA, 1822 bp, Oryza sativa
  unsure (1)..(1822): unsure at all n locations
nnnnnnnnnnnnnnnnnnnnnnnnnnnnnnnnnnnnnnnnnnnnnnnnnnnnnnnnnnnnnnagttagtattaacaacaggaacagcatgttcattcactagttgtggcatggatataagtgaagcattatcgcacaactcttctttatcacaaggaacagcaagtaaatcaatttgtgacaaaggcaactcagcaattgattccactaatggttgctctactatagcatgaaaagtggacaagtatagctcaccttgagaatactcaccttcatttctctcagcaccatttaatttaccttgcgaactttcttcagacatcgtaggtgcttcatcctctttcttctcaagtataccattctccttttcttggatgtgctgatcttcctgcaaaacgttagtaacaggggagacaaaagattgctcctccaatgtttgcacatcatcattacataagtatattggggattcagaaataggagataaatcacattggtcatgcatcctcgcctttgatatgatctaactctcaatgctacgagcaagcatgaataggtgcccaatataattatatgtcacattatcaagcaaaacctgaatttcagaattaagcccattgaaaaatctacgcattgtattttcattgcactctttgagaccactgtagatgatacagaccttaaattcatgaatgtactccctaacagttctatcaccttgtttcagatgttctaatttctcccaaagagtacatttgtaataagaagtcacaaagcgttttctcatcatggttttcaattcatcctaagtttcaggtttattactaacataagtccaccaaaataatgcagaagaggtaaacttattactagcagccttaatcatttgagcatcagaaaaatcatatatatcaaattcattgtctactgctagctcccaatcaatgtatgcaacagaatcaatactttccatcatagaatggtaacttagatgcaacttgttcaaaattatagtcatgtacctcatatgcatcacgtggagaagtcgtcatatctcgtcgaaggtgtagaagtcgatgttctcgtattcccttacgcaatcctgccatggttagaagcaaacaagaaacacacaaaaatatgcacgctcctatcaactactaggtagtggcagctcaaatatcacacacactcaagcttttaacgaagctcttacaagttcttaccaaagcaagcggaatggtgatgtacaccgacttaaccaagcaccccaatggagattggatgtatcgatgccttgggaaacacttgctgtacggctgcaatcatatctgtggagctctgggtaggcttaaatatgtagcaaagggatagcaaatgctcaaatcagagaatgtaaagttgaataatggttcaaagtcaagtaccgtgctggtcataggctagaacgtactagagaccgagcctagacacaaacgataccacaagatagcactaggaacaactcatgcacaactctgatatatgaagttcagctcaaacataacagtattttctcttttctttctttcttctttcttcttttcttttttttctttcctttccttttctgttttttttggtgcagtttttttttcttttatttttttatgcacctttctgcctttttttctcacttttttcttgattttttttaacaaaaactgactcaaggaccttaatgtaaggttacaaggactcaaacgtaaatataaaatttacagggactcaaatgtaaaagtctaannnnnnnnnnnnnnnnnnnnnnnnnnnnnnnnnnnnnn

SEQ ID NO: 16317 - DNA, 2572 bp, Oryza sativa
ctgtacggctgcaatcatatctgtgaagctctgggtaggctttaaatatgtagcaaagggatagcaaatgctcaatcagagaatgtaaagttgaataatggttcaaagtcaagtaccgtgctggtcctaggctagaacgtactagagaccgagcctagacacaaacgataccacaagatagcactaggaacaactcatgcacaactctgatatatgaagttcagctcaaacataacagtattttctcttttctttctttcttctttcttcttttcttttttttctttcctttccttttctgttttttttggtgcagtttttttttcttttatttttttatgcacctttctgcctttttttctcacttttttcttgattttttttaacaaaaactgactcaaggaccttaatgtaaggttacaaggactcaaacgtaaatataaaatttacagggactcaaatgtaaaagtctaaacccaaaattcaaattatacaaaaatggaatgctgaatttatgccggttccgtttttccaaacagatctcaaaaccgataccaaacaaaaattcaccaaggtgtttgacacaacttggaaccgtgaaagggagggagggagtcggactcggccaaagggacgagtgggagtcggccaggaggtggagtggatggtagccgataattaggatttggtgtatgggataaaaatgaaactgatttttaaccaatccaatctactatatctttccaaaacaaacttgactacttccaaaatcagattggtaattcactttcctcctctcgtgcacgacacaggcacggccaaaacagaagcacggcaatcagcaaacccaagatgcaactcaacaactccaaatccaaccgatagaaacttttgaaaactacaaaaatagaatcgtggcagcaagccgattccgttttcgtaggtcccgacgataacagagacacagaggcgacgacgactctggtataaaacatgaccagaactcgaaactctaaacgaactagacgctaagaccagcaacacgacgagacgatgcaacacaaaattcaacaaagcaaaaactgaaaaaaacaatgcaatggcacaatatggctaggtaaatgatacggattttttttgtatggctattttctggttataggaagataaaaactcaccgagtaatgaaagctctgataccacctgatgaaccctgagttcctctcgacactcaaggctgttgttggcccgatctttcggtgagttgtgataactatgatttgggagaaacgttaacgatccgactacaaccgtacaagacgttctgttgcgccttagcgatcaatacacctctccgtgggttgttgatcttgccggtgcagatcaaccttattcctgcaagcaaatcgaagaaacaagcaagaacaagataaaagcaatctgaatagcaaataggaatgaatacacaagataagttggggttccgaagagcaagcagacggacggtctagccgacacgcgtgctgcaagcaagtagcaatggctaaactttaatctatcaaaacccaagaaactctaaaggggtacctaactatttaaggaggtgggaggacgacctaaggggaccctagggtcgtgctccacctggttggggcgcaccccacatgggccccacttgggccggggttccagacgaagttataagcccataggccattataggtgacgcaacaccttctttttgtgatttcggccgactaggatggaatttggcgatgaagctggatccattggaaagatgactccgagagctttccatcaagtactcatggacccaaaatggagctcgcatgcatatttggcggccgtttgaagtccatactgtagcaggtggccgaactggattgcagaacttggacggcttgatcttgatgtgaacgacggttgtatctatagtagctatggtcacatcatcctccccttcttcacggaaaaccgtcctcggtttttccatatggtgctcttcgtgtagtctatttaaaacaacctgtttcttccaatcacaacaagacaaactcgagataattttgttagcaataacatttctctctagcttgcatgttttatccacaagtacaggaggttctaaatctgaacagatgtaaactctatgcaccaaatatattcctctatcattatattcaccaaagagatgaaaaatagtgttacttggaatagtgacatggcaaatcagacttagcaaataatttctccttcaaattatcgagctcatgaaaatcagcaaactgaacatagcccaaagtatttaaagaatatgtcaattcacgttcctctactctattagcaatgtgaacaacatgcttaaaatcagcgcagttagtattaacaacaggaatagcatgttcattcactagttgtggcatggatataagtgaagcattatcgcacaactcttctttatcacaaggaacagcaagtaaatcaatttgtgacaaaggcaactcagcaattgattccactaatggggtaccgagctcgaattcgccctata

SEQ ID NO: 16318 - DNA, 1862 bp, Oryza sativa
  unsure (1)..(1862): unsure at all n locations
nnnnnnnnnnnnnnnnnnnnnnnnnnnnnnnnnnnnnnnnnnnnnnnnnnnnnnntactgccacaaggaaaacaataggaaaagtgcttgcctagatcttggatttggggctggctcctccacatcgattcctgccacttgtctccacttgatttgccaaaagcaggtagtagaggccaccggtccttctctcggtcaaaaggccatccaaaccatctccaaaaatctccgccgccctcttctccaaccaactccgccgccatatgatgaaccctgagttcctctcaacactcaaggctgttgttggcccgatctttcggtgagttgtgataactacgatttgggagaaatgttgacgatccgactacaaccgtacaagacgttctgttgcgccttagcgatcgatacgcctctccgtgggttgttgatcttgccagtgcagatcaatcttattcctgcaagcaaatcgaagaaacaagcaagaacaagataaaagcaatctgaattacaaataggaatgaatacacaagataagttggggttccgaagaacaagcagacggacgatctagccgacacgtgtgctgcaagcaagtagcaatggctaaactttaatctatcaaaacccaagaaactctaaaggggtacctaactatttaaggaggtgggaggacgacctaaggggaccctagggtcgtgctccacctggttggggcgcaccccacatgggccccacttgggccggggtcccagagaagttacaggcccataggcccattataggtgacgcaacaccttttttttgtgattttggccgactgggttggaatttggcgatgaagctagatcattggaaagatgactctgagagctttccatcaagtaatcatggatccaaaatggagcttgcatgcatatttggcggccgtttgaagtccacactgtagcaggtagccgaactggattgcagaacttggacggcttgatcttgatgtgaacgacggttgtatctatagtagccatggtcacatcaccatagatctagcgctggagaggaagaaggaatagaacgagaatgactcgacctaaactacgggaaaacccaaccagaaacctacactagacaccttaagggatgcgatctgacccctcctcccatcgtcgctggcgacgagccgccggaaacccggggaagagaggttgggggagaaagttttttttttccgactcgctggtcgcttcaggaagcctcctctctctccatcgtccgatgtaaatagatttattgtactaggatgtgtcacattctttgcctatgttgagtttttttttttacggagggagtagtacttttatctgttttctttactccctagcgagaaattggatattacgccactgccaagagtgggattcgccacaatgccattccgcggaatggcgtcgttaaaatgccactgccaaaactgggcttacatttgttttgctatttggaccatttcactccattttcacctaatttttcacccaaaatgcccttcgatctgagtggtggttgccagtggcgacaccgagctaaccgtggcagaggccaaggaggaagaggaagccacccacgacggcggtggcatgcacttccagtggctgcgcgccgcggtgctaggcgctagcgacgatcttgtctccactgcgtcgctcatgctcggcatcggcgcggcgtgccccgccgacgagcatgccgtactcctgtccgggctggccggcctcgtcgccgtcgactggccatcggcaagccgtcttcctgtccgggctaaccgggctcgtcgccggccacgcgcagctcgatgtctacctggccgaaat

SEQ ID NO: 16319 - DNA, 1046 bp, Oryza sativa
  unsure (1)..(1046): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagtgttagccgtgcatctcttgtcccctgtttgcataaatctcaaaagtattggcaaaactcactatctatgattcccactggaagtgcagtacccattgtgaaataatatgttctcgtttcagactatatatctcctcatcttttacttatgtatcaggatctggtgagattctaaatgttgttttacatatgttcttttttacataataaattgtgagccttttatggtctttgaggagataccacaaggtacacgcattctatagctattttgtggtatctcttggcaacagtatgaagaaagtggtacccagtatgacccaaaaacctcatatattgtcagctcgacatttgaagatatgggaagtcataatgattgtagatttcataatctacttaagattcataatatgctaagcctaaaagatcacctaatgcggaatattaggggcgctaaccattgtttgaagccattgcacttgttgcgatttcctctcttggaaccggagtgaaagaagaggatggagtctcttgaactgctctggtgttcgttggcggcgtagtagtttaagcagagatgatgtggcaggctggcagcgtcctccggcctccacctgcatcggcctggactgtaccatgtttcccctccagcggtttagcttgatcgggattacgttatttttgtgttggtgagatttgagaccgagagannnnnnnnnnnnnnnnnnnnnnnnnnnnnnnnnnnnnnnnnnnnnnnnnnnnnnnnnnnn

SEQ ID NO: 16320 - DNA, 739 bp, Oryza sativa
  unsure (1)..(739): unsure at all n locations
nnnnnnnnnnnnnnnnnnnnnnnnnnnnnnnnnnnnnnnnnnnnnnnnnnnnnnatccccttttatatatttgaatgaatgtgtgcatggtgcagtattagaaaaaaaattacaaacaacaaattttgtttacgtagatccatccacagaagattaacaatttaagatataacatgacatcactagcacctactctttgtgcagtaaagatgtatgaaaattgtttatcacaaaccatcagctcgagccttctcaaagttcagacctaagatcttaaaacctcaggtcatattatgttgaccaggaatccccccagattcccaatataggatatgcttgagccacaaatagaattctaactgaagtattagtggcctttttggagggctgcatattttgatggacatccttttttttcaatggtaatgtgttataagttgtcagtgaaatcaagtgtatctgtatccaacagccactcatattttagagatctgacgtcagttctgtaactcttttctttataggggtttcaaagctctgaaacaaacagtgaagctgtattataagcttgggaagtacaaagaaatgatggatgcctatagggagatgttgacatacatcaaatctgctgtgacacgtaactacagtgagaaatgtataaacaacattatggattttgtctccggatcagctagtcaaaacttctctcttttggcagagttctaccagacaacactga

SEQ ID NO: 16321 - DNA, 714 bp, Oryza sativa
tactccatgagtgcccttcttttttagaaagacgggtctcacttatcaaaagtcatagcagtggcatctaggagagtaggaggcctgaggaggatgctggcagaggcttaccttgccttggccatatatgtggtcatccaggatatgctagctgtccatgcgagcatctgggtggggtcagctggcagtgtcacgtgactgtgtgagggagggggcgttaacgagtgtgcatggcctatggtggagtaggtatagagaaaagaaggttaagagaaggaataaccgaagaagggaaggtgtggtgtactggtgttgttggcgcagcaatgctgtcactgtctccaattatccattgctgcttctcatttgctctgctaacctgctaagcttgattttcttctttctgctcagctttgctcatgtattctcctctactaaagctcaccttaccttgcattggggatgccaaggtggccgcttggacgccgttgcatcctcaagtgctgtggctgtcggtttgtcccatgacgaccttggaatcaaattgatcacaaatagtgttatctggcagaaaaaaaaaaactccctctattgatttttattaggcatatgcccgctttcgagaagtaaaatttcgtagattttggtcacaattagtcaaaatatttttaaaaagttagttttatggctattatgattatattttattatgtg

SEQ ID NO: 16322 - DNA, 6906 bp, Oryza sativa
  unsure (1)..(6906): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagacaaattgtctagctcatctgtgcaacttacagatataacgaatggcttctctgagctttttgctatgaaggatacctcagagatcacatgtgtgaagaaggcctcctacctaacctcatctgtaatgaaaaattttgtggttccgaagctagagaaggtgattgatgaagagaggaaagtgacacactcttcattgatggatgagacagaaaaggctattcttgatcctcttaaggtcaaagtgaagttgaaggctgaaaatgttgacatatgctatcctcctgtatttcaaagtggagggaagtttgacctcaagccaggtgcctcaagcaatgatgattatctttactatgactctgcaagtgttatcatatgtgcaattggggccagatatggaaattattgctccaatatggccagaacatttctgatagatgctactcctacacagatcaaggcgtatgaaactcttatgaaagctcatgaagctgctctagaagcattgaagccagggaatcggatgagtgcggtttatcaggctgcagttgacgttattgagaagaatgcccctgaactacttcgtaatctaacgaagtctgctggtacaggaattggtcttgaattccgagagtctggcttaaacttgaatcccaagaatgaccgtatcataaaagcaggaatggttttcaatgtctcccttggtttgcataatcttcaagcagaaaaaaagagtgagaagacaaaacaatactctcttttgttggctgatacatgtttagtgccattggagaacttaacagcatcatgctccaagcttgttaaggatgttgcttattcgtttaatgacgaggatgaagttcttcctgtcaaaaaggtggaggttaatgcaaaggaggcattgccaccaacaaaggccacacttaggtcagacaaccaggagatgtccaaggaagagctccggagacaacaccaggctgaacttgctcgtcaaaagaatgaagagactgctagaaggcttgctggggttggctctggttctggtgatgggcgtggtccctcaaggtcatcaaatgagcttgttgcatataagaatgttaatgatgttccatatgcaagagagttggtcatacaagtagatcagaagaatgaagctgtcctcttacctatttatggcagcatggttcctttccatgtttctactgttaagagtgtcacaagtcaccaagacaaccgcacttgcactatccgcatcttcttcaatgtgcctggcatgccattctcaaacgatagcaatctgaagtcgcaaggggctatctacttgaaggagatcacgttccgctcgaaagatccacgacatagcagtgaagttgttcagcaaatcaaaacgttgaggcggcaagttgcttcaagggagtcagagagagctgaaagagccacccttgttactcaggagaaactccagttgacaagcaacagaaacaagccagtgagactttctgatgtgtggataaggcctgcatttggtggacgtgggcggaagcttacaggaactcttgagtcccatgtcaatggttttagatattctacttcaagggctgatgagcgtgtggatatcatgtatgggaatgtaaagcatgccttcttccagccagcagaaaaagaaatgattacactccttcatttccatttgcacaatcatattatggttggaaacaagaagacaaaggatgttcaattttatgttgaggtgatggatgttgttcagactcttggtgggaataggagatcagctcttgatcctgatgaaattgaagaagagcagcgtgagagggaccgaaagaatagaataaacatggatttccagaactttgtgaacaaggttaatgatcactggtcgcagccacaattcaaggggctggatcttgagnttgatgtccctcttagagagcttggattccatggtgttccatataaagcttcagctttcatcattccaacttcgacttgtttggttgaactaatagagacacccttcctggtggtgaccctgagtgagatagagattgttaatttggagagggtgggctttgggacaaagaactttgacatggctatcgtgttcaaggatttcaagaaggatgttcttcgcattgattccataccatcaacatcacttgatgcaataaaggagtggcttgacacgactgacctcaagtactatgagagcaggctgaaccttaactggcgtcctattctgaaaactatcatcgatgatcctcagaaattcattgatgacggtggctgggaattcttgaatatggaagcaagtgattcagaaacagaggaaacagaggaatctgatcagggctacgagccttctgatgctgagcctgagtctgaatcagaagatgaagattctgacagcgagtccttggtggaatcagatgaggatgatgaggacgattctgaagaagactctgaggaagagaagggtaagacctgggaggagctggaacgggaggcaagcaatgcagacagggagaatggtgcggagtcggacagcgaagaagagaggaggcggcgcaaggtgaagaccttcagcaagtcccgtccaccaccggagcgcagcagcttcaagggaggaccctcaaagaagccgaagttcaggtaaatctaacggtgcttcgccaggcctggctgcttcctgaatgcgcgccctttttgaggggcatggtgtgcttggctgtaagcagaagcgctcctagctgtttctctagatcattacgacactttgtttccgtagtagcgtactgcagttagctgaaagggcggtcggactttggtgaactccatagttgatgaaatgaactgtaaagactcttgccatctaggggaaacccaagttgattcattagttgtatcctcattgatgtaatgttttgtttcctgggtagaatgttgacctccagaatgtataatatttatgttggcggacgtatcttgtgcagatggcaatgctgcagcctcagttgtgtatttctgtcagttgcgtcttatagctccgttccgttctctcgacaaacgggtgctatgttaggttctgtcagtgctctgaaatgtaatgtgtttcctaaaatacggtgtagtttctgtgggacaatattaccatcttcaatgcgacaacggtgcatgcaggaatgtaaatggatcgggcaattgaattttatgctatcacatgtagcaaataaattatcaggaaggtttttatgggggtagtactgggactgctcacatccctagatgcagattacggacaaatgcacttgtctgcctgttgagattacagattacaacttttttttttcattcggaggctcaaaactgttacgacgagttgatcttgatgtcaaatcttcttcccggacaaccagtggctatagaacgcaagcgtctccttgggcttgtactccgggacagtgtgtccagctccctgaaacgtcggcacatgttgttaacatcatcaaatagtacagcttcaaaagctaaccacaagcgaaaatagatgtgttcattccaatggattgtttgtttagacagttgtggtttagcctgaacttgctaatgcatgactgaaaaccgtccagtgtttgctaaagaaaaaaaaaaaaacacatgttgagtgagcaacatccttttggtacagaacatgcagcttatctactggaaaagaaatctggtcacttacctttatggtgaggaaagtgagattgtgttcataaccttgtgtatatctgcaatggcaatatcgctctagtgaggaaaacttgtcaagacattctctcttaatttcttgcttcctcaagtaaaaaaatgtaaacagaagtcttatctacaatctgcacatatacttctaaaattctaggtagaaaagtatgagttaagctgaactgagctaatatctagatgtgacataactcctgaaaaggtatatgaagaactgatgattcctatgaagaaaggatgagaacatacccagcgacttgccctccaaagtaccatggtcgccaatgatcaattactcggtatcccatggatctaacccatgcttccgttccgacatagggaatacagagatcatgatctccactacaaaaaacagaatgatcagtagttggttctcattttatttttttcaaagacaagcacaaatttgaattttaggcctcttcagggtttcccaaaccgacggtaaccgcgcggttaccgcggttattgggcttaccgcggggtacggtaatataaataccgcggtaacctccttaaattcaaataaatttaaaaaataatttgaatttttgataaattttgcacggttttgtacggtttttcacggttaccgcgcggtaaccttacttaccgtcggagcgcggtaaccccggcccgagcggtttaggaaaccctgggcctcttaggctgaagcaaggttcagaaaccgttgataatccctaacccatataagttggattccaaacaacccaacttggtactccaattattttcaatccaaatgagcaataattgtagtactatttgttatttgtagctaaaaattctggcattctgcaccaaggttattaataggaatttaatttaatttaatgtgtagctttttttataggaatttagcactttaaatcactcaattttcaaattacaatcttaatggtctgttgcatacctgtaaataagtgcgcgatatcccatggctgtgaacttcttgtggtacttcaccatgctgtctccagtatcatggtagtactctattcttgcagtatacagttcccatgacccaattaagcttttctgatgtgccattttaacaaggtagttccccacaaagagaagaaagtgaggtgtaaattttaagataaattcaaaatgaaacctttggttcctcgtctatcataccggttccgcgtgaatggcagctcttacatcttcatcatccagccatgcattagcaagttcgtcgctctacaagtacatggaaatgttgatttgttaaacacatgaaacaaaatgttttatctgttgacgaaattaggcacccgaattctaataatttggaacgaaacacagctaaatgtttgatctacaaaatcaaaatgatgaaatttgagacatattaaactaccactccaatttacacaccgtgcaggggagtgatctaccaccaagttcaggccacatcgtcatgcgtccacgagtcacaggagcacggagaggccaagagcggccagccattcgctttctcactggaaatcgcttctctgtctcacctagctttctaaaacttgatggcaagctgctgttcttgaactctaattcttgaatttcagggtgatggtagcagggagcaaggatgttgtacttgttcaggtccttgagttcctgcagttgccagtaatggagcgtttaccaaatttgtaggattgtgctacattgttttgtttacatgtgctggcacagggaagttacccaatgcactctgtctatcttttcttggcacagattattaactttgccccaaaatgtaccatggcatgcagtacttgcatcctgcaagaaagcaactcaaatcattttttagctttgttaactttcatcagatttttttctgtgttgtctatctcctctgacattaccagtgagcacaaccctcgtttaacatattcttttagacagaagtatttagacagattcttttactgttttgaggtgaaagagcacaagagcggaggcattgatttcttgacctcaaacaattcggttgagatgagacccatcccatgtgcaaacggcacaaacgaattgaaatcatagtcctgatcagttgctccattgccaattagatatccctgaaaaataacctttaaattgtgagcccaaagacaattttcgcatgcatgtagagttgttgtatgacgtcatctcccgacaaatgaaaatgggaggaccttaaaattgattcttggcttcagatccttttctatccctgtcaggacataaacaacataagtaggaaacttttgataataatagtttctatatatattttttactgacaaactcaaccttttacaacttcatcagctagtgttggaatgtagatccctgcaaatgactctcccgacatgtagaacggatttgactggaactcagggtataactcaaaccactgcaacaatgcatagaatcaacataaaaattttccgaagtgatattgatattattgcaaccacagtagggagtaggtaccttcagaaggaaggtgtgtgcatcagccgctgtttttaggtcacctgtcgtgtaatctgatttattcaacgagtacgacatcccaacaccagcaggggagtcgaggtacaccacgttggaaacctatttagtgccatatttaatcactcacttgatgttgtatagatattttttgagccaaaaaagagttgatagaacgttaagagtgacttaggtactgctcttttcttcaactccatctcattttctgttaaaacggttttcaaactgttaaatggtgcgctttttgcaaaaaaaagattatatatagaagttagttaaaaatatcaaataaatcattttttaagtttataatagttactccctccgtccaaaaaaacccaacctcatactaggatggg

SEQ ID NO: 16323 - DNA, 6029 bp, Oryza sativa
ccatcctattactaggttgagtttttttggacggagggagtaatacttaatgcgttgaaaatcaacctccaatagcatcatcaacaatgccaatagcatcatcaacaatgcccttattctatccctaatcctaattttttgggttttggtaaaaaaaatgcctctaacagataacctatcctgatcctaatttgttggaaaccccatccccgcatccttcgctctcttcatttgagggagagcgacaccgcacctccaaccctaatctctctttcccgcgaggttttctctttgtgcgcgaggagggagatcgcgcacgtgtaggagcgatcttttttttttggtgtgcggggtctgtgcaaaaataaatacttcggttggtagtttaacataagagcccactcttagttttttagtttttggaatacttcactcaattaaatttaggctttcttttggagagaggagttttctcaggactatacacattctgtcggtgatgctctcagctacctaatttcttcttttcttaagcttagcacaccaaagctcagtgacaacaaccagacacatgagacatcctatgaaatatgcaaaaataaacacccctgctacgtgacaactaattgtgacacaaatagcggaacaaagcatctgaagaaactagatcagttactactagttgttttatctttgtaaagagtaaaaggtactaaaaattagcacaaagaccacaaaggtgcacacctaatcccccggggattacggagaagaggtttcagaaacagagattaaggagcagagcagtgcagagctatcaccttggaccagctgtaggggttgagctccagatttgggaggccacccggatcgctgccacgctcgaaattgaaggggcctgcgctgaatatgcaaattaatccaatggattggatggaatggaatggagcacttgaatcctaatcaatggcgattaaatcgatggtgaacaaggagattggagcgcaccgttctcgtagacgaagccgtcgaggctggagcatcccgggccgccgttgagccagagcacgacggggtcggccgccgcgtcgcgctccgacgtcaccaggtagtagaacagccgcctcccgctcccctcgtccaccgtcacgtacctgcgacgaacaccacggcgcgtcgtcggtcagatgataagagaagagaagagcggcggcgcgcgacacgagacgcacccggagtagtgcttggaggggaaggcgccatggaagcccgggaggctggcgactaggtggccgtcgggggccgcgacggcgacggcgatggcgatggcgatggcggctgcggcggagagcagcagcagcggcggcggcgcggcggcggcggcggcggcggtgcgaggcatcggaaaggatgatgattaggcgaggcgacgatgggtccttgttttctctttgttggaggttggtggggggtgttaaaactggagtataaaacattggcgccagcgaacagtggagccgcacgtgtcaggtgagggggtggggcccactggagtatcccgctgacatcggcactgagtttgtctccaaataatgtggccggactagggatgaaaacgggttagaatcggtatattattttattatttttttcgaaaacgagcagaaacggtcggggaatttccatatttacgatgaattcatctatttagtgccaacttcgataccatgctgacagaaataaaaaaaacaaaattttgaaaacggtaacatcggtaaaaataatattattatattagttttgcgaaaacggtatcgatacggtcgggaaatttccatactgttttcacccctaggctggactggcaggcgccaccccgttttaacccctatatgcagtactgtcccctgagagcagctataataacaaattataagccagatataaacatatgtcgaggagataaaacagtagagacaagagttgcgtcgcagtgtggggctattaaattgattgttcatgatttggagctagtagttagctatactattaaactggctctgattttgagtagatgatacggagccatggaggtccacgcccaatgcaaagtctgtgtggctggctggttgtctggagctgtggtagagaggatttaatttcgacgagtaaattgtaagttgagctaattatttttatcgaagtttttatagtggagtatgatcactctctatttcatgtttttaattaaagttaggaatatttacctaccgtttgtattttggaccggttgtccgcatgtcagcaaggattagaaggaagaagcttgggagagatgggggctgagctcatcttttccggcacaggtaatgtgttgttcatgtcccgtttaatgccagtagatcaagcaaaggcattaagagaggagcaaggtagccccgatcgagctaaggagaagtagtagctgaaagtgtccttgtggagcaatggtagagcttaagctctaggtaaagggaagggccaaagccgatgttgatggtgtggtggtgatggggaatcagagttggatgcaaatccaccgctgtactgcacctgcagtacgtgtcactggcatgtgggtcccacctattccgggcccatatgtcattggcacttaccgcacatgcattacaggagaggatcccaactcatcagagttaggctgtcttggatactccaacaagagttagggtgtgcttagttcacgttaaaattggaagtttggttgaaattggaacgatgtgacggaaaagttggaagtttgtgtgtgtaggaaagttttgatgtgacggaaaagttggaagtgtgaagaaaaaatttagaactaaactcgggcttagatgaaattttggatactcgtggcacgtttttcaaactgctaaactatgccgtgcgaaaactttctatatgaaagttgctctaaaatatcatattaattcattttcaagtttgtaataattaaaactcaactcaattaaccacacgttattatcacatcgttttacgtgaaacacttaatttttatctttatcttcatcttcaggagattcaaacaccaccttagagaaaaataaacattggatagatggtttttcagacaaagacttcgattaaaaaaaatctggcctagccagcaatttacttaattttattttgatgaaaataatgttattattgattaacactggaatgttttttttttcggggaggaatgtatttttctatggctatgattttgttgctatcattatcttaaaaaaatgattttgttgctatacgagaaattaataataagaaaacacttttggagatcatgttaagtttaaccgtgctttacatttataatcggtgggggcaaggaggggtactgcagttaaggcttggcctttggatggatggattttgggtgccaaaaaaccatggaggggttgccgggttaggtgtgggtcaatgattgatctgatcggatcccatcccactaaaaaaattattttcatgtagcacgtgagaaataaattaagtgtacttaggtgcaccatttaattttaatatttaatagtaactccgttgttgacatcgtaaaatatttgcagtcgatcctcgtagttttaaaacttctgttgatgtaaaaataccaggatttaaaatgtgaaaaatcatattaagtagatttgccttaaaaaataactcttccatatgtttttataaaaataagctatgacaaatacataaaaacaacaatattttcttctataaaaataagaaaatgcagtgttagtatgtctaagattattttgtttttttatttaacaaatagcatccaattagtagagtctccagcaagacgatgctacttaggaggatgttatcaccggatccaagaagagatcatcgaagggttctcatcatggaaatagagactaaggtatgaaattaaaatacacagtttttgtgctttcccctctctttgttaaggaaacagatcccctgactttgtgtagtctacagttataccactgacatgtagaccctactttgatatggcccacatattagtggcacaactccaaactgcacaaagttagagaagtctcatccctttgttacattttctattttcctctgttccaatttcttttggggcacataatcatataatcctgttctcctttcagaacatacacattgctacagccatagccatcaccatcctgagattcatgatgaatgcaacaagatatatatgttcagaaatcacatgcaagaccaaatggcacagtgtcgttttccattgataaggtaccgtaagttggacggtttcttaaacattcttctggctcttttgtcaaaaaccacaataatatgataaaaagacttggacaaaaagtttaacaaagcctacagttccatagaaacttaatctgaaacagaaataatagaacaaaaatgatacttgacatataaatcttcgctattattatgaacaaaatgtaataataccacagcactagactgaatttctttagacttgcactaagctgatttgatactttacagaataactgaaacagaggtcctagaaccactaattgcagtgcagaataaaccaagcaaccactccccaacaagcaaagtaaactggctccgtcttcccatgcagaagaatcattgcaagtataataagctgcacaaatcttgggcaaaatggttatcctaatccatagacaagtacggattttatgctttcccttgcaacttaagtaggctatcgcagatttttcgagacaccatcaaggacaggccactcatcacctgttaccaatgcagtaacgagatcggtaagagccctagtgcttgatttgatggtcaagaaagattaccaccacccagttctatggcattggccaaatctttgattcctgaaccggggggtttatttctagcatctgtattcaagaacaggcagacaacagcgcagtcatcaatttttgatgtggggaaccgtgttctccatgcacgttgagccgattcaacaacaaatcgtgccgctgaggcttctgacttggcttggctgacaatgctaacaacttctgagttggaaagtacatcccacacctacagttaataaaagaaacaaaacaatcatatatcaaaaataatcttccaaccaaaagtaaaatttacttctgtgaacaagcaagatatatgttcaagtaaaatttgtgctcaatggctcaccccatcagttgccaacacaacaaattcatccttttcagtgatgcggtggtaggaaacatcaggcatagaaattagaccataatcctttagacaaaagtctccaaatgctcttgccatggccaaccctggcatgttgtacttcggaagccaaacacgagcaacatctggctcatctggcagagagaatattctgccacttcgttccctaattcgtgcagcttcacctgaaaacatgttttgcttcatttaggggagtaaaagcaggaaacaactatccgatgtgtacatttgtagtcatgcatgccatttagtaatgtagacacaaaatcttgatattacttatcaaacataaactatcattattattattattttaaaataattcacagaaacaagcctttacaacagatactgaagtgtgccaacaatctcagctatgcaggaaaaatatcggaattgatcatttcagaaaaaaagactaatgattttcattatatcaacaattatttgtagaaaactacaattattttttcgaagtcccaataatttcctttaaaaacgcttttcgatgatagttaccgaacgccggcaggcatggcaatgttatcagatccaaagcacccagtcacacctacttgaccttgggtcaccagtcagaccacattatattgaacaggaaaataccagcatgttgggtttgaacggtaaaaaaaacataactaaatcctatgcaggatgttaatagtttaaaa

SEQ ID NO: 16324 - DNA, 1529 bp, Oryza sativa
tgttagttgaagtttctttgtgtccatctcttcctaaatttgcactcaactttatagggaggagatctctgaccctcttggacaccaaatggccatatggtccatggccatcaaaaacaccacaaaaaattgtatcttcctttgaacagaaattctggaagtcaaacaaaaaacaccatcaaaatcaactttgcggtgcctaaaaatggaatggtagaacaggaaaactggaagtggataattcatatgattacagactattatcaggtaggaattgataaatttatgtaatttatagctgaaaggaatatcattcatggttttaatattacaaaggcttcatagaaaggaacatcagatggtgcattcccatggagatctccaaaaatttcaacaaaccagatcacaaaaaaattgtactttcaatttattatttggcttttatagtatttttttccatggttactagatgtaaatatggaaaaatcagaaaccattatcacaataaagaaattggtagggcagcaaatatgttgccattgcaaaagtacatgaaaggagctatcattctactagctggctcacaaaaacaatagttgtatgctacatggcatgccaggtggtacttcagcaaactgtggagacaataaggctcggtgggttcacatcctctacaataatggtactatcattataggcaccgacgtgtggtgcaatgggagggtaggatccacatactagtgactgtaatggtagtaacattatggtagaggatcctcacaacaaaaggataatactaggtgttatggggcagaacgataagcaaacattaattacacagcaaaaggatggcccaagagctaaactcaatgtgtaaacagataagaataagatcatccataaaaagaagaaaggataaggatgagaatcgtgtggagcacctcccctgctaacaaattttctacatagggagaataataattaggttgtattatattactatctgaaacagtctccaccagcaatatccaatggcaatccatatggagacagaacaaagtggtattctaatatcaagaagtaggggaatcaaacatgcattctacaccaagacgacacatgtatgtcctatgtcaaagttgaaaaaaaaatcaatctgtgtaggccagctcaagcatacacaagaacaacatatattaaaaaaaaatcgcagatatatcagacagttcggggctttcatgtaaacgttcaatcatcaatcaatcaatcacgaattaacacgtttctctttcgccgggggtacgaacaaatttcacatcacacatcatctcaaagaaagtaaaaaaaaaaattcacatcacagaaaacacatggaaaagaagttattggggattaatgggggatgaaagaaataaattggggattaatgggggatgaaagaaataattacctcccagacaagcatggcgtcctggttgacgcccttgttgccccgcatcgtgtaaagcgaggcggcagcggaggcgccg

SEQ ID NO: 16325 - DNA, 28172 bp, Oryza sativa
  unsure (1)..(28172): unsure at all n locations
cgcctcgcatggcctcactggagggcggtcctgcaacacggcgctgtgtgaccggctcggtcccgcgcatcattgccgcgcaaccgccctgctcctgcccatctgcgccgctagctgtgccttgattaattctagacctaattgaggccaaaattaacaatatgattaaccagctagcttgtactttctcttagaagaattaagttggcaatgatggatggatggagctgaggagatcaggatggaataattagtaagctaagctagtactccctccggttctataataagctttggacaaggttgatgtcaaacttatataactttgaccataaataactttaaaaatatttggtttaaagaaactagaacaatatatatagatttatctttcaaaacatatatagtaaaagttaacatgcatttattaattttatatattataatagaaaaataaggtcaaacatatattttgtagactgtgtcattgttcaaaacgtcaattaaaataaaaccggagggagtacctatatattgtggggtttggctagatcaactgcgtgcatgcgtgcttgagaggtgatgctttgcatggctcgcgtcgaccgcgacacgcgcacgcgcgggacgggacgggaagcatggtcccgcgccacggcgccacgcgacctgctcggtcccgcgtgcagccgccctctaccacgctaccgctctcctgggctgcgggagtgaggcggtgtcgcacagccatcctgcaggactgccggtcccatggaatggaagcgcggcaccgtttcggtcctgcgtccccatcgtgcggagaggtatatttgtgcaaatattttctatgcaggtatataaacgcaaaatattgaaaaaaaatgtatattttcaaatttaattttcacttttatatcttaggcatcaatttaatagtatggtgaaaatagatagagagtgaaggcaacgtccgaatacctcagtgaatgcttctttaataaagtactatgtcatctttgaacttagttcatcctcgtatattttcttttattttattccctcctcttcttgcctaccatagagcatcaatctattcaaaaccttcctgttacaaggggcgtgttttgtgagccacttttttcttcaaaacccatatccgttcatctggctataaagtctatcctggctttaaaaacaggtcatatggaaaaaaaactattagctgctagtgtgtatgcagagaaatattgatcaatttatattcgttatttcaaaattaaaattaaaaaacataattttcatagtgagcatcactaccggagaaatcatttttgttggttgcctaaaatacacaataatcccggttcattaaaaactggggataaaaatatttttagtcacagtttataagtgtaaggggactatgctatctttagtcctggttcaccttgtgttagaggctatcagatccccggagatctttactcctggttggtaacatcaaccgggactaaaatcctaactttagtcccggttgttgttcccaaccggaactaaacatcaatatacgtatataatcctttgctcttatccttaaaagttaatttccatctcttattcctcctcctctctctcacacactcttatcctcttcttatcttcctattcctccttctctctagtctctcacagtcttatcctctcggtagcgcctgatgaggacataactagctcggatataatcatgactaccttatatattaatcaaccaaaggtgtatatattctacattggatttacttgttatatatttgaataaacgttgctacacaatgagttttgtgtgttttcgtttgtagaggtacttgcttaggtgaaggaaaatatattaagcactcgaatttggggttccacaaaccgatctagcggcgaaactgtttttgacagattaatctaagcaaaacctgactctaaacgatgacggctactgaataaatatgattagggacgtcctagggttgccttagggcgcacacccccttgggctaagcccacgacactaaaagtacatttacccccctagtgggttttggtgattaatgacaaatgtggttaagggactaatgagttcattgagctactttcaggtgcattagtccaaagtgtggaagatggatgcttggagaccacccaaaagtataaaatcaaagcggaccagaacttgaggagtgcataggatagtttatttattgcaatcgagttttagaaaaaaccgtactattaagaggggttccaggtggtgctctgagatatgtcaagtactcttagtgtgaaccaagtgacaagtttccctaggagttatttttgcaaatactccgtctgtccaaaaatgcaactctggaacttcctgtctttcaggtccggaagttccggtctggtgaaaaagattttcctaactgttttccagaagttcctgtcttccaggtccggaacttcctgtctagtttcaagttcaaaattgtgagtaacggctagatgacgtcacctagccgttatatataaccagctcgtttgcagctcattctttggctattctactttcacttttcgaacctagagctgttgctagcctctcctaagtgtttattgccttctccactcaatcttgagcctaattcttgtgagaaagagagattgagagggagagaagaagatttggagaggtgtgaagactaggatattgggtgagcacttggaatatcttgtgggctgtcatctcggtgcttgttactcttggagatgatctcctagacggttaggtgtcgcccgcgagaatccgttatatattgtggatgtcccgagtaagtttgtgaaggatctcctctcctccgaaagagaacgaggtaagttaatgaagttcttgtgctgagattctagaggttttccaagtagagcaacccacacttgtggcgaatttctagaagtaggttgagttggatcttggtagtcactcaattctagaaatttgcctaggggtgtttggggttgaaggctgtggatttcctctggtgtttttgcataagtgaggcaaggggttaattgagacccagctctttggagctcctcaacggagagtaggatcgcaagatctgaacttcggtaaaaaatcgctcttgtctatttctgtgatgtttctgtggatgattttgtgatctatcttctgcttagaatacctgtgcatcatcttatgaagattggcttagtctcctgtttcgaaatttgaatttcttctttgttctgaacaccggaagttctgggcctggcagaccggaagctctggtgttccttaccaggaagttccgggtctgtttgaattttaccgctgcgatttgtttttatgttttcagggactgcctattcaccccccctctaggcttcatcagcacgtttagacacaattacaaggcctaaaacccaaatcagattcagaccagatgagatacatgacttgttttgtagtttcccggcagctcggtggaaattttgacatgggaccaaaaccatctgaaagtagattccataagcttttcaacaagtactcatgggccccgaaattccttctagatcagcggctatgtccatttgaagttgatgctgtcaggaggcccgaatccgaatccaaaacgtgtaaaacttgatctctcgtcttttatggaccaaaagtgacgtggtgaaatagaagtagacttggagaaggtcttggtttagtccccaatcaacttctttgatcatccatgcatgcgttacactcggtctcttttccttcgcccaagcaagtacctctgcaaacgaaaatacacaaaatttattgtgtaacaacgtttgttcaaatatataaaaaataaatctaatgtagaacatgtgcacattttctcctctttattcattgagtcgtacacagtgactctgcatgcgtccaagtcgaaagagaacaggacccagtggaatctggaatatgcgtgagatgagataaatatcagaatgtacatgttatatgtatgggaatgaaatttgttcgaacgacaataaaaactcactctgtgttgtacggcaatagtatgaacgtcttgaaatgctgctgcgttaggagatggacgagattgtcctctgtgtctttctcgtacttgtcgagcatttcggtgttgattttccgagggtcaatgaacccagtatcgtaaaccccccgccgtcgggccctttgaaaggaaattattattgcttacatatatgctaggagctaattattgaacgaaacaaatcgaactcaaagatacttacaaaatccatgcgctcagaagagagacgtcgagggcgtcccgatggtacagatcgaagacatccttgaaatggatccatagaacatcttctccttgcaagaagtcggggtttctgatcctcgctccgaacatctctctaccattggcgctcatttccatgtatcgttcatggaatttgtacatttgtgtcggtagggactgcagctgctcaggcctgacaagcagtttaccgagttcaaacttgtatgccacttccgccttcaggattggtgtgcctccaaccaactgagccacagttagaccggtgtccaaaatgaaatccattatgccaaagtcttcgccggtcaccaacggctcgaccacttggtttggttgttctccaagctgaggaactggtttagacttcttgtaataggctttcctaagtgttcggtcatagtccgatagctttaaggccttcttgtttgtggtggatattcccttgaagaaattcttcatgctcgggtcaataggtatcttcttttcaggagtccgaggcttgagttgcctcttcacttctcctgccacataagggtcaagctcctcttgactacaatcgtatggcggctccttgtttttggtggtgtcaactttggccttcttcgttgcccttgtgctggcaggaggtggagcttggtgagaccttgtcttgggaggtgcaggcggacacggtggaggtggaggtggaggaggcggaggaggcggaggagccggaggagatggtgcaggaggaggtggcggaggagccggaggagatggtgcaggaggacgtggcgaaggaactggaggagatggtgcaggaggagacggcggagccagaggagatggtgcacgagacgccgcttgtcgcccagggaggatgatgaaccggacgtggcttgtgtctcgtagatgcgtctcaccatctcctcctaagtagtccaactcgaggtcctcgtacacggcttccaccagctcaacttcgaccctcgagtatcctgctggaatcggcctacagtggtaagtccctgaaatgtccgttgggatgtcctttaccgatgccaccttcacgtgatgagaggttatctattagtaatcaacctaagcagcaacttgcggaacgtacaagtcaaaaatcatatattatatcgagcataccttgattgataagttcttgaagggaatatgcagctcacatggtgtccgttgcgtgatctcatcaatggggcaggtggtttcgtcctgggtttgcatgacgtccatgctatatgatcctacctaccccattgaggcgcagctgctacgattgcctgatgggctgaccattggaggaggtatgtacggctggggatcgtgtgaccgatatgctgccatgcgttcatccaccttccgggccacctcctcttgcatgctgagctcgtagctcgataccctgtactcaagatctgcaatcttcgcctcggtatctctcttgctcctcatctgactcttgtatgtgtggatgtcctccttgaatccaatctgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaaccacatttattgcggtttggtcgaacgtgtcacgctgcatgcagcgtagtgcagtgcgttcctttatccggtctgtgaccagtcacagaccggtcagatcacgggttaggtggcgactggcggtttgacgcacgccttgccccatcccgtcaagacgaaagcctctaggcacttgtctcaagccagagcaagcgtgtatctcttagagatggcacgttagccctggttagatttataccaggcttcatcccaaccattacaggcaagatgctacatgaagaagggcaaacatgcacgttggtaggctgacgcttggggggcaaaaatgaccgatttgtgaccggtctaacaccggtcatgttttcggcagacagccacgttcccacgacgcgcctgcctccggcagaagtggaggtaggtgtgtgccgtcccgtcaggaggatgttcggaggacaaccgtgcaaatctccgtccatttatgaagagaagaaaagtccagtttggaaagagaggggtgcatgtggtatccccttgaagtataaaaggaggaccctgcccatagggaagggggttgattttttccagattcagagcctagaacgagggaggggtcggctcacactttgtagctccttcatacacagatccaccaaaacacaggagtagggtattacgcttcccagcggcccgaacctgtatacatcgcccgtgtctcgcgtttcttcctagctggcgatctttccacataccgagagagcttgagatttcaccctaagcccccggccgaaccggcaaaggggggcctgcgcggtctcccggtgaggagccacgagctccgtcatctggcgcgccaggtagggggctcagcgtgtgttttctgagctctcgcacttttccgtgtgcgccaagtttttcttgttcagcctaatggccgggcaagcaaaggcgcacgacctctctccgagtgtgagcggcgacgacggggagccaaacccacgccgtcgagctcgtactccaccgcctcctccacaccaaagtcctaagcagggggaggccctcgagagggtcgacagatccgcggcttcaccgatcgcgggcgatggaggagaacggcgagatggggagcgtcgcctcctcgtctatggcgacggcagcacgccccagggcgcgcttcaggctgctggcgcgctcctacgtcacccgcccgtcgtccctgacccggagtctccagcccagcgatggctggacgacgtggccaacttggtcatgacggcacagcagcgcctgggtgctggtggacggtccgccaccaccaagacctccggcgccgccactaccggctccgtgtcgtcaagacggagggcgcggcgagcggcggctgttgcacgccattcggctgccactccctcgtcggcacctccgactcgggaggatcagcgtggagagccggatgcccgcctcgacatcgagcgccggcgtaatagccggcgtactccccgcgcaacggagggcgcctctttgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagtgtcaaccccaccgagtttctccaggtctatacgaccgggattgaggccgctgggggtgacgacagagtcatggcgaatttctttcccatggccctgaagggacaggcgcggggttggctaatgaacctgccacctgcgtcggtccactcttgggaggatttatgccaacagttcactatgaactttcaaggcacttatccgcgcccaggcgaagaagcggacttgcacgcggtacagcgaggggatgatgagtcacttcgctcgtacattcagcggttttgccaagtccgcaataccataccatgcatccctgcacacgcggtgatctacgcgttcagggggggtgtgcggcacaaccgcatgctcgaaaagatcgcttccaaagagccccagactaccgcggagctttttcagctcgcagaccgagtggctcgtaaggaggaagcatggacctggaacccctccggttccggagtggcagcttcggccgcccccggatccgccgctcagacagggcggcgtgacaggaggaggaagaagtggtcggtccattccggcgacgagggtcatgtcctcgccgtcgagggcgctccgcgggccacccgaaaggggaggcctgcgagcgacaaaaagaaagaggctggtactcccaccagggagcgcccagtcggcaagtggtgctccgtccacaacacctccctccacgatctcgcggactgtcgcacggtcaaaaacttggctgagcgaacgaggaagtgggaggaggacaggaggaaggaacgccgtgagggcaagtcgccggcaactccctccggtaaacggcgaagtgaggccaaacagaaggcccctgctgttgacatcgatgacggtgatgatgacctaggtttccaagaacctggggccaccattgccactgtcgatgggggagcgtgtgctcacgtctctcgccggagcctcaaggccatgaagcgagagcttctggccgcggcccctactcatgaggcgacgcgccgggcgcggtggtcggaggttgccctcactttcgaccagaccgaccacccaccgtgcgtcgcccggggagggcagattgcgatggtggtttcccccaccatctgcaacgtgaagttggggcgtgtcctcatagatgggggagcggccctcaacatcatttcccccgcggcttttgatgccatcaaggccccggggatggtgctccagccgtcccaaccgattatcggtgtgacgccggggcacacatggccgttgggtcacatcgacctaccggtcacctttggtggatcagccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctgaaagtcgcgctcgcttgcatggagcagcgcgcggaccacctcgctgctgcgtccaagcccgagggtggtgacgagaggcttggcacctccgcccccaccgccccgaggcagcggattgtcacatgcgccgaggtcccggtcaaggaggttgccctgggcgacggcccatccaagaccacacggatcggtggtcttctggatggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttccaaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaatagggcataatgttgaggcttatgtcgatgacttggttgtaaagacgcgcaaccaagagactttactcttagatctagaggaaacttttgaaaatctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccccagcaaacttagggatgtgcaatgcgtcaccggttgcattgccgccctaagtcgtttcatatcgaggctgggagagaaggcgctacccttatttaagctcctcaagcgctcggggccgtttacttggacggaggaagctgaacgtgccctcactcagttgaagacatatctcagctctcccccagttctagtcgccccggggccaaacgagcccctactactctacttagcggcgaccccccaagtagttagtgcagcgttggttgtggagcgcgatgaagacaatcctcatttcgcgcacccccgccctgtgctgacttggcccgggagcgagcagggaggagaagcccccgagtcgaacggtggcctaaggcccctgacgaccggagtcggccctctgcccgcttgtcagacggtgctgggtgcccccgaccctcaggaaggccccgaggccactgcgggaaggccgcacctatcgccctttggccccgaggctaaccctgtgctgactcgacccgggagaaagcagggagaagaggcccccgagccgaacggaggcctgaggcccctgacgaccggagtaggccctttgcccgcttgtccgacgacgccaggagcccccgacccccaggacggccccgaggccactgtgggaaggccgctcctgtcatcctccgaccccgaggtcatcggcacagaagacgagtgcgccccgagaggccacttggacgaagaacgccccggggatgcggcccctagcgaagaggatcggccccgccgaaaggtgcagcggcctgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtgtaccccggctccagagaccgtctcaatccccgaggccagcacggacccctctcagctgcctcacaccgcccactgggtgatgcagttcgacggttctctgtctctccagggcgccggtgcgggggtcacgttgacctctccgaacggagacgtcctcagatacttggtccgtctcgactttcgagcgactaataatatggcagagtacgagggactccttgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatggttgccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaagcatacctcacagataagactctacctgaggaccgtgaagggagtgaacgcgtccaacgcatttccaaacgctacgtgctggtagaagggaccctctatcggcgcgcggctaatggaatcctcctgaagtgcattcctcaggaacaaggcgttgagcttcttgccgatatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccatttgctgtctgggggctcgatatcctgggaccgtttaagcgggccccgggcgggtttgagtatctgtatgtcgcgatcgacaagttcactaagtggcccgaggcttatccggtcgtcaagatcgataagtactctgcacttaaattcattaagggcatcacggcccgttttggagtgcctaaccgtattattacggataatggcacccaattcactagtgaactcttcggcgactactgcgaagacatgggcatcaagctcttttcgcctcacctgcccaccccagaagcaatggccaagtggagcgcgccaatgcagaaatcctcaaaggccttaaaaccaagaccttcaatattctcaagaagcatggcgattcgtggatcgaggagttgccagcggtgctctgggcaaaccgaaccacaccaagccgagcaaccggggaaacgcctttcttcctcgtctacggcgcagaagcggttctcccatccgagctcaccctgaggtctcctcgggccaccatgtactgcgaagctgatcaagatcagcttcgcagagatgacctcgactacttggaagagcgaaggaggcgcgcggccctccgagccgcgcgctaccagcagagcctgcggcgctaccatcagcgccacgtccgggcccgatcactctgcgtcgacgacctcgtcttacgccgcgtccaaacgcgtgctggattgagcaagctctcaccaatgtgggagggtccgtatcgagtgatcggtgtcccccggccgggctccatacggctggccacgggcgacggcactgagctgcctaacccgtggaacatcgaacaccttcgtcgcttctacccctgaggggggggtcgagtgtcaggttttggctcgggccaaccccgcacccccctcgggtgtgcagggttggccgggggctaccacgcatgcacattcttatttctcttatttcagcatttcaataaaagcagtttcaatttcctaaaggttgtgtctgtgccgttttttccttttgtagaatcttgacttgaaataaggtcactcgtactcaaccttgccctcgggggctcggttcggtcagctaaaatcgccaaacggggcccagaaccgagccgtgccccggggcgtggtgaacttcgggggggaatcggcaaaaacccacaatcgggtcacccataaccctcggtcaccacgttcccggcctggccagcctcgacatgtggatctccccaggcactagccccgacccgagccattagaggactgggacttgggcacgagtccttaaatcaagctaagacacaaaagaggaccacggcacagatcatcctcatctcatacgcatagcaaaataaaattgacacgaattttttcatcatttttgattccagattaagttgatctatacaaaaaagaggcatgaaggccttggaagaaagaaaaaggaaaaactggagtcaggcgggggcctgggggctcagtccgatgcgcccgggtcgccggcctcgtcgtcacgatcgtctgcaccgctggcatcgccctcctcgtcggagttgggggcgaacgcgagccgaggggccgacccctcgaaactgtggacgatgtggtcggcggcatcccggacccgcgcacgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttgaagagcccaggccatcctcgtgaggtgcgaagcgaggccttccaggttggtggagtgcgtccttgtctggcctttccagaggcccgcttgccgtccggcgcgatccaggcgggagaccgcatcccaaagcatgccgggccctatttcgcccgccaagcggagggcctcggcttccccggcggatgagtctagcgcgcactgcatgtcggcgatggtgagttcggcagctgcgaggcgggcggctaagtcgctttcgcccgcagccgccccgccgatgcacgccctcgcgtccagctctttttcccgcgcctcgagatcggcagcccgctgctccagtgcggctctctcggcgcggacggattccaaattgcggcgggcctgctccgtcagcgctgcctcacggagggacagggagtccgccaaccgttgcgcttcggcctcggcctcttcgagagctcgctcccactcggcaagcgcgtcttcgcggaggcggagtgcggactcctcttcggcgcaggcagactcgtgcgccgccagcgttgcctcccgggaggtgacggcggcctcgcggtccgccaggactttctccgcgacgcagacgcgctcctccagcgccatggcgcgcgcctcgagggcctcttcacgccgctgggacgccgcttcaatctccgttgcctgccgctctcgggcagcggcggtgtcaaggaccccttgggcggcgtcgagctttttctttagctccgcctcccagctcccgtgttgaaggcggagggtgtcctgcgcctcgatcatcgcggtggtggcaatgagggcggcctcccgctcctcctccacctctcgggcgatctctgccagcgccgctttgcgggcttcaagctcagagacgtgacggcggtgagccttacggcccacctccaccatgacatccaccgagcgccgcccctcctcgacacgcgcccatgcggcctcgagctccgctcgttccgctcgcagggcctccacttgggcgctgaacccatctagcaccgcggtgtttgcggcggccaaggcctgcagaaggggctcggcgctcagcggggcgacagaagacgaggggaagagccgccttggagagaatgcgacgcggctcggcccgccggaggacgcgctgggctcggggatgtcccccagacccgtttggtcctgggcgtcgcctggggaagtgggcccaagcgacgcgccagcagcttcgtcgtgagctgcctcggaagacgccatcgcctcagcctgacgagcccgggcggcctcctccttagcagcttcttcggcttggcgagcccgggcggcctcctcccgagcggtatcctctgcatggcgagcccgagcggcctcccgggcggcctcttcagcttcccgaaggcgatctgcggcctctcgccggtcagattctcgcctccgttcctctgcggccgccggatcttcggcctcggactggccagacttgggatggcgggaggaacgtgacgggacatcgctgaagcaaaagaaaaaaccagaagacaaacaagatgggtaagagaaaacttgcttttgggtaaaagaaaggcggtcgcaaagagagtgggacgaacctgcgagggggtcggttaaatgaccaccttggaggggaaatcagatttccccgggatggttccgtctcccccatcttgcggggccgcttcttcttgcgctccccctcgggctgcgatgtcagcgcggccccctccgggcgccgactgctggcacgcaccgccccgccccctcggggaggagatgggggaggtgttcctcccagcttcctcttcccctgggcgtcggcagggcggctgctccccgagcccccgacgcggggcccagaagcacgaccccctcctggggtagattgttccccccggcggctctcgcccgcgccgtcgtggcccttaggagtttcctcctctgaggccccgacccccatcataatggtcagaatggaggcgcggtcgggatcgctgcagagggggaggattccttgaggaatgagagacgcctccacggagctgagattcagcaccctttggaccacgatcttgaagtcctcgggagcccaatcccatctgactccctggtgggtccgcatgtagtcttcggacccggtgtactcccaggtgccccgggcgcgccgttggagcggcgcaatccggcgacggaggtagtcgccgtacaccatggcccctgtgagcccctgggatcgcaggcccgccaggctgtcgaggacggcgtcatagtcatcccccagatctaccggcgcccgccagctggagacctgcgccgggggctgacttggaagtcggaggcgcgcttcgttggcgaggggggtgtagaaccagtcgctcttccagtcgtcccacttcttgcggagggcgcaggggatgtagcggttcaacaccggccccagcggctggaagtagcagccaccaaccaccgacggcggcgacaccgactgcacggtgaagaaccaccggaacagccgaagagatgggcgcaccccaatgaacatctcgcacaggtgcgcgaagatgaccaatgtcatcactgcattgggggtgaggtgcgccatctggagatcgtagaaatccagaacatccataaagaaagaagaaaatggcggaaccagccctgccattgcgaaggggaggaagaagacggaccgccccgggtagtctggtgccgggcgtccctcgcccagcatcactatctccctgccggtggcagattccggcataaagcggcgcggcagcccggcgtgcctctcgctcacgatgcgagaaggcggaagtacgcttccgtcgagcagagcggaaccccgtgccatggcgccggaggaagggatgattgagaacgagcgcgtgtggcgaaggaaaggcgcagcagagaaagagttagagctcaagcggcgaaggcaaggggaatagtggcgaaaggaagggagcaaatccgttcctcagtgtctttatacctttgccatcgctgtgcccggctcctcgtttctcgcgcccactatctcgctccctcgtttctcactatctcgctccctcgtttctcgtgcccacgcttccactaatcccattcgcccgcttgcggcgcatgaggtggatatgcggttgtggcagtcgagatagatcgtatcgtgcgcgcgttaattacgctcgccgaccgaagcaacgttaccatatctccaggcgaagcaaatcggtttacccagattcgtacgtcgctcaagtaatgtggcagtcttgaagagaccgcccattatggacagccaagtcaccattaccgatgtgcatgatttgagaccgttgggtttctgcccaaccatggagaccggtcccacctgtcaccaagctttaggagtggcgtcacgcccgaccgcttcccttgagaagggcgatcgccctggcataacgccgggggctactgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaaccacatttattgcggtttggtcgaacgtgtcacgctgcatgcagcgtagtgcagtgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacaggcaagatgctacatgaagaagggcaaacatgcacgttgctaggctgacgcgtggtgggcaagaatgaccgatttgtgaccggtctaacaccggtcatgtcgtcggcagacagccacgttcccacgacgcgcctgcctccggcagaagtggaggtaggtgtgtgccgtcccgtcaggaggatgttcggaggacaaccgtgcaaatctccgtccatttatgaagagaagaaaagtccagtttggaaagagaggggtgcatgtggtatccccttgaagtataaaaggaggaccctgcccatagggaagggggttgattttttccagattcagagcctagaacgagggaggggtcggctcacactttgtagctccttcatacacagatccaccaaaacacaggagtagggtattacgcttcccagcggcccgaacctgtatacatcgcccgtgtctcgcgtttcttcctagctggcgatctttccacataccgagagagcttgagatttcaccctaagcccccggccgaaccggcaaaggggggcctgcgcggtctcccggtgaggagccacgagctccgtcacaatcttctagggaatcacgcctttccctcgtgttcgtcctggatgctcgggagtctgtagggcgagtgacagctcgtccttctctctgtcgggtcggaacgtgccctgagaagaggcttccactgcgtctgttagtcgactggcagcctcgcgtatctgatcgctgaagaccagggagccatcaactgggttaagcgttctaccgtgagcatagtaccagaacttcgatcgatccggccatttagcggtggccggttcgatacccctctcaatcaagcctgcctccatctcctcccacttcggcattgcgacgctatagccgcctgaccccaagtgatgatggtacttcttcttggcagcgttttccttgtttttgaccatcatcgcttgcccttgttgccctgtcttgtaagcaacgaactcgtcccaatgatcccttagctttgggaatacgtcgaagttcggtgttagtcccttcaggatgtatttcttgtatagatctcccttgaaggtctgtgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcggatgcataattaatgcaagggaggtacaagggaataataatagggattaagttttgcagtaaacagcatttaaaagtcacttagttgcccaaagccattttgtaaagacgattctagagctacacagtattattaaacaaggccgtgaaccctcacgaacctgccttgacccaaggcctacgatgatttggaccgaactggcaacccgacctgggttccagctcgtcccaagccaacccaggccaaccattccacattttagttgctgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccaggattgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaccataatccaacaattccatagtgtccaaatgatatgagaattcccaaagtctaaagttataaaaccacctaatgttgcctaattaatcagcgaagcatctacctaaattcatactagtggaaccataaatagagtactcactagttggggttttgtttaacctagggtgaacaaagtaataataacaataacaataataataaggtcataacaaaggtaaataggtatggctagataaaacagtgataacgcgggaatttaaataaagcggtaatgcaataatttaaatcaacataattttacaaactgggattcaatatgatcaaggatgatgtgacttgccttgctcgctttcccaaacgacggcttcgacttccacgaagagcggatcttccgaagctgcagcgtctacacgaccaacggaaaagaaacggcttttactctaataacctccacataacagcaggaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaaactcatttattgcgtcagccgagggagagggcgcgcggaccgggtccacgggagtggggcccacgcgtcagcctctcggtccacggtggaccgggagcacgcggctggcggcggtcggcgccgtgggtcccacgcgtcagccgcacccgcgggcgcgggcggctgacggccgggcccacttggcagccgcgagggcgcgcccgaaggcggcctcgccggcacggccgacgggaggcggcacgaccgcgccccgatggtcaccgccggcgaccaccggcgcggcggagcggcgcccgagagagcggagaggagagggaagcgaaagggacggtccacggctcaccccgagacacgaggacggcggagacgacgaacggagcggaggaacgcggcggcgcggttcgggacggcgagggcgacggtgctccggcggtcggcgagcgaagcggaggggtggacggggtcggcggcgacgcggcgaagccgacggaggtggcgccgagtcgggaggaagcgcggagcgacgtcggcggcgaaccggagcctgtcggcgacggcggagagagaggaagacggcgcgagcacgaatccgacggggagagcgagcggcgagcggcggaaacggaagagcgaagcacggggagcaaatatatagcgccgagagggggagagcgcggccggagaggaaggaaaccggcgcggagatctcggccgccattgaagacgccggcgacgattgcgggatgaatccggacgaatccgagggagagagagaggggaaaacgggggaaacgggagagggaatcgcggggaataatttccccctctttaatgcgcgcggggacggcgggatgcggcggaatccgcggcggcggcggcgctagggcacgggcgggcggcggcgcggcgcgaggagggagatgacaggcgggacccacccgtcagcgagggcggcgggcgggcccgcccgtcagcggcgcgcgcgcggggagagagccgatgggccgcgggggaagagagagagagggagggaatgggccgagccggcccaagaaggaaaaaggggggaaaaagactttttagggatttttctttttataaaccttttcaactttgtttatttcttctcaattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagaagatgatttttatttcgggatgaatttatcaggacgtgacagtctggaactgttctgccattttcttaagagtccactgtttcactatgttctccgtacccgcagggagcgtgaacgtctcgagcattgtagtccacagcatctctttctctgattccgggacaaagctgtcatcatccccgcgtgcccttgttttgcgccagtacaccttgctgacaggcacgttatccctcacaacccaaccgatgtggtgtacaaaattcttggctgcttctgccggggcactaggtcggccgtcttcgtccacctcagttatgatgtgccgaccctttatcttcttcgtggcacctcgttgtccgcgtgccctcttctgtccagcggagggatgacttccactggcctcctcctcgttcccctccgcatccctctccacgttcccctccttgttcccctcctcgttcccctctgcatccctctccacgttccgctcctcgttcaagtactggtttggatcctcgttcccctcttcttcgttccagtattggctgcttccctctgcgattgtatcatacagtatctgttcctcatcgcgatcagccatctgttcatagaagaaatatttgctaagcgtaatattaaaactctactaattaatcttgtattaaaactcaaataatcatatatgctaagtctaagtgtcgtgtattagaaccctagataatcatatatgctaagtctaattaagtttcgaatattacatctctaataatcttatattaaatctctaacaatctctaacaatcaaatatgctaagtctaattaagttccgtatattaaacctctaataatcttatattaaatctctaacaatctctgacactcacatatgctaagtctaattaagttccgtatattaaacctctaacaatcttatattaaatctctaataatcttatattaaaattgtaataatcatatatgctaagtctaacagtcttatattaaatcgctactaatcttatattaaaattgtaataatcatatatgctaagtctaacaatcttatattcaaactctaataatcttagattaaaattgtaataatcatatatgctaagtctaacaatcttatattcaaactctaataatcttatatcaaaattgtaataatcatatatgctaagtctaacaatcttatattaaatctctaataatataataatcttatattaaaattctaataatctaataatcttatattaaaactctaataatcttatattaaatctctaacaatcacttctttacaacacttgcctgcgcgaattccttcgatggctagctaccacttcggcttgagggacgacaacgacgtcttctctacaacattactaggaaaatatattagtctaaacagggccaagttacatttattgtatttcacgttttaacctatatatataatcatatatgtatgctaagtttaataatcgtttaattatctcgttcgtacacgttttgctcgcgttcgttctcacacttttagtacaagtgcattcactttcgtaagcgtttcgttcacgttcgtttgcgttccttaatgtttcgttcacgttcgttcgcgttcgttaacgtttcgttcacgttcgttaacatttctttaacatttcgttcacgttcgttcgcgttcgttcacgttcgttaagcgtttgtttgcgttcgttcgcgtttgttcacgttcgttcacgttctttaagcattcgttcgcgtttgttcacgttcgttcacgttcgttcgcgttcgttaagtgttcgttcgcgttcgttcgcgttcggtcacgttcgttaagcgttcgttcgcgttcgttcacgttcgttaagcgttcgttcgcggcggcggcgtctcacggcggtgggggcgcggtccggtgccgagggccggcccggcggcgtgggggcgcagcggcagcgtggcggcggcggcggcgtctcgcggcggtggcatctcgcaacggtgggggcgcggtccggcggcgtgggggcccgcggcgtgggggcgcggcggcggcatgatctcgagacaggggcggcggcgtggcagtggcgtcagcgtcgccggcggtggcggccacgccgaagtcgttcgtcggcagtggcggttgaccgtggcgtggcgtagtggcgtcggcaacaagctatagctaggcacgcggcggcggtttggagagagagagagctacatcgagagagagagggtgggggctctcacccaagagaggcggcggcggcgtctgcggcggaggcggcgaggaccgccaggcaacggtgagagacgacgccggcgtcggcgcggggttgccctaagcagtggcggcgaaggagaagccgatgctcgatctcgatggaaaaacgtctaagtgttggtggagaagacgagggcgcaccgggaatatatataccccccagatctttacttccggttgatgagaacaaccttactcccggttcataacaacaactgggattagaaatctatctttaattccggttgttgttaccaaccgggagtaaagatatctttactcccggttgttctcaccaaccgggagtaaagatattttcccgctatttccaaattcttttttaaacccggttagggttaagaaccgggactaaagataatagcactgaatattgaatttcgttgaatatgtgtttctaaaatagtaaataatgcattaaaaattctaattaacatatgtaaatcccacatgcatgatttaaaacttttaaaaattctaataatcatatatcattagcatatgcatgatattaaattgttaaaaattctaattaacatatgtaaatcccacatgcataatttaaaattactaaaaattctaataatcatataaaattagcatatgcatgatattaaattgttaaaaattctaataaacatatgtaaatcccacatgcatgatttaaaacttttaaaaattctaataatcatatttatttagcatatgcatgatattaaattgttaaaaattctaattaacatatgtaaatcccacatgcatgatttaaaacttttaaaaattctaataattatatttatttatcatatgcaagaaattaaattgttaaagttctaataaacatatgtaaatcccacatgcttgatttaaaacttttaaaaattctaataatcgtatataattagcatatgcatgatattaaattgttaaaaattgtaattaacatatgtaaatcccacatgcatgatttaaaacttttaaaaattctaataatcatatataattagcatatgcattatattaaattgttaaaaattgtaattaacatatgtaaataccacatgcatgatttaaaacttttaaaaattctaataattatatgtacctagcatatgcatgatttaaatttgttaatcatcatatataactagcatattcaatacatccaaaatagtttacaacatttacggcaatacatcggcggtgacggttgtccgcacgtactttctcctcactattgttccttccttgtgatcgctacgtgagtaaggggtgtcttcatttgctaggaggatgctagggtcaatcgtcaccgtgaaagggcgttgcccatcaaactgatcgtaatcctcgtcagtcttgtcctctactccgacgatttttcttttgcctgggagaaccacgttgcgcatcggctcgtcaggccctttgcccttctttcctttgctagacatgtccttcacgttaaaaacttgcgttacatcattggcaaggacaaaaggttcgtccgagtatccaaccttgttaaggtcaaccgttgtcatcccactgtcatcaattataacacctccaccagtcaacctaacccattgacaccggaacagagggaccttgagaggtccatagtcaagttcccatatctcctcgatggcaccgtaatacgtgccagttgtaccatcgtgtcccatggcatcgatacgaacagcactgttctggttcgtgctcttcatgtcttgggctcttgtatagaatgtgtacccattgatctcatatccttggaatgttgcgatcgagccagatggacccctcgccaggaaggccagttgctggttaatcgtctcgttacccatgagatgttgtcacagccatgcggggaaagtatcaatgtgatgccgtgtaatccatgcatcggacttaccgatgtttctggtgcgaactagagccaagtgctccttgatgtaaggagccaccaatgaagattgttgtaaaaccgtgaaatgggctttacggaataaattgttgtctaccgtcattattgctttcctttcgagagtcccattccccgtagtctctcttcaaggggtaattcaggtaactcgaatgggcgaaagtcttcaataaattctacgcaaaattcaatgacctcctctgttccatacccccttagcgatgcttgcctctggacgagcacggttacaaacatactttttcagaacgcccatgtacctctcgaaaggaaacatgttgtgtaggaacacaggcccgagaaaaccgatctctttcactaggtgacaaagcagatgcgtcattatattgaaaaatgaaggtggaaatatcaactcaaacctgacaagacattgcccacatcattttgaagggcttctaacctatccggatcgatgaccttttgcgaaattgtgttcatgaaagaacatagctttgttattgttgcccggacattgtctgggaggataccccttattataactggtagcagctgtatcatcaacacgtgacagtcatgagactttaggtttgtgaacttcttctccttcatgcttattattcgctttatattcgtggagtatccagatggtaccttgatactctccaagcattgaaacatactttccttctctccttgtaagagtgtagctggctggactcaagtaatggctgcctttctcctttggttccgggtgaaggtcgccacgttgttctatatgaatcagatcattacgtgcttccagtgtatgtttcgactttccatatacacctaggaagccaagaaggtttacgcanaggttcttagtaaggtgcatcacgtcgattgcgtggcggacgtccaagaattcccaatagggtaactcccaaaatatggagttttttttttccacatcgccacgtgaccatcttcgcactctataggctggctaccaggcccctttccaaacactactttaagacctttcaccgtagcaaacactgttttcccgctacgatgttttggcttcgtacggtggtccgccgtatgttcaaagtgctttcctttcttccgtactggattgtttgctgcaaggaatcaacgatgacccatgtacacaaccttccgacagtgcttaagcgtactttctgtttcatccatacagtgagtgtaagccttgtaccccttgtttgactgcccggataggttgctaagtgcaggccaatcgttgatggttacgaacagcagcgctcgtaggttaaactcctcctgtttgtcctcgtcccacacggggacaccttcttcttccacaacagtttaagatcttcgaccagnntggttcttaaggaacacatcgatgggtcggttaccagagttgcttggggccttgaataataatcggcatcattatgtactccctcttcatgcatagccaagggggga

SEQ ID NO: 16326 - DNA, 6228 bp, Oryza sativa
ccttggcatcctgcaacatctgaccaagatcatccgcaacatcgttataatcagcatctctttcctcctcgcccgtttgatttccttcaaatccagcgtactgagcaaagtctggaatattgtcgtcttccacttcatcttcttccatttcaaccccttgctctccgtggaatgtccaacaattatagcttggcatgaaccccgactcaaacaagtggaaatgaatagtcctggatgcagaatactccttctgattcttacacttattgcatggacaacaaataaaaccattctacttgttagcttcggccactctcaaaaaataatgcacgccgtcaataaactctttggaccgccggtcagcgtacatccattgacgatccatctacatgaaatgaaaaaaaaatcgtacacaaataatcattcgtacaataataacagtcatacaataatgataaaataatcacaaactctttcaacagtcatacaataatgacatatcattattcatacaaaaattataaaatattccaccaaataattcttatttattattttttaagttttaaattcttttaattttcaatttagtttgttttcttttatttaagattaactttctctatattttcctactcaactattttataaaaccttatttagcaaataaacaaaatttctatatattctttcttttcccacacaaattttctctctcatcaacttacaacaaaattttggagataaaaaagtgtgcaaaacatagctccaaatgtaatatgaccaaaaaaacattggaggatgaagttgctaaccttttaggcacctccgatttgtatataatcaccaaagtaaattcactataaattttggcatgacctcccctcttttttgaagaaattttgaagaaattttgaagcttgctcgggctggaggaggaagaagacatatataaaggggtgggactttagtcccggttggtgttaccaaccggtactaaagatcaccgggatctttagtcccagttggcaacactaaccgggactaatgatcccgcggggcctgacatgcactgacagcatttgaaccgggactaaagattaaatatgcccgttatctttagtcccggtttttattgcgaccgggactattgtgaaattcggccgaccgacaaaagatggtttctccaccagtgaatgataaggtagaaggatttttttgtcctttccttaattcaatatttatccaacaggggatttgtttaaatgaggtaaaaatgatgacaaataatatgagccccctcgttgcaacgcatgggtatttagctagtagtttgatatacatacaaggttacctgttagagtgcgcagcctggcccaccaatcttgggccacccatgtgacattggacctgctccaccacagacccaatcaaagccacaactttaggttctggacctaagcaacctaaaaaactagtatgataggtgggtaccgcgtctctcaccttttaagtcgtgctccccatcatcaattaccgatgtgggactaaacccaacatcaccctcagcacagtctgacagggttgttgtgtcatcctgagctaaagccactttaattatgtacataatgttgaacgtacggaaatatagaaaaactgaattgatgtaggatgatccagaggcaaagacgataaaaaagttgcatttaattttttgcatgaacacaaacaactacggatagcaaagaaatttgtttaacatagtcaatatagtaaacagtgcactagtctcttgacagttcaggaggccagacgggcttattcattaataaattatgtaggacttattcattaataaattatgtgggagttacatgcatttggtttaaaaaaacacacaagcactaactaacatttatacttttccaaattgtgtcatcccattaaaacgtcgatcgctcctctgaagagattagctttcacaatattgccaaccttcggaagatctcttaataagaggctgcatgacagcaaaagctttcgcttttcctagatggagagagacaattttcaagacctcccagtccaaatgtatatgtagattatgtagaagcagactgcaatatgacaatatatataatgagtgaatcagaaatggcgatgttgtctgaattgtttctattttggtagcaagacacatgtatggtttatacttgtatgcacggctgtgtcttgtacacttcaaagtgaacatctcttaataactacctaccgtatgatcaattgggaagaagtactgtatggcttgcctcaaagtacaaatcatagcacatatggcatatcataacatgacctaaaaatctaccacccttgaagagttgtattcctccttatatatatagatatgcccttcatgaagagaggtaccaaaactaatcttagaggttggaatagggttgagaagttttttagagtcataggtaaatgtattatttcaatggtatatatatggaggcatatacctcatgactaacattgtgaggtatatatgcctctatatacctcccaagtcccatggaaaaaaaaagtccaaccttaccaattgtatactgttctttcaatcagttccaccgattttctttctttttccccttgaatagtgaggaggtacctttccaaggaggtaagagaaacctcaataattatatacctagtttttgtgcacacctgtttggatgcattatacatgtttaatgcgtgactcctttattcacatgaaggaagcacatcacatgtttttataattgttttataatgaagaaaagtgtagccttcgtacctcccaactattacaatgaactagctattttctgtcgctcaactacaacaatgggtcaaaacattaatactcatatctctaaacatgaaactcttcactgtatgaacagatgagttagcatgctgacaagacaatgcacaactattaacatctctcgtgtgcaggggagagagatagaaagagcaaaaccatagtagagagctcaagtgctcaacaaatgtgccaggcctcgtcaacatgttgagtcatgtatccatggctaaaagttcattcaaatgagtggaatgatggaatgtgtctggtatagagagaggaggaaaatttgaagtttagggacaaaatatttaactgttgccataggtgtggaatggaaatttttttaatatgtaataattagatgagactatggcttgggcatcttgtttatttcgaaaaagaaccaaatgttgtttcaccacttagtgaaacgcttcagagaaatggaatgtttaaaaactacaaactgcaacaccaacaaccgtgacatgaaacattgagcccagtgataaatccatggaaagaattcataaaatcgataagtaaagtcaaatatgagtggaaacatttgcatctgacacgtaaaatcgtttaaagttactaatgcagcacatgcatgaatgcagacagccactgcatgctcaaggagatagagagagtagacagactatccgtctaagagatgacgcatgcagctagagagagaaacgaggtgcgccggatgcagaaagtgcaagcgcaagatggaggcacaacctgttggctttatcagcagaccgataggaagcatttttaatgataatttcgtataaataaaccatctgactaaattctcccctcagttctattatatttcttgacgtgttggataataatacggtctcgagaacatatttttaactatatttttattatattatttaaatttattaatgcatgtttcaaaattaatctatgcataatgttgtagtttcttcaaactagatattttaaaagttacttcctccgttttacaatgtaatttattctagtatttctcacattcatattgatgttaatgaatctagatagatatatatgtctagattcattaacatcaatatgaatgtgggaaatgttagaatgacttacattgtgaaatgaatggagtattgatagttaaagttttaattgttgatctcaatcttatccaaaacatcaaggattacggaacgggaggaagtaccaacatgaaattgataccaggcacctaatttccataaaaaaaaattttgtgggggggtgaaatgtttaagttgtccacgggtgaaacattgaaaaaaaatagtgattgaaatactgaaagattatgtgaaacatatgttgaaacatttcagtatcgcgtatgaacatgaattttcatggttaaaacataagtttacatatctttcataagaatataattatgtgatatctttttttacatatttaataacaataaattcaagatataatcggattgtaaattgaatataaataatttaaaagaaaactcatgtcaagctattttaaaaacgtagaaaagacatcggaagggaggagaatgctagtgagtaggaagataggctactgcatgcacatatagcggccatgtagcttagacataggtaatatgatgccctatcttttctatttgattggacgtctaactgaaagctttgtcgattattttagcttttttataggtgatggaataaaacatctcgatttttgcttaatgagctatatccaattattacagaattcacacaaaagcaatcttacacagtgagtttagaagcgcaccaacaaaatattaagtaagcacaaactaatacacaccaacacaagataaagctcccacaactactgaattttatttgtgaacctctacctgaagttggcgaagagctgcatatcaattattttagttattgaaccgttgtaaatttggttttaactggatcgatgtccagatttattcactaaaatttctcgggtgaacgtggacattttgtcggaatgtcctaataatagtataggtatacgtgtagagatttgcttgcactttgtcggccataggtagggtgcacctccaccattttggtgcgtagaactgtaggctgtagctaccgcagcttccatcgggtgccaatggcgacgacgctggctagaccttgtccgcccgcagcaccaccatgggagctccggtgtagaacgggccgacgcccagctcagacctcaggtagcacctcgcgccggcgaccctcgcgccctcgccgttgagcgggaacacctgccaccaccgcgccaagacgccgtcgaggcacctgcggcacgacgccggcggcaggtccggcgagcactgcgccatggagtagatgttgcggaaccccgggtcgcgggcgtcgtcccccacgcgctgccccgtggcgaacagcctcgccgggttctcctccaccgcgtaccgcacggtggccgcgagcagctcggtcaccgcgcggtcgtacgccgccacgacgccggcgcctccggtgatgttggtgccgctgatgagcagcgtctcgccgccggcgttgtcggtggcggcgaggaagtcgcccttgttggagaatcgggcgtagcactggttgtacacgagggccacgtccttggcgcggccgtggcggccgccgcagacgcggccgacgtcggcgaggacgcgggtgccgcagtcgaagcagtcggagacgctgaggtcgccgcggcagaggaggaggccgtagacggcgtcgggcgcgccgccgcggatgcccgtggcgaagagcgccgacggcgaggcggcggcgcccgcgcggagcgcggcggcgaggtcacggaggttggactcgtaggcgctcccggccttgtacgtgccggcgctggtgtcgcacgtcggccacggctggccggcggcgagcggaggaagcagcagcgcggccgccgccgccgccgcgacgacggcgacggcgtggatgagcgtacagcgcggctgcatattggcgcggcgtcactcagtttaagttgggatcgatgcaaattaaagcaggtgaatatatatataggacgtagcctagcgtacgtagttttgggctgcactgcggcatcgatctcctacttttcgttttggatttgatcaagttccaaatcgatctcggcaacttgggcaacttgggcgtgcgataacgcaccaatctggctgaattcacagtgatagttaggtatttgtccacgcacacaccaacgcacacgttcattttgacgcttaattgtcagcacatgcgcgcgcgcgccgggggggggggggggggggggaa

SEQ ID NO: 16327 - DNA, 8940 bp, Oryza sativa
ggggggggggaagggtctccaatcaatcgctggcttggtccgcgcgtgccgctgcctttgctattctagaagccagcaactctggtttctggcagaagctgttcataaatcacaacgaaagatgataacaacgcaacaaaaaacgaccaagatacgtctcgaaacgtaagagagtaacggatctttgtttgaatgggtttatttattagatatttgttttaccctcttaggaatttttcaaacaatagaagggtacctcctcattgtaaagtaaccaaatcaaattatgcgatttttcttgtttcttaattaaccgactatagttacaatacatatagcctaaacttgtataaaatgtgaaacaacacagctttgtatagggttaataactagattttccatatctactataggaaaaaattaatatgatttataccgccctcaactatgaaaaaaaaaagacaacacacacctcatcggttaaatccggacatttaatcacatgcggacatttttaggtggttttgaatcaagttttcccacggcatactccaatgtggaaaacgagttgacgaatagattgccacgagcattttttcaacattatttattaatatctatgaaaaatttattcgcttgacgaatagattgccgcaagtatttttccaatacctttctgtcaatattgtgaatctgtgtgcttgtttgtttccacctcgttcacggaatctctagactagctatagtccctataatgcagcaggatccttaccttatcaacgtggcatatcatgaaagcaatagtaagttgcgttgtgtggtgagaaatccaactaaattatattatgcaaatgtgcaactcaataccaatacgtttgtataaatctgacaatgtacttagatctttttggtacatttttggatcaaattaagatttattagagatgggtatttctagctttacaaatcaatgaatctagatctacgattacgttgataacatttagataaatcatttaattcccgatttagataaaatttaaaactttgcaccgctataatttaacgtaaaaattttaaatttactgtgggtccaagatctaaaactatgcccaagtgacttagttagtatattaaatattgaatagtagattgaatggtgcaccatcgatccaatggttgcaggagtcggcggcacaatacctcgggctacagattgatctgtggttacaagagcgtgcagagatcggtctaggcaccaatagtataccatttgggaggttctgtgcatgcctgtcaggtgctcgctcgagatgtttttgtctgtatatctgtatggcttccagaatcaggcatagacatccatatttatatatccagtttcttccgtttaactgaagtgatgaaatttgtttatcagttttcccataaagaacacgttgtggtcggagacttggtatcctgatgatcaaccacaggcatgtaagaaattaaacatgcatgcacgatcagcctgcatcgatgcatcaaacatatggtaattggaaaaagtacgaattaccccctgatctattgcggtagtacgatttatcccccgaaactataataccggacatttaacaccccaaacacttaaaaccgaataaattacccccctaactcgatttgaagcggttttcagcctacgtggcacacacgtggcgatacagtcagcaaaaacaaataaaaacaggtggggcccaccttttagcgttttttttcactcctctctctcggttgacagatcttgcggctggcgggcggcgagcgggtgaggagccgacgccgatgggcggccagcggcggggatggccgcgggcggcggacgggtgatgagccgaggccagaggcaggcgggcacggaggccgacgccgactggcggccggcggaggggatggctgcgggcagcagacaggcgcggaggcggctgcaggcggcagacgggcacggaggtgactgcgagtggcgggtgggcgaggagcggacaccgactggcggccggcggcggggatggctacaggcggcgggcgaggatccgaggccggaggcgggcgggcgtagagaccgaggccggcgggcgggccaggaggcgaggctggcggtgggctgagcaagctacgccgatcctccatcccgcgagctaagcaggggggcgccgccgtcgtctgtccagctgtggtgactatggcgagcggcggcaactgcggcagggcgccaggcaaggctcttcccctctttctctctggcaccatcgggagagcggaccccaggccggcggcgggcgttgtggaggcggtgatggaacgcggcgtggcccacgacggcgactacggcaagtggcctcccccctctctctgtctctccgtagcgcagtcgggagagcggaccccgaggccggcggtgggcgtggagggggcgttcagggcgtgcggcgtggcccatgatgaagctcacgtgaaggaatcgaccgcggcagtcggcggaggtcctcccgcacctctctctcctcttcccctctctcggcgagcacggcaccccggcggtgcccgaggacgacctcggctcggcggggaaggttgtctcgtcagtcgtcgtccgctgctgttgcccctacaagctcgcgccaccccctccctcgccgtcgctccccgtctctccctcccctcaccgccacccgcactccaccgccgttgctgccttctctgcctgggccaccaccaccaccacactgcagccatccacctcctgcaaaagctccatctcgcgcgactcacgcgtcgccgccacggacgcggtcgccgacaccgtgcttcgcgttcgccatcgccgctcgccctcccggcacgcccgtcgtgccccctagctgatgagagagagaagagagagaggggtgaggtaggagtacatgacaagtgggcccacagctttttaatattttatttattggattgccacgtggcgccatgtatgtgccacgtaggagcaaaaccactctgggttgagccaagggggtaatttgtccggttttgagattcgggggggggggtaattcgtaccttttcctatggtctctaaatgtctctgtattcatctggaaaagtaaccacatgatagaaaaggaggcaagacgcttgagcgaactgtatgcagcacgaacgctgccatgaatcagaggtgtcgagtcgaaaatagccgtgtgcaacaaaagaaaactagcagagcaaagctcctctggtcttgtgcgattcggactgtcactgccacgaaaatcattgaagactttcttcgatgccctgtaaaagccctcttacacacggctaaatgacgtttcaagagacagttcgctaaatgacatctaacaaaaggcctatggaaataatatatttgtgtagaatagtaaacggagaaaaatactacgaaatattacacatgtacgtattaagctcagggaccgatatatacaaaatatacgtggtagagataagaaaagattacatataagaaaaaaattacacaaatcaatactatcctaatacatttctaagtaccatatatatgtactctaacaatttgtacacaggtagtcatcatgccatatgaggaaatcatgccctgtctacatgattgagctgatgttgcaaattaaatcctgcatatctacaaaacctatgtctctttcatttgtagatggagaaacttgtgatttcaaacaaaagaaaccgcggagaatgaagtgttcaatcgatcaattgtcccatattcctaatgtgctataagaaaaaaaaaggaatacattcagtccctcgatgaaccagaatccttcatagtggaaaagcatcaatggcttccgatggacacatcaaagcacatgccagcaaataactagaacctagtttctcgagcctctcttgcttcctcgtgctacattgaggccgtgtttagatagggccaaagtgccaaaaaactcggtacaaggggtgcagtctggactttagaactaaacgggtagtcacctgaaattcggccatattgcacatttaaggcccaacagtagcctagggttagggtggcccattatacccctgggaggcgccgaacccgccgatcctatccattccccatcgcctcttcacacgcgctaaccctaaggttcttctcccctgcgtccactctctctcgaactcatcggcgtcgcatctgtcctccccgccgctgtaatccaaccctaccctgggtgaatcgaagggttcctcgtccagatccatcacatccgtggcggtgcgtgcagcggaatcgacgggagcgtgcaatggatttgtacgagggcgacagcaacaacgggggcgactacggcgacagccatgatggcggcgggtacggcaacggcgacagcggccacggctacggagacgccaatgacggcaacaaccttggcggatacggcggcgggagcaccatcctcctttacggggccgagcatcgattcggcgccagcatccctacgcacgacttcctcgcgcagcctctccatctctcccgtgatggcggccgcacgtcctacaactcgagtggctttggcgagggttcttccagcagccagaaccctcccggttcaacttcggggctctcgacctcaactacggcgacaagtggtcgaccatgcacggctaccaagaccttcttcgcagtggcgaaggggatggcagtcaatgccctcctagcgtaggcgtccctccccgtaccgtgcatcgcacgctcgggttgaggggccggccaagtgctcaaggagcttccggatctgggccgcgacggggcggtcggatgtcggcggcaggagttgacgggccgcatgcgattggagctgggttccaagcgccaatggcaccgccatttggaggttcaggccatggaggcgtattcgtgcctcccatccagcctcaagctcgagccgcatctcagggtcgaggccgaggtaggggtcgcggtgcacggtgccggctgacagaggtaaggacgtttttaggtgttgcaatgtgtggattcccatttcatttgaggttaacaagtggttcatctgattagttgctacgtactacagttgttgtaacttgtcaagtacagctagtacaatacttgcgaaatgtattacagctacagttagttcgtatggttaatttctatgtattactgcttacagctcttatgttagttggttagtaatacagctattacaaaaattgtggtacaattttgtgcaataacatgacatagtgagcgccgagttcattgtgataacggtgtttaattccgattgattgatatgtcgcaaggtcattgctttcccggtttacttgtccctctaggatttcaacgacagggcatcgtggacaaatgagaacaccaaacttttttgcgagctgtattgcaagcaaatagataatggcaactgcataaggggaagaatgagtaaagcaggttggaaggagatcagaaagggtttttatgccaccactgatttggtccacgacaatgagcaattcggatttagatacaggggtttgaaaaatatgtggaccttcatattgaggttgcgtacagacactggtttgggccgaagacctgacggcaccatggttgcttcagacaagtggtgggatgacaacactaaggtacaaaaacttcactttttcgttgcgcagttttacacatgatcattcctatgcatctgaccgatgcattcattttgtgcaggaccaccctgaatttaggaagttgaagaatgggatgcccgactatctcgaagaaatggaccgcatattcatgggggtggctgtcaacggatcgacttcatttgttcctacatagcccgcaacccagccggccaaccccattgtggatgtggaggacagcgaggatgacgaagaatccgacgatgacgacttcgaccccctaagccccatcagtgttgggacgaagaggtcgcacagcatgaggagcacaccaagcacgcagagtagggctactagtccaagcaagaagttgaagagcccagccgtccgcgccgtggtgaacgaattgaaggtgcacacgagctgcagaaggagaaagcgatagcaatggacagctattcggcacagcgtgagaagaggagggatgatgatgactctcgcgcgggggaaaaggctgagcgcatcatggcactcagtagggagtgctgggtcacagaggcgactccacacttgtgggttgccatgttcaagatgctcaaggatcgagatgccgtcaatgtctttgagctgtccaatcctgaaggaagaaaggccctccttgagcacctcgcacgggtcgacaactagaccttttaatgcttgcttaacatgttaatgtatcagccttagttatatcttttgggttatgtacgctttggaagctatgaggtgctatgtctgttagtgctgctatgtctgttagctatgtcatttatggtatgttggctactgttgtgttgcaaactatgtcatgcgtaatgttggcaattaaatataagttgtagtaaggctgtctttccaaattcatttcttaatatgaggatgtttgaaagttaccgttgttattttacttttattacaggaggatgtgcggctccaacctgtggatacaaaggatgaagattccgacaaagagttcggcagagttatgatggagtactttatggacgattatgcatccaccgcgtttctgtacggtacgttacatcttgcaaaacacattgacaagtactacaaccagtcagaatatagagatgttagcacaacaatgagtgcgttggaatgggtagagaagaagcatgcagacaggaagcggtgttacaacatgtttagaatgacctctgatatgttctatagtcttcatgatctattggtcgacaaatttgagctcaagtctagcatgaaatctaaaagtattgaggcgttaggattgtttctttggatggctggggctccacagtcggttaggcaagttgaggacagatttgagcgatcattagcaacagttcacaatatgttccacaaagttctggcaagccttttgaagctagctgctgatataattaaaccacgtgacccacagtttgcaacattgcattcgagactgaggtaccttaggttctatccttatttcaacgactgtattggggcgatagatggaacccacattcctatgcaggtttccaaagatcatttggttcagcacatatgtcgacaccacattacaacgcagaatgtcatggcatgttgtgactttgacatgatatttacattcgtgcttgctggatggccgggttttgtgcatgacatgagggtgttcaacgatgcaatgagtacatacaatcatgttttccctcatccacctccaggtacactgctacctattctatgtttgcaatttctaacctccatcacgtgtaacgtacaggtgtttaccgctgcagggaagtactatctagtggactcgggctatgcaaaccggattgggtacttggagctgtacaagggcacgaagtaccataacacagcctgatagcaacagcagcaggggagctgcacttgtccttacgactgctgcctccataatagctgagccaaaggtggctttcgggaggaacccctcctccccggcacgcgaaacgaagcatgtattattgtatgattaattaagtattagctatttttttaaaaaaatggattaatttgattttttaagcaactttcatatagaaacattttacaaaaaaaacacaccgtttagcagtttgaaaagcgtgcgcgcggaaaacgagggagaggggttgggaacttgaaggtaagaacacaaccaaaggataacatatgtatatccagggttcctcatgtctcccagtcctagagagagtacatatatataatactacctccctttcagattataacactttctagtatagcccacatttatatagatgttaatgaatataggcacacatatatgtctagattcattaacatatatatgaatgtgggcaatgctagaaagtcttataatataaaacggaggaagtagtaaggatgagaaaactgcaatgtatgaatagatcatatatataggctgtataagtggaagaaaatataagcatatgtgggcttaattgattttaacatataaatgttgatatcaaacatgtaaactagcaaaaccatctcatgcacataacctagagataaaatcgcacatgaataaatcaaatgtacggaatataattaagggtgccgctttgaccacgcatgctacaaaatgttgacgatgacttgtcacaaccgagaaatgatgaaggcatgtcaccgtgaatatacagcgggaagccacacgtagcacttcccaaacaccttattcgcttgcagtgatgactatacacaactactttctttacaccgaagaagagttcgacctaatgttttacgtctgtcttagtagattttatcgtttgttttagtggatccctatttaacattaaaagtatattaattttttcccaatatccttttcctagtgcaggactttgaagtagagagtttaagagaaatgctctcccaatcgtcggtgtttgccggtgagtgggatctcgtagattgtgtattgcacatgagtgtgggatggagtagatcgattacagacaatggtgcaatatagaagtgaggcaaattaaacccaatattatttatggtgtgtgttttatgaaggtggcgtctcggtattattaagatatgactagaacgtctgcccaatcttcacagctcgaaatcgaaccaaataaatcgtgctagactgatatggatttttacatcacaccagcacaagaaaag

SEQ ID NO: 16328 - DNA, 31845 bp, Oryza sativa
agatagatagatagatagacttccaacttttccatcacatcaaaacttttctacaaacataaactttcaactttttccttcaaacttttaattttaatcaaacttctaattttagtgtggaactaaacacacccttatatcttccggtcgtcgactcctcgtccatagatactaccacatagcccagaggcactatgaccgatcaataatcacacatataccagccaataaagttaggcgttcgcgtgactctgaccttcttaatatggtatgaaaatttataaagttttcaccataacaaaataagtataaataatcatcttcactactacttgaaccaccgccttctcaaccatctctagtgttgtgtgaccatcttatctggacttgagatgtaacacagattaataaccttacattgcaatagcggtggtttagagtactgatagggtgattttccacgactttctaagattatataaaactcatgtatatgtggtatggtaatatcattgtcctatttccgcactggatttaatttaaaaatatcatttttttctcctcgttatagtactaattagaacttctttcaagtatattattcttattgcgtaagtcatgataatataagctaggtgtattttaaacatactccctccgtttcataatgtaagactttctaccattgtccacatatatagatgttaatgaatctagaaacatacatatatctagattcattaatatctaaataaatgtggacaatgctaaaaagtcttacattgtgaaacggaggaagtagtaatttctcaagtctcatctatagataaataagacaccttaaaatatgttttacaatgcaaccatttcaaagtagtgacctactactctgtcaaaaaaaaaaaaccgaattcctagctacaaatctggacacacgcaaattaattaaggattggtctttttttttttgacagaatggtaccaaattaattaagggcttatatataaaacaaattcaaattgtaaaactgtcatcatgcgtctgcctcttccttcaactaacctatgtctgttgctagtttatctcgtgtagaccctagaagtaccatgaagatatgctagcacctttttttttattttgctttatgtctttatcaaacggtatgttttgtttcatcgtagaatccgacggctaataatatttacttttcagtacttcagatatctggtcaattaattgtctattacacacatcgcatacgtatgatttgataatttgcttcgagatacctggattgaaagcaatgtttttaatgaaaatagcagatgcagcgacgatcagcacgtgcctccaagtcatacactgtgaccagatgtcaaactcgaagtttacaaccaaattaaaatgccaagcatacatatgtttttgttaacgagtttacaaccaaattaaaatcaagtccaagtccagccggtaacatggtactaccatactcttaaaaaaatagcatgcatggtaattaagtccatcacatcttaaatctttgaaaagataatcacaaaacatcatccaatagataatagatgttgcatcaataagaaaacaaaacagataataaatcccagtcattggaaaaaagagggtgttcttgagtttttcagtgtctccttcatatgtgggagagagatatagagtaaagaagacacccatcagaaataaagaaaaaaataaatgtttgtatgattgagagagatgataaaaacatttctttcttaaaaaaacataaattttatatatttttcactaacattcttcagtgacataataccagtaatagattattcttaaacataaaaaaaggataatgatagtcatgcgaatgcacgacgtcttgcactagtatatatggtcaataatttcagtaaatcgaaatgtgaacaggagcgattcaagtccttggttattgttgtagggctgcacaagcagctataggctatagctgccccggcgtgaatggaacactctggcaatattactgggtgcttgaataggctgttgatcgaccttcccgtctatctcactgggtgctaatgcaggcctgcagggtacttattttttacaaaatttattcccttggcgaaggtggatgttcctgatgcctaccaagcttaaaatgctgcccagtccaaaaggaaaagcaaatatgacagtggcaatgttcatagtagttaacccttgtctggttgttatatatttatcctttccaccaatttttggtcataaattagaggtgcaatgccatccctgtgtgttttttaatgagacctttcacagtccttgaagggaggcggtaccatatttgaccgttgatctggcgcgatctaacagatgatattgcttggtaccacgtcctcacatgtggaggtaccgattgagcatgtggtagtgggaggggtagaattgtactttcgaatcaatcctttctcccgatccaagcattcagcgaactctcttcgtccctccatctccacattcgaacgtcgtgccccccttccgtcttgcgctcgaacttggatggccgctgtctcctccactcccgcttgaatgccgaaactgccggccaccatcatctccgctcttcctcatcctttgatgctctccccctacggccctgccccatgtggatgtcgttgggccagatccaaccgctgaggttggggtgccagatttggttaaggatgcgcttccgcgagcttgcaaagacgctgattggagacctcttgccaccctctcggcgctagtacgtcagagggggagaccatgtggatatggttggtcgacagtgacggagatctctcagatggcggagatcagcgaatatattacaaatgattttctgtttatttcgcacgtcttggatgtggttggtcgatagcgtcggagatctctcagacggcggaggtcagcaaacatattgcaaatgattttctgtttatttcgcacacaaggcgttcggcggaaaacaaaatgctggcctcccaaattatagattataaatggaaagcgtccttccctgcaacgctccggcgctctctacttgtattattatactacaagtagaattcttgctctttcttcctcttcctaccgttctgccacttgaatctccggcgggagctgccgtgaactccggtgtgttctgctggtgtccctcccgaacctgagcaccacctctgccacagcaactgcaccgtctaagcatgcctccataaccccatttcctcatcctagtaggggcgatgcaaaagatgcagcatcgggtacaaagacgaagagagatagaaaccatgcaattagaacgttattatatgcatgtagtacagaagttgtcatctcataattaactctctgccccattgtaatacacacctagcaaaagtgaagggaaaaagagtgtattagtgtgtttctttaaataggagagtgtgttttttttatctcctgttagttttatctttttgtccttttacctttactgcaggattcttaacctgtaacattattgtagtacataaggagaaacatatttgccaaccactattttagggactctcgtaattatatatatgatgttatttttagtgtgaaagcctcctaaatatttggaaatgactaaatggggacgttttatattgtacttgagcaagacagctcgcaaatggattaagccccttctgtaattcatcagttaatgtgatgcatgattgctgattctgaacaaagacagtgtcaatgaaaacaattgaagtgttagcaattggtaacttgtgaggaattaatctgaatcgtcaaaaaactatgccaagatggtccctaagctttacagccttacgaaagcgattactctggaacggtttcagagagaaactatgatggagatcgacaatttctttggtcaaattaagattccaataaaatatcaaactaagaataggcttccatggcgcaaatataatatatataaacatcgtaaaaggatgcacaaccttcccagcatataatctctaataccgatttttgggtccagactcttgttttccattgggccacgtggcgccctacaaatttggttagggctcactgaaaaactgccacgtgtgatgcgtgaagtatccggactgaaagagatcgggaaaaaaaaacgtaaacatttgcctgcgtgtgtgtgcggggtgggctttgcatctagctaggctgtgcaaccttgggcctgggcctgtccctggcgccccacggcctttctgtaatatgtaatatgtaccgcagtccgcagtactggtgaatggcctcttcacgcagcgctaagcacgttcgttcaaaagaaaagggaagaaaaacagcgtgaagaactgaagtgtacagagccagtatagaacaaaataatagtaataaaaagaaaaggagaaaaaaaagaaaataataggattatgcaatcaactacaattactcggaatgaggaaaagtcacttcatgttagcatcatgtgtttctagaaaattagaaaaaaatagtgaaattaaatggaaaaaaaatatagcagcaataaggattgcgttaggacaatctaaagtctctagataaatacaatctagaatgtttacttcaaacaaggaaaattaatacctaaatttctatagaatggaaagaataaaaagtgaaattagatgaacagatatgtattctctgttaaccgacaagttcagcactactttcctattaattcggagcattttgtttttcttttataatcctcacattatactttttctagatactaggaatccatttattttggaacatgggtaagtaaagacaataattttgctatattttttgtttgtgaaactcaatatagttatagatgcttatatgtacgcgcgtatattactcactcctataaatatacacacgggcaccttttaggactgggccgttaggcatatatttgaactgattgataggttgcctatcattgaaacaacaaatagtcgtaaaatgtaagaactcgtactaagtctatgacctaaacctgtataggcacggaacctaaccagctgagctgcattagaataagtctatgacctaaacctgtataggcatggaacctaaccagctgagctgcattagaataactggatatatgaaatcaagataagtatgtttactatgtcgatgtcccttgctctaaataaaaccagcataaacaaaaaggtaacataagacacatttattttagatatgtatttcggacttattatacaaagagcaatgctacatgtactaaatttttttcttgctaaacttttactaacaatcatttcaaccgtttgatttaagtacatgcacaaccttcccagcatatatactaccctagttcattgctccaaacaggcacagatatagtacaatatatacatacatgtatattaattttgagtagtcgtaatgacctgcgtagcaccccaacatattgagttcaaatctacgtaggagtgaattttagattgggttatttgaagtagtaagttctaacttaaatggctgcatatggctgtatatatccggttacatgtatatgctgggtaaaaaaatactcttccgaaaatataaattcatcagttcttacttcgagtatgtacactgaatcatgtcaattaatttgaggtctatctttgttgtaaaaagcaactatgcagcgcagcaacaaaatgtgcaactagctagtacacggcagagttgcacaaagcagctggagtagactgcgacttctttcccgccggtgccgttggagctttaaatttcgaaattctttcccgggggaccgaaattaccaaaattttggaaatgttgaattttttttagctgaaattatttgaaattttctgtcttaatgaattttaattaaatttgaccaaaatcagaaaaatttacaaaaaaaaaaaaaccgaaaatttcgggcgagatgtgagctttccggtaggggacaaaattaccgaaatttcaaaacgaaattgcaaaccctgcccttaagtcgacattctcattggcggagtggtgaaaccacggaactttgtaaactatcagaagaaaactgacagatttcgtggcgtcactgcagcacaacaattcctgggacctcccagtccaaacatagatatatagaatgtatggtaggatggatgcaatgaccgagtgaatcataagtggaaatgcttcacttccaacaaatatatactccctccgtttcaaaatatttgacactgttaactttttagcatatatttgaccgttcgttttatttaaaaaaaattgtgaaatatataaaactatatgtgtacatgaaaatatatttaacaatgaattaaatgatataaaaagaataaataattatttaaattttttgaataagacaaatcgttaaatacgtactcaaaagttaactttgtcaaacattttgaaacggactgagtagaagctagcaacatgcatagcatatctcagccattaataatctctggctgccttaaaactatagccaattcttttcgtagctagaaaccatccacttaaaacgtactagagtacacatgtggtaacacaagttgttgtcttataactttttgccccattgaagcacacttgtgataaaatgaagggaaaagagtgtatcagtgttgtttaattagagaagtgtgtgtttgtttatctgcctcttaattagttttcccagggaaaatcattacaatgcaagcagcaaaaaaatcacgtcatgcaggggagggcccacgattttgaggttgcgtataagcgtactcaaagtagaaaggggtaaaagaaatttatctttgacagtttgtatgttgtttcacgaatcacagaattaggccataaaagttgtgtgaattggaccctcataggagaggaagccaagcctagaaagacaggtttatttactaattatatatatttttaacttttttataaacatacatataacaaaaaaaattgggtctccatttgaatacccgtgaatctaattgggccgctctgagcaccgtgaatggaattactaaacaaaatggaattaataaggctgcgttcttttgcaatggttcccaactccatcctcttttccgcgtgcacgcttttcaattatatggtttgttttctacaaaaaaaattctattggaaagttgcttttaaaaatcatattaattcacttttcaagttagttttagctaatacttaattttttttacggttaaacagcaggagaggctcctactacgctatattaaaaaaggggggaaattatgtacaagagctaatacttaattaatcatgtgctaatgtgcttttccattttctatgctggaagggaaggttcccaatcagcacaaacgaacacaacctaaatggctgttgattgagaattgtgggatttgtgtcacaatcaaaccttgggatttgtgtcacaatttgtgctccgacaatcccaactcgttctcctctagctctagagaatcttcggcacccggcgccggcatgttgagttagggtttaggatcccgggttggggtggaggtaggaatggaggcaagggagagggaagaggcttagagggatggttgtgagaggcagcgttcctataggcggtgagcagctagagccatggggatggagcaaggcgactggccagcaatggtgcgtggcggggaaaaaccagagctttgtggttaggacataggaaagatggtgggatgtgccgtagagcaaaaaagggaactggtgattgatccgggcgacccttggttccaaatatataatgtgtattttctctaaaacataagggaacaagggtaggatggctagagctaaccactctcaacgcatagatcccggtttgagtccccatgccacaagccttttctatgatttttgtaaaccaaaatcagtagtacggggctaaaggcaatggaatgggccttaatttggcccatttatctcctctgcctggttcgaccaaaggggtttaatgcccggtccgaccaaggtgttttaatgccgggtccgaccaagacggtttaatgctccgtttagtctaaaccttattgcacggtttagtctaaactcggctggttcaatctgggtcgaatgcatgtctgatctttaagcgtaaccgaactatggaaacttctggttccgtacttttccaatcgaactgacgacccggtctgtttttttcaactatgggacaggggcactcaccatcgctggataagaaaagagaaaggggaggggagggggggactatgggatggggacacttgccgctgctggatagggaaagagaagggggagtgggagcgaggccggtcaggataggtagcccggtccggttttttccactatcagacgggggcacttgctgccgttggatagggaaagagaagggggaggggagggaggccggtcaggagggcctcctcatcagcttccaacgagacaacgaggttgggcggcaccgctggagatgctcgccttccgtcgccgtcgccgccacacacagctgctggagccgccgcgtgccgccgcccgaggaccagaactgccaccggagccaccgccggaacaactgccgccatccagggagggaggaggagagggtgctgtctggtggatctggagggaggaggaggaacgagaggataaggatgggtagatggataaggagtgatgggtggcgattttttaatgggctatgatatttttaagtgcgcatgatttttttgacgggctctacggtaggttaagaggcctgccagctaaattaggcttatttttgcaagcggattttttaacctaccaccagcaaaaacggattttcgctggcggttctaaactcaccgccagcggaaaaaaatagggtaccgtcatgaaaaatcatttttcttgtagtgatgtaatttaatcaaacttagaagtatatgtatatatgataaatgtaacttacatatataataaaagtaatttacaacatatatatttcttttcatcagaatatattcatgtaagatcttgttataaagatttaattacaaagaataaaatggggtaatcggactgtagatgggatatgtaatttgaaagaaaaagtatatttgaagtttaactattaaactatatttccttgctgtcgcatgcttgtatacttaccacataggaagagatactagttatgaaaatagttgggtctctggtttaggctatcaagagaccaaaagcagtacagttgccacccgaaactgctaatgtacgggtgatcacccgcactcccctccccctgtactcctccctcttccccccttcctcctcccctttctctttcaactacagtacaccacaaaatttttttaaaaaaacaaaagttagaaaaatttatgtatagaaatactatatataaaaaaattgaattcaaattcaaatttgaatcgggtatgtaaacttttgacttataaactttggatctataaattttacatgtatagaaatactatatatagaaaatatttgaattcaaattcaaaattgaatcagatataattcaaattcaaatttgaattgggtatgtaaacttttgacttataaactttaggtatataaactttacatgtatagaaatactatatatagaaaatatttgaattcaaattcaaatttgaatcagatataattcaaattgaaatttgaattgggtatgtaaacttttgacttataaactttaggtctataaactttaggtgtataaactttagatgtatagaaatactatatatagaaaatatttgaattcaaattcaaatttgaatcaaatataattcaaattcaaatttgaaacgggtatataaactctaggtgtataactttagatgtatagaaatactatatataaaaaatatttgaattcaaattcaaatttgaatcgacttttggtctctaaactttagatgtgtaaacttgaggtgtataaactttagttgcataaatttaccaaaataagaaagtaatacggtgccagaaaaggaaaccaagtggagggggtgaatctgagagtcttttagccctatgccattaagaaagttggaggttacgcgtgtgccacaaaaaagttttgagtcacctgtatgccatgacacaaactttcgtttagccgtgtgccattccatccaccttctgttagagaatgagctctgacatgtgggatccacgtatgaaaatgactaaattgcccctgaagcatgttcatctcactactcctctcacgtgcaatttctccagtgccctagcctagcacgccgccgccgccggtcgtcgccgtcgctggcacgccgccactgccacctcgcctcgccggcacgccgccgccaccgccagtcgtcgccgtcgccgccgccgcctcgcctcgtctatccaccgccgccgccgccgccggtcgtcgccgtcgtcgacacgccgcctcgcctcaccgtcaccggcacgccacctcgcctcgccgtcaccggcacgccgccgccgctgcctcgtcttgtctatccggcagcgtgcctctagtcgccgctgccgccaccgccggtcgtcgccgccgccgccgatttctcttccaaatgttccatccaaagtggctgaaatagagcaagggcaaaatagatctttcaaacctccgttagtctccgttagtgctgattccatccaaagtggcgcacaagtaaaagaaagtttgtgtcatgacaagtgactcaaaacttttttgtggcacacacgtaacctccaactttcttaatggcatagggataaaagactctgaatctgatcgctaccccatcgccaggacgatcgatcatccattagaagcccccgttggccctttaaataaaacgaacccacaagaaaaaaaacacaaaagtacatatgttctattttgcaaaaaaaaaaggataaaattgagacgctgagcaacaatagtggccccaggtgacagaccagagcagcagcccaacgtctgacattaatcgcggggtcgcaggccgcagcacccaacaaaccacgaggacgcttgcctgaccctctcggggactcctaatgggcgcgtgtgcgctggctgtccagctcgcgcagccgcgcacctcttctactggttatgttgattagttttaatgatatttattaatgctaatgataattatagtattagttttttaaaaaaaatacataaacaaatctttcaactcggacttgaaaacattcaagtcaaagatttgaaaattttaatttaagatttttttaaaatttccaactcggatttaaaaatttttaagtcaagatttaaaaacttttaacttagattaaaaagctttcaattcggatttgaaactttcaattcagacttgaaaactttcaactcagatttgaaactttcaattcagattcaaaaacattcaacaaggatttgaaaactttcaactcaaatttaaaaactttcaactgaagatttcaaacattcaactcaaattttttaaaaaaatcaagtcaagatttgaaaatttttaactcaaattttaaaactttcatcttaaaattcaaattttttatttaaattttaaacattcaacttgaatttaaaaaaattcaactcaaattcaaaactctcaactgatattgaaggtgaaagtatcagtttataaaatatcgcaaaaaaaaaatcacacgcgtgtgcgaaaaaaagaacgatttccaaaaaaaaaaaagaaaaaaacagagcgatttcaaaaaaaaacagagagagagagagagaaaaactagggaaattgcggaaagaaaaaaaggaaaaaaacttgtcgcggcatcagaaattacgattttgctaggaatttgtcgggtgatttttttgttgctatttcccgtttttgttgccgttggatctgcgccgagatttgtgccaggaatggggtggacgtggtcatacgtggatagggcctcgcgttggattccctggcccgattactttgcactgtgcaaatttcgatttccgcgcttgtccgtagccgttttttatttcccctcgctgatcccgctctctcctcgcatttctctctctcgctttccccttttcttctcttctcttctcgttttctccgcgaggcgagagagagatctcgtcggagtgagtgcttgctggagaggtttgtctcgtcggtataagtgctcgccggagaggactgtcttgtcggtgtgcatgctcaccggagaggttggtcgctggcgagatttagtgtttagatttttttttgttcgatttgattcagtccaggtccgattcaaattgtgttcgggttcaatctcggttttagttgttttcttgttcgatttgattcaatgtaggtccgatttgctcaccggagaggttggtcgctggcgagatttagtgtctagagtttttttttgttcgatttgattcagtctaggtccgattcaaattgtgttcgggttcaatctcggttttagttgtttttgttcgatttgattcagtgtaggtccgattcaaattttgttagggttcaatctcggctttagttgtttttgaatcgatgtaatatgatggaaagctcgccggagacgttggttgccgtagttttgtttagtttgtctcatcgtttttgtgtggcatccaatgttttttggtcggtgaaatcgtgatgctgctgctgcttcgccaagttgcgcttccaggtttggagatttgttcttcctgggctgtgggaagcgttcacggaatggatctaagattttgttgtttttgttgctgcagagcgttgcttttgagttggggaatggttgtttagcccgcggattcgggggttttaggggaagcttttgattttaggggtgctttttgcttagcaaatcctgtttctgtttttgtgcttgttgatgtgtgatttagtggcaaattctaggcgtgaagcaatttttcagaatcatgacatggctttttgttatgtttgtattagtgaatttttttactgaattactgaatttggtagccagcaaatacatgatgtgttcattactttgtaaagcttcacagtgattatattttttatgtcaatgtaaatggatctggatgttgtacttgtgctaaagtgaagtttctacatgattgtgttttttatgtatgatttttgttgtaaagtgaagtttgtattgtttgttcatttaactcatgtccaagttgatgtttatttattgttctttcagatgcctcgtgtccaaacatcaaggttgggtaaaaatcccattgaagttgattctgatggaggtgaagatttacatgttgattatgaagttggtaatgatgtaagttatattttaaatttttattattgtattatgctgtttaagtttacctttaatttggtattacattatttttctttttttttaggttgatgaaggtcctgaacatggtgaaattgatggtttattctctgttgtgctcaggaaaatggtatgtgaatttttttttgttgacttgtgttaatttaattttatattgtttaatgggttgctcaatttcatatttgtagattgttcaagaagtgaaaaagaatttggttgacacttcttctgtcaattttcacaatcccattgtatgtatcttttttttattagcatattttattatgcatggcattttatttgttctattttattgggtttcttattgcttataatcttgttttaacttatcaatgaaacggagaattaattcggtcaaaggaaatttagtactaatgaagtggatagttattttcagattggaattgttctgttttttttttgcaaaataaaattttatatttgttctgtttggtccatgtgtacaatgcggtactctgaatcttgctaccatgctattacagactactgttagttatgttgaagatgtgagtatttttcaggttgtagttgtgactatacaaatttgtatctattctctcaacacagttcagtgcagccaacgttgttgagttttttgttttttcttctctcgttgtttggcactaataccttctttgttttctttcacatatcctgcacctaagtatccttggtagctttgatgcatgcaacgtcatattcatgtttcccatgtaactaattcaatctagtattatgcaaacatagccaccataacacgtgttatggatatgtttttttttgtgtgtcattgtgtctaattttttctcaagtatatctgttttgatgtgtgatttgtgttagtttgcttggattagttttctcaagtgtttttttttgttctacacgcagcagcttttaatatgatatgagcttaaactttttttcggggctgtgcaaatttgtaaggttgcaaaataatagtctagtagtgatggtttcttcacttatagcttagttcaggtttccaaaattttaccgacaatttctactaaaattacagtacacttacatgctatatgcattgaatttacaattgtaattttaatttcaaatcactgtaatttctacttctagtgtttgattttgcatatgtatggcagcatggatagtgctattaagattgggtgctatctcaagtatatctgttttgatgtgtgattttgtgttagtttgcttggattagtttcctactagtaaggtttcagatatattatgattttaaatgttaggctatacagccgggaccaaattttatataattctggtcatgagtgtatatggttgcctcttagcctttataagggtaccccctcactccctacctccctatgatttttttttgattttattcatgctaatgtgctgatctggtatatggtaatgaaattattatttctttctcttttagcttttaaatattctaatttagtaaataagtttttaacacacttctacacttgtttttaaggataagaaatctaaagttcattcgaagactgagccctcatatagcagattctcaacaaaatatttctcaacagttctatcttctttatctcctgatcagcagcgtactattggtgactatggttttaattctatgctgatgtttgacaatgcttatgtcccaaacaaacaaatttgcttcttggattgcaaatcatgttgatgtgaagtcttctcaaattgttttgaaagataaagtcattgcaattaataaagaatgtgttcattatattttgggtctgcctattggtggtatggagttcccaactgattgtgatgctggaaagtcctttattctttcaaagtttggcaagagcgctcttccatctgtgagattctttggtgataagttcatccgaaaggaaactctctctgatgatgaagttattacttcatttttgattgttgcaatggcttgttttctttgtccaaactcttctttggtccctagcaccaagtatttgactgtgtttgagaatgttgatgagcttcggtcatatgattggtcaaaatttgtgtacgaatggatgatgacttccatcaaaaagatccaaaagtttaataccttgggtggatgctggtttctctgggcagtaagttattaaattttttttccattatctttgttccatattattattgttttttaattaatttttctttgctttttcatattttattttgctaggtgctttatctggattatgttgagtttggtgacaagaatattcctattggttttcctagaatttctcactggaagaataatatgattactttgtattctgaccttgacaaagttgatgaagaaaactttggccttaggcccattaaggatttcaatgatacaacttatttcaaggtacatgttcagttcaattagttttatttatttttacttgtgtttttcttttcataaattaattcttatcattcattcatctttacaacctaaaattttccttgttttaggttgtaccccctgaaaatagaattaatacattcagagataaattggagtctgctattggtactatgttacctgctttcattaaggagaaaatttgttcaatggttgttagtcattgttctgccaatcacattgttgacagtgagtcttgtgaagatattgctatcagcattatgctcttgctatgtgaacatgctggttctagagatggtggtgatcctgatgaaaacttaatttttgataatatcaaccctgggtttcagcctaactatgcaattgatgttgaaaatgaaatcccttgtgatgctcataacaatggaagtaagttttcttctatgttcttttaattttattatattttttaatttttcttctatttatatgttctttgatgttttattttttttaggtaccaataaatctgttgctagtaaagctaatgaaacaagttttcgccatacaccttctcatgataaggaattgggggtatgtgtctgcttcttatgattataatttatttttttagcttaagttttctaactttatgttcttgtttaggtaaatgatgattctgttattgtctctaaatctgttgttagattttccctttcaccaaactttgaaaaaggtacttggtgatgcattgttaattttttattttcttaagtttgcgttgctgttaattttttatttttgctcagatcaaggcttactaacccctgaagttggatatgctaataactccaattcacgatttggtttgtgatttttctttgctagattttatcttaaattttctatttcgaaaatttgtaaattctgttagttcttatcatagttattttgccagcttcaggtcctactgtatctgctgtagctgctgttaggaatgttgcaaataaaattaaatcaagattatctcaactcaacaatgatgacaaaagaggaccattgttccctgatttaattgattcttgtgaagatgaagctgttggttatgctaagtcactttcatgtcaaaaggaatatcttaaccctcgatatgtcacttcctcttcatcacaggtattccttttttattggcttgtgtcttttcttttttaaaaaattcttgaatagatgttgtgatgtcatgtttctgtatgctttattttttgattttctcttatttttttatttgttgtagcctggtatatcttttcactgtcttgacaattcacctattcaagtaattggtataaataataatgaaggaacaagcagaactcattgtattcagaatgtgaagaagaggcgttttgatgatgttactgtatgttcttattcttgttgactatatttatatattgtcctaagttacttttttttctataattatttttttttgctttttttttagaattctcctgatgtggaatatcttggtcattctatatttcctgattgctgcaaggtattgtgtacccaaactaataatttgtataatgccaagaacatgttgaaaagtaacaacctggatttgagttctaccggtggaaaattacctccccatggccctagaagagttttagttccttctcggaaattttcagatccttatgttctttctgttagacgccaatttccagtgtcagatcaagaaaagagacattacaatgcaatatgcaagttgtccgagagctctaaatggcataggtacagtttcctttacatatatttttatagtttttgcattatgcatgtttcttactttgcttttctttttatatcttttttttgtagttatgatgctgtagacattgataatgttagagcaaaattctcttcttttgggcaatctctcatgaaaggtggtattgtattgagctatgttatcaatgtgttttgccgtgttttgttcaacaacaatcatccttcaaactccaagagacactatttcttctcttctattggtgtaagtagttatttttcaaatttgtgcttttttctgttaatgttgatatgttacatattttttggtatgtttatttcactttattttttttcaggaactattgttaactgatctatcttgtgctgatttgagcaaggtgaaaagatcgtttcttggagcagctagtgctaggaagttgcacctttctgacatggtattttttttgttttcatgctcatgtaaattttccaaagttatgttgttaattctgaatgattttttgcagctatttttccccatcgaacaccttgaacattggttcctttttgttgttgatataaaggacagaatgttggtcctcttagattctttacatgaaaaaggtgatccctattttgaagacattgaatgcttactggtatgatattttaattttaaatgcgttttcattcagtttttttcttcttgttttttgtagttgattgattttttttattttgtattcagatcaataatttacagacattctgggattcttatgatggctcttcaattgattttactactttgaagaaagtttacccttgtgttccaaaacagagatcttggtatatttttttgtgtttaatcttttctgttcaaataattggagcattcaaaatacgttatttcaggaatgtgcagagtcacgcttgtattacattacttatttgttgatgtccaaattctcaatacttctttactttagccaatgttttctaattttctaaatgtcattaattgtcctctcattggggcattgtagaatgttcttgcttcatttgttaactagtgaaattaccatgtaattctgtgagctagatatttttttattctgtgtgtgctatgctcacacttttgctgtgtattttattttgtgatattactgtggtgagtagtttgtgtttacattttgtgatattactgtgctgcatatatttttatatttttcgcgtattgcatatattcttaggatgttagtaataacacttgcccaatttttaacatactaataataataataataataataataataataatacaagaaacaagaaaaaatgccattgtggtacaactaatatcaacaatatcatgaacagtactacctaggttttatttctttcttttttgtaatttaaagagttgtttcaattttttttgtacctttgattctggaatttttgttatgaagtgtatggaattgtggtcatcaagggttgttctaccaaatgaattttcttcagatgatattgacaatattcgatgctgtatgcaaatcagttattcttccatccaacgaataaaatgctgcagactgaagttgaagaagttgtgctcaattggtttaatcctgtaagtgtgtttttatttttttttcctattcttgttttttgatacatttttagttatgaaaaaaatgtttttcattttttatttgtatgctcaatttgttggtgaaggctgaaatttttcagaaagatagttgctatgaaaattggtttaatcttgtaagtgtcttttattttttgccattcttgttttttggattctttcatagttttgaaaatattatttttgtttgttattgtaggatcaatttgctggtgaaggctaaatttgtgcataagattagtcgctatataaaactgtagtgtgtgatagcatagtggaatgtataggatcatagtgaatgcatttttgcagtgccattacatattcctgtagtgaatacagatgttcacttacatcaaatacttttagtatgaatacacatatatagtgtgtgtagtgcagtaatacagtgaaaaacattaagatctaatactttcagtctcaaaatttgacatccttgttttctgtcttctaatttgatttgttctttttttgtccttccttgatctttaggtagcttgcttcctttgtcattttcttcatgtttcttcttcctagcgggcattgcttgcttctctattgtccctgcaatacaaaaatttatatccattagcttgattttttttgcttgcccatgtttgtaatattttacatattattcatttcttttacttcttgttgtagtcttctgtattttctttgtacttcttgcaattcgcatcagcgggcaattttctattgtgtgacttgttcttccacatcttgtacaatgtttttttggctgttcttttatcttctctaccatcccttttgttcttgctgattttttcccctttgtgttagctatgtcagggtcttgaatatcttcttgctcatttgttgtttctttttctgctttatcctcacttgtgttttccaccgtgttgctttcatcaattgatgcttgattttgagctgcatcttcaattatcaagtcaaggttgctatccagattatcaatctctcctagcaggtactcatatgtttccttactttttgatgcctttgatgtcatgttgcatattcttctagataatacattgaaccttagcacagaactgttctcatcatttgttgcaagttgcatgctcaccgttaattttctctcctttttcctccatctttcaattatgtacttatcaggaatcttgctcattttcagatacaacatcactttcaaaacatggctgcataggattccatctttggagaactttgcacatatgcacacgaagttttcttgtggtaagtctgtcatcacaacatatcttcttggtctgaattcttgttgtttcagatttggcgctgcatatacttcatatgcttttgcttgttgtatagctgccacttctagatttagtgttcccttcaattcatcttgaaacttatcaaatatcccatggttgtataggtctgctgcttgttcttctatcatgtcatttgaccaaaaagactttggcttcttgtttctggattcataatctttcccatactcagtgtcgaagatgatgtcattgattgtttcatattccagtagaaaagtcatgacactatgtgttgggccaactccccttttaaaccttgcatttgtgccctcactaagtgctgtgctatgtataaatgggcaaaaatctgttttggaatacaccggtataaaattcttccttgttctccacattatttccagatatttgatattttccaagttgtattgtgcaatcatttgcaaccataggctttcaaattcagctcttgtcaagctattgtgcacaatgtcattaaattctgcatagagatctttccttctcttgtctgaaaatgtatttcctgacctttctctacatttcttcaaaatgtggaacaaacaatttctatgtttgctgtttggaaatacttgacgtatagctgccctcattgccaagtcttgatctgttataattgtttctggatgttttcctcccatggctgttaggaacgtttcaaaaacccatttgaaagtttctgtagtttcatctcctaaaaatacacatgcaaaaatgcatatgtttccatggcctgtaacactgactgtgaatactgtgtactattcgcagtaatatttgttatttttttcacttgttatattgaatttgaattttatgtttgtggaaaaacatatttcatattattctatcatatctgtcatacaattttttttataatttttaggtgacatacataaaaggagggaacagggatgttcccttgagggataaatattcacttctggaatatcattccttccacgaaaagagcagttttcgtgaagcattgctcccagatgtcaaaaagttcattttcagtgaaagcaatttcctagccataaaaaaacgttgacagttaaaaaaaaccattttctagtactgttggctttctaggtctggctatgttgtaaacaatgcagcagctagtgctaccctaaacaaccttgttatagtctccgccagtaaaaccagcaaattagctgcttgtgtccaatacctgtgtttcaattctttggaatctctgggattcccaatgcctcccaaaccaaaaccgaaggtgtgggatgacggataccggtgtataaataggacgaccatgactgcaaagaattttcaaataacagtacgaccagtgaacgtttgacatgccagagattcattttatatcttgcacaatatttatgggtgcaagtccataagtccaaattaagttggctgaggaagcagaaatttatgaaaatatacaaaggcatagaattatgtctaacacgtgcttcagagttgttgcccggaggataggttgatacatctatttttgggacaagattgatacgtacaaagtaacaaccactgtctgagatagggttgtgttactactgcagaaaataacattagagtcggttcgtaactgacatcaatgcctgaaatgaacatatatatataaggcatgttactcatattttaaattactttcatgtgatactaatttcatatttattgaaaacataacatgggataaattaatagtcaaagtatatcattgaagaccgtataaaaaaatagacatttggacggatttagtatcatgtaaaaagaccatctactcataactcacgatgtggtaattaaatcaccgtgaataaaaggcatatgcccctggccctgcaaacgtagctactacccccgttccataataattgcatttctaccattcaaatttgtctttacccccgttccataataattgcatttctaccattcaaatttgtctcaaaaatattgtatttctaataatatgggaagcaacaaatggaatatgtacccaaacctttcttttaattaagtttacatatggaatgtgtattcctcaaccttgcttttaatcaagtatacatatggaatatgcatgtagttattaaatagggatattgttgtaaattgtgtttgttgttaatctatctctaattttctagaaatgcaattattatgggacggaggcagtagtgttcatataattaattggcaggtcctaacatgaaatgcatcattattggatagagcattagagcccctctgtgtcttcaacccagatcttcactaagggcatcagcagtgtgttcttcggcttgtgcagtctaaagataaataaaaagttggtttgatccatgtagtgtgtaaaaattgattttatgggacacacggagaaaaaattcaacctttttcggcgtcctcccgtgtgcgccaggccaaagtacgcaagcaagtattttatttaagggttgtttagattgatgtcatttcaaaccataccaatttttaagtaaaattattgaatctgtgcatctaaactctggcaaatatataagaattcctgccaaaatttggtaatattaccaaactgccaagattttagtatagccaaaatttggtaaggtttatttaggctataatctgaacaaacccttaatcacatgtggtcgaactctctcttttttcttttttaggactggtcgaattctcttcgaaagtcattttttaccgaacacaatctaatcgattctaacaatgtgcattgttcggtttctttcctctaaaatcgatgctagccccacactggagatgctctaccaaactagacacgggtagttcacagcatagagcagctcttgtagactgtacccggtacttttctgatcgattgtgtcactatatcgacatgttgttgatccctcctctgaagaggttagccagtacacctttcccaactttcagaggataaagggatgcattctcaagacctcccagtccaaggctagatagggcatttctagatagggcatttctaattgtttagttcacagtataaaacagagatatatgtaggaggatgcaaatcatgcatagtactctctgatatggtttctctctttggtaacaagatgcatgcatcgtctggtatgtatatactgtctagtactctttaatgttagagatttgctctggtccaacaaaaatatcttgaggtaccggtaactcacggtactaaatcgtttccgatcgttggatctaacaatgcacatcctgcccagctagattcaacgatcgaaaatgatttggtaccgtgagataccggtacctcgagatactttttgctgggccggacaaaatctcttaatattaacatcccttagcaactactccctccgtacctaagactggatgtaacacattctaatataatgaatctggagagaggtatgttcatatcagttcgctaataggatgtcagacatccaatactagttagttttttatgcgacgtatagagtacctaccatgtgatcgatcgatttcaattgcctagttattgcttgcaacaaagtctgaatcgttacacatatcataaacttgacctaaaaatctactatgcacaaacaagtactcttctccgttctgggatgtaccaaaatgaatctttatttggttggagtaggattgaataattgttttatatatgttgtgatattttcttcccttctttagagtttagagttggtatttctatttttccaggtggtatataccctaacgctgggggtatatatctcatatcgaattaacgttataataaggtgtatatcgcctgaatgaccctcgtggtctcgcctcctcagccgggacagcgatggggacggatctaggcaagaggtctgccctgaccccgcatatgccatccgccgagccactgtcactggcacgataacacctagcgatataaatggggaagaggagagaaaacgagcgggagaggagaaaatgagagggagagtgagtgaaggacaccatgggaaagggggagtccaccactatggagagcaagagttgggggcggcggcggacacgaagatggatggatggccgcaaagtgggtggcagcgaggagagagcgaaatgtctaccggtgtgggtggataaggatgaatgtgtctgttgacttggtgtggggataaatcagaatctcacccggctagctcgcctagctcaactcagattttataggtgtaatatgtttatagctgtagattttttaattaaccgatattataaatttataatatattaaatgtgtcttttttaaaaaatactaatagtatcgatgttggttttgtatagaaccggcacctatgattgttcaaaggtgactgtattatattttctcacctagcgaaggcgggaaaagataaatagctgccggatttaaataaatcaatatataagccgttccctattaagagttctgtgacgatatctcatgttaatatatatatcccgtcaattatttcaaatttttattatgagtgacaaggaaagatgaaaattgacctaagagagtaaagtgcataggagatccttaaacttgtagtgttgtgttatctagatccctaaactctcaaaatgcagattcaggttgtagaacttgtctaagtgtatcatttaggtcccaaatcgacatagcccctatagtatcctacatggcgctgatgctgatgtggcataccacgtggatgtgacgtgtccttttattttttttcttcttttctttttcttttttgttttcttctcattcttcttttttttcctttcttctgctcgggtcacggagaaaggagaataatgaaaaaaaagagaagaaggagaagaaaaagagaagaaaaaaagaaaaggaaaatttttaaatgtccgtgtggcatgccacatctgcaccacgtaggattttgaaggggttgtggtgatttgggatctagatgatacactttgacaagttctgagatttgaatatgcattttgagagtttaaggaatctaaataacacatccctacaagtttaaggaccgcccgtgcactttactctagacatagttacagagtgcatgtgtagtaattagtcttaaggtatctcttcttgttgcactcctctgactttattgaggtatatccgtatatgtgaaagttgcttttcagtaggctcaaaacaagatatcacatgccaaattatttgcttacactagaacggaaaccctcatctcaatcgggcggtaagccccatctcaatcgggcacagcgtccgtcacaggctagaagtcactgatgtgaagagttatctcaatcgggcaaatggccgtcacggatgaatctatctcaattgggccctaagtaaagcccgtcaccgatagctttgacccagacgaccagtcaaactatagcccgtcatagatgacctatctcaatagggccacaattagtgctcgtcacagatgactactaacctttatcgggcctaaactagagcccgtcacagatgatacttatctcaatcgggcctaaactagagcccgtcacagatacctactgacctcaatcgggcctaaactagagcccgtcacagatgactattgacctcaatcgggcctaaactagagtccgtcacagatgactactgacctcaatcggacgtaaactagagcccgtcacagatgactatcatctcaatcgggcatttagttatggcccgtcacagatgactataatccacaaaaaaaataaattttgttttttggctaacctcaggcctttgctagccatgcccgctgcagaaatgacagaaacaaacacagatatccaatatccccagctccccagcatcacccattcatatacatatgcattcacatacacagacatcaatatattttacacaaccacacattcacagccatctcatatttcacatccattcacatatttcacatccattcaaatatttatcatatttcacctgcaaaaccaaattaattggatcaaatatttatttagcaagtcttaacataaacatatgaaatatatacataaatataagcatcacagttacatcatcacagttgcataataagtgttcatcattgcctaaacataaaagttcaacattgttcatcattttagtttaagcctaaacattcctttggggttaattatttcgcagaggataaagctggctatctcctcgcgaacctcctcaaagctggtaggcagagacttggttattgtgccctacattgtcataattctagattagttgatcgatcatatataagtactaaaatgtagttagtctatcagaattgagaccaccgacctcaaactcagccaaagtcttcaccttttctctgtacagaaggcgcatgttgtggcacacatggaatccacactggtcacctatttgttgcttcaccgggaagtcttttttgtggatgagggtgtcatgtcctgtcttcctgaggcctcctctttgcacgtattgggcccacgcttcatctatcgctagttgaattagggtccaatcatatgcgttcttatcaattctggagtttaggtagtaacatgtactccacttaggtgttattaccagaaggatccaatgggcactgcagcattaatatagtgaaagttaattaagtactgaaggaatgtgtcatgctgttgtgtatatttagataacacacttactattgattataggcgcacataatgtactccttgtctcggcgggaccacaaggtgtcgtagatgtagttgaccattccttgacggtcattctggagatttgtgacagtgaccacttgtggatcaaggaaggcaacttctggtgcattcttctgacaccattgccaacttaacctacacacaggataaacgatcttgtaagctagttaatccgattgttattaccagattgagttgggcgacaatacttacaaggagtagcacttaaggaggcttgtgtcaaccgctcggagcctgtagaggtcgaatagatccttgaagtcgacgacgatataatctgttggaccaaggaatggctttccatcgtgctctccaaggatatcggtagctttattcggcttcctggcattagatttctccatgtagtatgcgtgaaggtccttgcaagcggtgcccattgcggcaagcacgtcatctccaaccaatggcatgcctagttggaactcctgtggagcgacatatttcttcttgatctctttgcccttagtctcttcctggcccttgcccagatctagctttcttggagctagaagcgaggactgcacctttcctccccttcctctcccctttgcttcgggtttatcgagagtaattctctaaggggaagagtgtgccttcctgctcttcttcatcggtgggggttcatgaatcgccttgctgtcggccttcgttcggtcctccccaaaatccgtgtcgtactgcaactgcacatcgtaagattgtgcatgacaatcttgagcaggaggggctgaaggagcagaggcgggtctctttggtggacaaccgcctggtgcagtggttggcctcgctgtaaccctgatctcaatgaggtccttgggccattggatgaaggtaccatgggcatttcctagtgagaggacctcgtcgttcagtggatactttggtaggaatagctcatattccggcttcactgagtcgacttgtacttttgcacagtcgcccctgagttgcgctccatgcactcttgtctctagggtcggcttgtacgcaagtccctcggctgctggaaccgtgtaggtcggcatcaccctaactgtgagggtgcagctcgttggttcctgcgatagattaatcaatttttttagaatattatatatcatatggactcgttaagtctttcatgcattatggacgaaacttttactgttatgtggtcgacggcgctgtcgaccgatgttggattttccgccacatcagttgatgcgcaactgctgcgtttttgggtgggacttcctaactcttcatgcgcagcagcagcagcggcctgggtgttctgttgctcttctcggatctcttgcctaatcttggccctcatcgactcgagctttttgtcgaattcagatgtcagctcagctcttatcgacgcccggatcttggcttcaaggcgtgcatctttctccgccttgttggaagaccgcttcttgtactgccacgcgtagtctggtaatccatacttctagggaacagaagacccaacgccccgtgtccgtccatggtattccttgttgcccaacgctttcgtgaggaggtcgtcctcgcgtctttgagagcaggcctcttgtgaggcttgttgctcggcaaccaactccttctgcattacaatttagtggggttaaataaactgcatgatcggaaccaatgcaaacatctagtttgactagacacttactatagcttcgtacactcattgatcttctggatttggcatgaagattgtgccatcatccttcttctggtacctggccctggcccagttcctagccggagggtgtgggatatcaccaaacacgagcggcgtgttcgattcctccgcttcttcatcctcacgctgccattcctcttccttaccggcatatccggcggtgccaagccgatgcagatgctggttcttggtctggagcaagcgatatgcctcgctactagctctggactcggaggtcgacttctttgcatggaattcctcccagacctgttccgggatccaaggaaatttctctcttggatctggattcgccgggttgtagacgaactcgctgactagcttagtcttgaagttcttccaagcgttgcccataaccttgaaagcagcccgcctgagatggtccgcatgctccgcaggataatcgaagctctccttgaacgttagccaagcaatgtccttctctgcggccgacacgtgcttgatgtcatcttgcagaatactgaacttctgcctccctatgaccgatagacctaaatcggctcaatattttccttggagatgtcggcaaccctacggcgtccaccgctgttatgcggaaccgttccttagggattttgttccctgtcctaggagtacgtgcccttgaggacccactagttgtcgtcgatattggttcaccttgctgagacatcgtctacttttttctaaataacgaaaatatactattcagtgcttcaatggctaagaatcgaaagttctaaaatctattagtcacataaataaactaaattacacatctcacagtaataaaatgaattgaatgtcacataaaaataaattaaacatttcatctattcatctattcatccacattcatctcgaatcatctattcatccacattcatctcgaatcatctattcatccacattcatctatccataaacattcatctattcaaacacattcatctaatcatgtattcatccacatgtaaaatgaattgaatatcacatataaataaattgaataattcatctattcatctattcatccgcattcctctctaataatctattcaaccacattcatctatccatacacatgcaagtattcaaacacattcgtctatccatacacatgcaagtattcaaacacattcatcaatcgaaccacattcatctattcatcattcatgcgcgatggaggactcacctgggggtcggcgtcgggcgtcgggcgtcgcaggctcggtgaagccggcgtcgggcgtcggaggttggtggagggggctgcctagggggggcggcctcagacttagcgaggaagaagtcggcgaaggccggcggtgccgcgatcggtgaagggcgtcgccggggtcggtgcagcccgcggtgtgctcggtggaggcggcgtcaggcgtcagagaggagtaggcgacgacgatgaggaaggatgtcgccgggctcggtgggggtcgtcggtgaggaggcggcggcggtccgaatggagggcggaggaggctcggtggcagcgaccgcgggctagtggcgacggtggcgggctcggcgatggaggacaacagcggcgctagggttctaaggaggcgggaaactatagcgggacttagaaaaattttcgatctgatctgagaaaccctagttatagtagagtgatgagtcatctcaaacgggcattgccgtagggcccgtcacagatgactcatcggtgacgggctccatcacggagattgagatgacattcaggcccgtcacggatgactcatctatgatgggccctaagataatgcccgatagagatagactaatctctatcgggcttaaactaaggcccgtcaccgatgactatttttctatttttcccatcaagtctttatatttgtgagtacaatatatatagctgctatataataattcaatttattagtcataatacatttttggatagtaaatgatttcaaatcaaaatatggtcaacaacaaaattgtagagcttatcaagatctacaacttttattttggtcatttgtctatataactttgttcccaagagcttgaaattgattttgaaaatatgacaaattaaaacagcatttgtaaatagtaaatgatttcaaatgaaaaaggcaacaacaacaaagttgatcctctcatcaagattggcaacttttattttggtcatttgtctctataactttgtttctaacagcctgaaattgaatttgaatatatgacatatttaaacaacatttaaaaatagtaaatgatttcaaatggaaaagccataaacatcaaagttgtacaacttttatgttggtcacttcttcatccgacaaagtgatagtaccaatgtttacaaaattgacatatatgtgttgatgtttataaaccagatgagagaaatgtggtttttgtgaataatgtaactatcaccttgccggatgaaaaagtaaccaaaataaaagttgtagatcttga

SEQ ID NO: 16329 - DNA, 23415 bp, Oryza sativa
cccgattgagatagattaatctctatcggccgtaaactaaggcccgtcaccgatgacttatcaagatctacaagttttattttgttcatttttctatataacttttttcccaacatcttgaaattgaatttgaatatatgacaaatataaacagcatttgtaaatactaaatgatttcaaatggaaatatggtcaacaataaagttgatcctctcatcaggatctacaacttttcttttggtcatttgtaagaaaacaaaattagccatattaatgactacacatatcaagtctttgcaataaaacaataaaacaaaatacttcattcattacaatagataagtacaaatgcatcggtcacaagattatgccttccgtatgatctgaacgagcatatgccacatgctcttggggatcatcgtcaaggtcaatgtgaggtcttacataaagattatggttgtattcttcttcatcgacgatgttgtcaactcctacaattcggcgctttccatccctcacgatgtgcatcttcttgtttgaagggtcttttatgtagaatatctgctcaacctgtttcgcaagtacaaatggttcatcggtgtatcccacctttgatagatctactaaagtgaaaccttccttgtcggctttgacaccagtccgtagattcacccaacggcagcggaacaaaggaaccttgaacttgacgtagttcagctcccagatctcctcaatgcggccgtagtatgtgtttgacccaacttgatcctggaatgcatctatacggacgccgctgttttgcactgtgcttttgtcatcttctttgacggtgtaaaatgtgtatccatttatatcgtatccttgccatgtgtctacggtccaagacggtcccatccccaacaattgtactgtctcatttgggacatccgtggacattgtcacacgattcttgaaccattcgttgaaccgagaattatgttctctgttaatccatgcataagatcgtcccaagttctcatctcggatttttgctaagtgctcctcaaagtatgggccaacttctgccatatgttggagtacagcgtaatgagcctgcgcgtacgatgcttgatcgggcctaattcttttccatccgattgtgccaacacctgacaaccttccctcgtgatgagatgcaggaactccgataggatcggcatcggacatgtaattgacacagaactcactcggtcgtgtaaccttcaataatgctcccctcgggtttagctctattacgaacgtacgacttcagaactcccttgtacctttcaaatggccacatttcccttagaaaaaccgggccacataaatttgtttgcttcaccagatgaatagggagatgaaccattatatcaaagaaagatagtgggaaaaacatctccaggtgatagagggtattcacaatatcggtctgcaacccatctagatcttctggatttataaccttctgtccaattgcattgaagaaggcgcatagacgttggatcgtgtgacgcaccttcggtggtagaatgcctctaatagcaactggcaagatttgtgtgattagcacgtggcaatcgtgagacttcattccaacaagttttagatcgtccaatttaacatacttacttatcctcgctgaatagcccgatggaactttaatatccttcaagcatgataacatcgcgatcttctcatccttcgacaatgtgtggcaggctggagggaggtacactctacctgtctctgcatctcgtatgggctggagtttcatgtcctgtagatcaaggcgcgtgttcaacccgtcctttgtcttcccgggaatattcaacatcaggccaaccaaactctcacacacattcttttctacatgcatgagatcaatgcaatgacggacatcacgatctttccagtagggtagccgccaaaatatggatttttttcttccacatacccttctcctttgtcttgctacgttttcttttcttcccaaactcattgcttatgtccttgaccatattgtggacctcatctccggacaaatctttgggagcaagctgaagttctctcttaccgttaaaaattttcttccttcttctaaatgcgtgacgtagcgggagccacctccgatgacccatgtataccatctttcgtgatctcttcagccaccggcttcgtgtatgttccttgcaattggagcatgccttctttccttttatagtttgtccggaaagattaccgagtgcagggtagtcattaatggtgtagaacaatagaactcttagcttgaagttctcctgaccatatgcatcccaagtttccacaccttctttataaagaatctccagatcgtcgataacaggctctaggaatacatcgatatcattgccgggttgcctcggaccttggattaacaagcacaacataatatattttcgtttaaagcataaccatgatgcgaggttatagttcgcaataagaactggcctagtgctgtgagtactactcatgtcaccgaaaggattcatgccatccgtacacagacatatcctcatatttctagggtcggcagcaaagtctttgtgtttttgatcgatattcctccattcaatcgaatccgctgggtgtctaagcataccgtcattccttctctccgtggcgtgccaacgttctgacttcgcttcgttcgggttggcaaagattctcgtgaaacgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcatttggacaagcgtgaattctacggacctctaaccccagtggacacagaacctgctttgcttcgtatgtcgtcgtgggtaatgtgttctcaacaggaagcatagccttcaaaattcctaaaagatttgtgaaactcttgtctgtccatccactacttgccttcagcttcattaggtccaaggtaactgacaacttagtgtgttttgctttgcatccagcgtacagaggcgtctcggaatcactgaccaacctgctgaacttcattccatctctctcattctgggctgggtcctcaacgtcacgtaacttgtcttgcagcagatcgtgatccacatcaaccatttcaccgcccaatggagaaggtataaacatgtcatgctcatcttcatcttcctgattatgcgcaccacttctgtctgctgctactccacttcctgattcttgctctccatgcttcacccaacatgtatagcccttcatgaatcctcgttgtaccaaataaccgtgtacgtcctctgcgctatcaaacatattctcattcttgcaatctacacatggacaacacatgtaatcactgtttcttcttttccgatcctcctccgcggcgttcataaaatttattacgccatttctgtactccgtagaatgacgtttcaaatttttcgcatacatccaacttcgatcgattgctacaaaataaaaaaaacaaattgcatgcacatcttataagatcagtattgcaaaagtaatacgtgatgaaatttctcaattaatgtttaatattactcacttgattgatccattttgatcacttttaggaattttctgtttttcttggaaaaaaagacaaaaaatcgccccctacagcctcccaccaaaatagtgaacagtgggatacagttacactaggtggtaggggtatttatactgtgcaataaatatctgtaatggccctaaaacaatcaaccgtgacgggcatacaagtaatctctatcgggtcttaataaaagcccgtcaaaaaagagtgtcatctgtgatgggcattaaacttatctcaatcgggcctctagttggagcccgtcacagatgaccctcatctatgacgggcttcgtttagggtccgattgagatatggaaccctcatcttaatcgggcctcaactatggcccgtcacatataagtgtgatccgtgacgggcttaagttttatgccgatataccatggctgtgcgaccatatctcaattgggcgaaacttcggcccgattgagattacttccttgtgacggctcgcaaattccagtcttgttatgggccgtcacagatggaaggatctgtactggtgttaattaatcaacctatttggccagttagggatcgacgttgcacagtgaaatttgtacggacagaaacatccattagcttttgattgtttgtcatcagttttcatctctgctcactgtcacacatgtacttcagagactagatgactaaaatagaatgctgaatgtacatatttatagcatgaaaacccttcggacaaaaagttactccttccgtcccaaaatataacaaccttgtattggatgggacacatcccagtacaacgaatctggacaggggtatgtctaaattcgttatattaggatgtgtcccattttatacaaggttactatattttgacatggagggagtacaagcatcagatggcatggcacgtatgtaacacaggcacaactatatataggtcacaaaacgtaagtccatgaaagagaggggtaaaaccgagttgcagactggttgtctgctctcggttgtgcctggcaaaaccacacccagattctactcaattctactcaaatcatttgcacaatattgagtttaacaatagaaaagctaaaatgtacgggaaaatcatttgcacattatgagttcaatttctagctttgtgactaactagcttggaaaaaaaatattttctgaaaaggtaaaatgtacgggaaaataatttgcacattatgagttcaataaaagaaaaggacgtcccgcaaaaaataaaagaaaaggacgagatcgatcagtgtctaagaaaagattaattggctaggtcgaaagatcgttgtatatacagtttgccctcggtcgtcagataccatatacaaatagggttgtggtttaaactagctatgtctggtaggcatcaggaacatcagcttgctaccccaggagcagagatgtaggtagcaagttaaatcctgctagcctgcatgatccgcaagggatgttctcaatttggaagcggcaattttgcggtatacaggaacacttccctaagcaagagtgtggtactgtggtatgtcatttagaaaaataaaaagttattgcttccagtttgttctaatcaaccaaactagtagcaaactgtgaaataattaacatatatcaggatttgctgaaagcacaatttaacatggatgatggatgacatttgcccacaagtcctctactgtgattccacatgtacgcttccaagtcagcccacgtgcacgattggggcgtgagccaaatctgacttggaaaatgcccaaatttggccagacctttcggtttgaaagggttgaaatggattgaagggtttgatagggaataatttcacaccacaataaattttgaaataaatcctctccaatccttctcggaacatagccttagccaaattgggggaagatcttagggtgggatcctgtgagaattaggagcccacgctgttttcggcgtaacaaataacgtgctggtccaacacaaattatgtacaaacaaactttataaattaaaaagttcatacataaaaggtgtgcataggaactacgcattcgtgtgtgtataaatttcaaacaaattcattagcgttttatctcagcaaaaagacaaaagttcatacatagacctttatacagaaaaaacttatagattcaaattttgttgggcataaactttcatgtgtacaaaaccattccgtgttattgcgcgatggtgctgtgtccatccaattagcacgatgaggccctgcatgttcttctgggtgtgcctatgaaaaatattaaactaaacgaggaaaagtaagagacggctaaaaatgagagagaaaaatcataaaattaaagcaagttggtgattcctgttctactttccgcaattacttgaataatgtagtccagtgaagaactcaatgtgctcgaacaaataggataggcattcatctgctattctttgcttgcaagtagtttatcaatgtatcataaaaaggtggtggactgaaattgtcacgttctattatcatattacgagcaaattgccggggagatagagtctgtgctgaaaatcaatttcagattagtaacttcggtagttgataattagctccagttcagcagcaattcataacgcacgtggaatacttcagatgataaagttggaaaacactgcactgcagcagatgtcgaaagaaaagtcacctacacggtgtgcaggatggaagaactatgggtgtgtttggttgcttgcataccctcatcctggcccatctcaaggaagagtgaagcgacgaggaagaggaagagtgaaggcccaggtggcgatggcgacagtcctccctcgacggcgttcagatctggcggattcgactgagctcgagcatgtcgcctccgcgcgcgtctggatctggcgaatccgaccgagctcgagcacgccgccctcgccggagaggatggtggtgccatcttaggtcagtcctttgcttctatctcaggtcatcgtcctcctcttccctttctgatttcgttgctactcttcctctccaaatcgtagattttgaattttgggggcaaatgaggagggggcggattgacccctgcttgccccttgcacgcgcggtgcaacgccttgcactcgcgggtgcaacccgctgcatccaccgggcctgcccgagataggaagctcgaatcgagcgtttctcctcaacctggctggggagccctttttgcatcagcggggccaggctaaaaatgctgcacaggcaaccaaacaacaggaagttgcatctactgatgcaggcaaagcctaatgcaggcaaccaaacacgccctatatatttgtgcagagctctgccttcttgtatggccaatcaccgaaacagagtcacgaaaatatcttggatatgactggcctgtgtaagcacaagagagaaataccggcaaggcccagtattctgcagattttttttatctattttagaccttttaaataaataatttaataatagacctcccaataaattattttaaaaaacaaacctcttcgccacgccaccagaactggcgtgggctaactaagttgtcctgtgacggtctaccgtgttgacagggtcaagcaggcatcgatatggcagcggggtgaggtggcgtgacactgtcatgccaggcttggtggcgtgccgatgctgagcttgccgttcttcgcggagcagcagacgaactatcagtacgaaatgatggactagggcatcgggatggagatcggcaacgaggcacgacgaggggaggtggaggctatgagaggcctcatagtgcaccgagctagcgtggatcctagttgcgccagctcggattttcgccgacgtggagcgagcgaccgcgccttagctaggtttctcggcacctaactgagcaacgcagaacctcgcgaggaccaaggcgcgcagcgaggagaagacgtgagacgcgcgcgctgtgggcggcgtagcctcgcgctcgcgtgcccctagtgcccaaaatccccgattcaccctcccaaaatcccctcccgccacagatcggattggaagagaaaaggcaagaaaatcttggggattagaagaaaagaacagatcggattcaacaagatgaaaaataaaacaaaagcaaaatcatcacaacaagattcaacaggtcggactcctcctgcaacaccacccccgcctgctctgattccgacgacgaggacaacgacgacaaggtggggactcgtcgctcccgccgccggtggaggactcgaggaggactcgctgccgccctccaagaacctgtacgggaggcgaggaggaggaccagctcaccggtgctccagatccagccgccgccgccaagaaccgcctgctgcccgccgccaagaaccgccacgccgcccccgccgctcccaccttcgggaaaggcacggtgacggaccgggaggaggcgtgacggcggactcggagaggagcggcgtgggaggtggtagtgggaggcgaggcctcgccgccgtccgctcccgcacttctctaagcacgcttcctcctcggcacgagtgagggaggagaagcagagcgtgggatatagagggaggggaaaggctcgccggtgcgtgcggtttattgcgatgaggcggcgccgtcgacgtgggaggcgaggaggcgcggcagcgtggcaggagaggaggaggcgcggcggtgcgggagagaggaggagccgaggaggcagtcgcgccgaggaggggaggggaaagggtggtgcgagtagtaggcgagggtagttgagagaaataaatgtggggtaacgcgcctggggtcacgcccactgtgggcttggtaccctttaccagtgtctctattcaattaagccacacaactagaggtgtttgcactgtgggatgagtgtctctgggccaactttttaggctagggatacgggccccatggcttgcactgtgagaggcctgatacgggagtccatggaggggcagaagaggagggaggtgcgggcatgtgcaggagagtggaaagggaaggttgtacgagtgacgctgtgaggtgggtcacgggtcaccaaccttgaccggttcatccacgaggagctgctgtcctgcaaggataaaacagtcacggtaaaatatgcatggcagcatttaatattgtacagtatttctagttggaacgcagatcaatattagaatattcaaccaagtaaccaagtagccatgtcatgtgttttacttagtactttctctgttttacaatgtaagtcattctaatattttccatattcatactgatcttaatgaatctatatagttttataatgtaaggcattctaacatttcccacattcatatgaatattaatgaatctagacatatatatatttatatagattcattaccatcaatatgaatgtgagaaatacaagaatgacttacattgtgaaacggagggagtatttcataagagcatcaagttcagaacttcagatataatgttggcgttttacatctcctctctgcagctacattatcggaagagaaatgcacactactcctactagaaaaaacgtttttccaggtgggcaaatttctttattccaaacagccaaacgttctgcctgcacctaaaggcctgtgaaaaaatattttttgcaggcggccttcggacccgtctgtgaaaatatttttgcaggtggactcttctttctcgcatgcagcagatccaaccgcctgcgaaaataatcccaatgagccaaaaaaaattccctgccaccaccccctacccgccgtcgccctaccagctctggccaggtctagggttagggttttaggagggagagggaggggagggaacccgcgctgccgccggtcgccgccactgcagggggccatcgccagagctggaagggagggagggaggaagttgcgtaccaccaatgccaccaccgctgtatcttgaagaaagggaggaagccgcgccgttgccgccactgccctaccccctccccctccgggcggatctaggaggtggggagggaggggagccgccgccgccaccgccctcccctctcttccctccagccgaatctgggagagggagggaaggtgagccgcctccacaccgccaccttcgccctgcgccaccaccatcgattgggtgaggagccacctccgtgccgccaatgtcacttggagaggagccacctccgcgccgcctcagcttccgccaccaccactgtcgcttcctccactgctgctaccatcatcgtgtctgcctccatgccgcgctgccgcctccgcgccacctccacgtcacgttgtagtcgctcggaactgggactgggagtgacgaagggagggtagggtagctgcctccacacctccttaatgccaggccaccgctgctctgatctgggactgggagtgagggagggagggagggaggggaggtgagacatggaggagatgaggagacgagggaggtgaggagatacttttcgcaggcagacctcttaagataccgcctgtaaaaatgaccacttcagaggtatgcctgcaaaaatagattttcgcaagcgaacgataatctcgccccacggttctcatttttccagacagccatttagctccaagaggcatgcccgcctaggaaaaaaatgccatcatgtgaaaaaatggtttttttagtagtggcacggggaaaacaatttgttttgcttcaacccctaattattaaaaagatatgtgctaattatatttattttttatctttaccgctgactagctggtaaatcatttaatcacaagagagaagagatgtcagaaaaattatttatcttagtggtgtccaatttgaactgatatattatttatctaagtgatttctgtattagcatgaggatagacaaacaaaataaaataaaaatggccgtaagcccctgactcaatttctttggcttgtcttaagctgccaactaatatttaggtccatattccgtctttggttttgtggaagaagagcgttgaagctccttcaagagcagaaaactttttgcatttattttgttttccaaagccccgaagttcaccgcaccgaaggttggaacaacaattactcccccatactatgtggtcttcctcatgacctaaattaccttcgaagtcgagttcaatggtccaagatggacacaataaaattcccaatgcttcccaaatctaagtgcgacgggtctggtgagaatactgcagggcttgtggccatcggtctatgaatgatatgctatgagtgcagggtagagacgcacagaatatgaaagcatatgcaagagcttatactacatgtgacaacgtgactattgtcagaatcttgaaattgcagcctaattagttaagctaccaccaggacaagctgaaataactactgtacatgatttggggatggtgcttgcccacggtcaagttacagaggtacatattttggatcatgtttagcaatgccacatttatctcatccaggttatttctttcataattaaattgatcagagatatgatgcccatcatttgaacctctctaaacatttctaccttcagctaaaataacatacttcatttcgcctcttatagaaaacggagtggatttgctgacatgtgttctctccattgatagtgtcttacttttataatatgaaataaagggagtaacatttttacgaagctaaaaaaattgtgtgtacaaagacagggaggggatctatccaataatgatgatttcctgttaggacttgccaattaattatctattatatggttaagcactttagtgtaggcatttaaacttccaacaaacactagctttgcggtaccaggtacatgcctttattcatggtgattaccacatcctgagcaatgaatagatggtttttacatgctagcacgttagagcaagcttacacagcaacataaagaaatgcaacgaacgtttcaatggttcggccattccaatagtcgcatattattgttggttactaattttacctctccactttaatttagaatactaaaatgatttatgtagccaactataaatagtaggcaaggaaatattcttgtctatggtcaaaacatataaataggtttctatgatttaccatatcgatataaaatgcctaaaatttatatgtactgcgatgtaatttctttatggatcaatgccgttcaatattcagcttaagttagtcctcctgaagtttaaatcctagcttcgtcactggtgatggtactgtgtgtactttcatcaaggccaaatgccaaaaagtcctatataatctatctattatatactaaaagtctattaaactttctacaaacgctctcatgctactatatggtgctctaaaaacgctctcaagctgccacatggcgttttaataaaatagagaaaatcttaaaaattttgagaaaaagaaaaaaagaatctagccctcgactttcattaaagtttgtggacccattagtttacaccgttagattagatccattataaatagtaatctatccctcctaatttaccatgtaatacttacccaaaaaatattggctggaataagccaagaaggcatacgcacttacagagttaacaaccacaaacgagaaaagaggaaatgatatacagcaaaaaagaaaaaaaaaacatactgcatatatattacttcacttcctctgttttttttataacggctaatgtcaaatatttagtgaaactatcgaaagaaaacaaagattttaaactgatttccaattatacttcctatggacttctttttattttctttatgatgatcaacgtcaaatatttagtgaaggtggtagtaagaaaaatatattacttcataaaagatgcacacccaaaaatagatcgataatataatagaaaatatcaaataaacctatcatttcacactacaattgttgagtatagataaattttatttgcatcaatgggcctacattgatagttcaagatgaaataatgagtaactaaaatattacttgggacatattgtcagaaacacaaataaaaaaagtattgtttaaaaatcacattttttctcaccaaacacagtcaggattttagccgttaatgactcaatctacgcttttgatttgtacatatttttttaagtacataagtaataaatttaagattgagttctaaagtgcttatcaaattggctctccctcatttatcttgagcatgttccgaactattaaactgtgcatgttttgcaaatactttttatactttttttaaaaaaaatctatttcatgtttgtaatattaaatacttaattaatcttacgttgatgacctacatcgtttttcgtgccctggataagctcaaccaatgagatcgaatgtagcctaagtaggagataaattagattatttactataaaatttaaaattaaagaatcaagtgaactacattattaaaaaatcattactttttttatgaaaaaaacaaataagttttttttgtctcctcgctatttcttagctattaaactaaaacagaaacaaacaataatattggatttttctagaaacacagcacgcgcataccctaccccttgagtatcaccaaaaggctgattcgacacattttgagatacgatgttaccatgggcgtctcgatgtcgatgggtacgtcacctaccactgaaacattttgagatacgatgtcaccataagcatatcgctgtcgacgggtacgtcacctaccactgaaagaataattagttgtaaatatgagcacccgtatcaagtataggacttgaaccaggtgggcaagttccaccacaagaaacctaaccaattgatccgctcactttacaataacgttggatattaaaacaaccataatttttaagttacattgttggaatacttctatgccttttaaaccggtgaactattagttatagctgttagatcaatcttatatataagttaagcatgtattcatggtacatgacatctccaaaatattactgcacaattgtattttatcattatcatatttaagttaggttgcatggagcctctcacccaccctacatgaaatgttcatagatgggtcgcctcacaaactacatcaatcgtattaggctatataaacccatatatttagtggagactcatgtcccactcaattcatcctttaatgaactattacaatagatatgcaattaaaaaaaacaccttactttactttcattgacacgttttctaaaataaaaagtctaccttattttcaaattgtaaagaagactataaataattgcttatagatattacttaagtatgatataatataaaactaatttagaaacttattaagcaattaatgccaatgaaaaaaatttacgaacaaatcgcgacagaagttctttgtttaatattttgctcttatacttatctcaaatttagtatacgatgcatgccggcgcgaatacgcgggctaccttcttcctagtttattaataatgaatataagtcagtctggcctccttgaactgtcaaaagaatagtgtgtagtttactatattaattatcataaccatatttctctagcaatctgcagttgtctgtaccaaatgctaaatataaatgcaaccttttactgtctttgcctctggatggatcatacgtcctttgagtagtaccgtgaattagtgttatgtatatgtttatttcttgcactgatccctaatctcagttacgaaccgacactgatgctattttctatggtagtgacagaatcctatcagacagtggtagttattactttgtacgtatcaaactagtaccaaaaccatattaatttatcaacctatacccttccggcaccaactttgttcgtagcacgtaggctgtgtttgttgtgggtggttgggaaaaaacctcctccgcacagaaaacggcgcggtctattagcgcgtgattaattatgtatttgctattttttttaaaatggatcattatgatttttttaagcaaccttcgtatagaaacttgttaaaaaaagtacaccgtttagcagtttgaaaaatatacacacggaatacgagggagagaggttgggaactaggagtaaagaacacaaaccttagacataattctatggctttgtatcgatcttttcatagacctgcaaccataaatattgtgcaagatatatataaaatgaatttgcaggaactccatcaagaaaacctcaggtctccgttcaataaaattccttgcagtcatggtcatcctctcctacaccagtaccggtcatccaacacattcggttttgcattgggaggcattgggaatcctagagatactaagcagtatttgttggtttagcttgcggaggctataacaaggttgattagggtagcactagctagctgctgcattgtttacaacatagctagacagagcaagctagccaacaactactagaaaatggatttttggctactgttccacgttttctcgtgatggctaggaaattgctttcaccaaaaatgaaactttgtaacagctaggatcgatccttcatggaaactgctcttttcgtacaaggaaggataatccagtcaacaaaaatgaaatgtaacacgaaaggtatttgctataaattttttgacatatacttatagataaagcattttcgtagacgtggagggtttttttccccagacggatatgaccctcggagctaaatggccgcctacgaaaatataaaccagggagcttgttgtccgcctgtaaaaatacttttttctaggcggaccaatcaagtcctcgtaagtggtccgcctgaaaaaaatatgatttttgcaagcagaattttacgtggtctgcctgcaaaaataatgccaacaaaaaaatatctaagtcctcgttcttaccatctcctccaccatccttatccttatctcctccactcatttccttctcctcctctctctctctctaccagcagagctgctccgcgctctagcctccacctttctccaccaccgcctcccctcttcgccgcgagtgccgccgccccacctcgccgccacggccacagcctccccttctcgccgcgtcgcgggccctccctcctcgccgcctcctccttctccaccaccgcctccgctgtctctgccaccgcctctgcagccgggctcccctcctcgacgcttccaccgcgccacctcgctcctccgccaccggccgtgatgcgcgatgacgacgacgatgatggcgacgcctatggatctgccattggcttggcccgggcgcgtggatccgccgctggctggtctcggggaggggaggggagctggtggcgacgaggaggagaggcggcggctcacctcctcgctctcccttcgtcgcaccgatgacgatggcgacgacggcgccgcgtgtggtaagcccggacagaggaagagaggcagcgacgcacgacgacggcctcaacgatgtcgccgccagctgttggggaggccagcggacggaggaggagagccatcggccagaggggaggccggcggcggtgccttttttttttatttgctgtgatgtttttcgcaggcgggtgaatctaccgtcaggcaggccattgggccgcctgcaaaaatcatttattttcgcaggcctttgcttctagacggttcgttcccccatgcatctttcccactgagttacttgtctcttttgtttacatgagttttacgcgcaaattgcagtctaatttttttttaagaattatacagtacaatgtagacattcacaacacatgcacactcacccctataaacatactagttatattgtaattacttactagttacattgtagttacattcgtactattaaagtaaataaaatctttgtgtgtgtgtctatatatatagtccccaccaaccgagcaagctaaccatgttgggtacgtaataaaatattatagttacaatgtagttatagtataattacaatatagttatactattatatttgtaactacaacataagtaaacaaattctaattataagcctgttatgaattttttggcagcccagtattgtgggttggtccatcagattgaggcccattagatagttaccgtggcagttactagtgagcagatcttatccaagggttaaaaaaaaacgtgatatatggactccaaaaatctgtcgatagacagctatgtagtcctttccaaccagctcttatgtagttttcatcaaatcatatctctcaatccccctcccactcctccactatatctcattcattagggccatcatgttttttttatccgtaatctcttaaaaattttaaaaatatcttatatttatggacagagtgagtacacaacacgaaatatcatgacaatgaataggtgtgagcgtgactacattggtgcatatatataccgatagtgtagtcgattgcagtgccaaataccaacatctgatacacgtctagcatatcaaagccttataccagtatatataccaccagtccaccacatcgtactgcaggtgagttccagcgttctgtctagctaggttgaacaaattaaaatattgagacaatacttctaatgttacagtaccaatatttttttcttccaattcaatagaaaacaggtagctctgctgtcccagaaaacttgaatatgccacccagtttgccaccatttggtcaggcttgtctgaattactgaatagaaaatggtagctatgctttacatcatgtgcgtgtgtgttatatatgcaaggttatattattctcattggtttggtaggcatcaggaacatctgctcgccatgcaggaagcagaaatgtaatttagcagaggattattgcgagttgtagtgatgcaaaggacagagctggaatggccttagtagcactcttcaaaatgtgccacctagaaagaaatagggcatatcgactgctccatctggatcagtatcatcgctatgaggcaggagtggaagccgagatccctatgtaagaatatgaagaaagatgacgatctgctaaaacctagagacgcgagcgtgatcaaactagttgttctagccagctgaggctatcagcttctaatcatgaccatgaattaacatcaaggcatgtattaaacttaattggaatcgatatcgtaattcttacttttgccttatttccagttccattttttttattttgcaggtatgtgttaaacttttaaagctttttttatattcacttaagctttttttatattcacttaagctttttttattttctgaaatttgtgacgcaaaggacctgtaattgacggttatatatgaccactcttatacattttcatttgaaaaatggctttctcacgtgaaactgtctgcgagtactttgacatgcaaaaattcccatttcaaataccacaatgttatatatgtgggagaaccattaaccatctccggctttgaattatcccaacgcgtactgaggcatatatatatatatatatatatatatatatatatatatatatatatatatatatatatatatatatatatattacacacacacactaattaatgttactggactcggtctgaaaagtgtatttacttcattttgttgatcaaacaacagaagcaaccgcgtcatgcatggaacatatggcaaattactatgatagcagcaatggtttttttaatactatcccaaatattgtcgcaccaagccaaatacattactaaaaactaattttgtagactgatgattaccaatttatacaagtctttaataaaccacctgtgacctaggcctgtaaaaattaatcaacaatttccttatgcatttagaaggaaccgcatgtgacaatcacattttcacagacatctctcttaacgaaatacctgtcaaaatgaattctagtgttagtttgtttctgataatcacaagtcatgcgagaaatgtatgcaagcagctatataggatttggaccataatatgtttactccatgcgtggtctccttgacatcttatctatgaaatacttcattactttgccatgtatgctattcttttgacttcacctctacatacatatttggcgttctaaataacatcaaataaaaatgtcattaactacaaatttcatatttagcgctataaatcagtgcctcctctcttgctctctatactttgcattgatgctgtcatattgagtaatttggtgatctatttgtgcatgcttatatcttgttgatcatcttctagctctagtttataagtagtgtgcaaagtactctatctataagttttattttctctttccataggttttattttttctgtacagggccggattgtcctatcattattagagtgtcaaacagggtttacgattctgataggcccttctgttttgggcactagcggaattcggaatttcacggaatccgatggaaaaccggtaaattccgaataaattttataaattaaaatttgaatacaaatttctgtagaacgagcagttctactctccaagggcctatgagttagtccgttcgttatgattcattctaacaatatatcaactattgcatcctggatggtttggttttttttgataactgaggtacttgcatcacccgtttttcatgtacgcatggcatgtgtggagcagcaaaggtctgtttgcaaatctaaatttgttgcacagaattccattcgtagacattttggtgtataaaagtttctagacttctagtgaaaagcgagaaaacaagttttccaaaggctaatgattatccttggtctgtattttggaggaagatatgctaaatatttgttatggaaatgattcattttataggattgctcgtatgaccaatgtgacacatctccttataacaatgaacaatttttatttcaactatcaaacattcaggcatatggagcatatgattgtgaacattgtgggcatctcaagtaagacgagctagttatcgttgccattcgtatcaaagataatcagctcccacccaagggttttcccttcaagactttactaatggcaagtccttgcagtggttttatttcatcttttgtcttagcttaaagttgcaacagtgaagtctgtacagtgtagctttcatatgcggctcgcaacgtttagccttctgcctttataaggataagtgaaaatttgagttttaaaaaaatttagagatgatttcaggttttcttcacttagccttcaggttataaggataagtaaaaattcgaattttgaaacataattttagagttgatttcaggttttctttgatgtagtttgttttcccgcattttttcaaaatcaataaaggacacgcatataaaagctttacatgtaaattatattttgtcattaataagatgtttcacttataataattataaatgaagagatgagacatacataactataaaaaggcagtctgcttccgtctttgctgcagcaagcaaaaaatatgtaaagctcccaagacgagaggccatatcatgaactgtagtcacctcagatttctcaccgccatttaggagtgggaagctttaggaattctagtatgtctttattgcagtatttgtcttggctccacatacaccaagaaaaaaaacaagtttgtaaactctagggttagcaacagcacagtgcggataggaaatgaaccgcgccctctcactccgttgcatgttcacccggctcagacccctgagtgaagaacggggttcaaccagtccctagcttttgcccttctaggactccgtaacccgaccaagtgctgttggtgatatgccctagaggcaatcatagagatgattgtatcacatactatgtttacatatttatccgagattgtttgcttgaaatagataactcattattggttaacgaatatgtgattctttcatgagactctttatgttgtacgttactatttttaaaggatccctgatcaaatatcatatgtggaacaaatatgtttaaatgatcagcacatgtattaattgatgatcatgtctcatggattatagtatcgagatacaaaattaataatgtggacacatgttggggaacatgttgttggatagacccaacatgagacattgcaagagctatatgcatgtgttgtgtcatcagtgatcacatttagcgttggtgttgaatccttagacctaagattatcatggttcccaacatgataaacgctactgcgtaattgggtagttataaaagtagttttcgggtatgctagaaacatgtagtgggatatgaataatgatgatgggatttgtccctcctatggagagatatctctaggccctatgatgttatagattatagaagtgcatggccatgccaaaggtgattgaggagtcaatcacaagttataaatctatcacaagttcgagtgaatgattgagctattagaggatagcacatatctagccttgagtttaatcgatatcgtgaggcaaaggggttcatacaagtatacactagaggttctgctaggggctgctgttgacacgtggaacgaaaaggtgttttcgggttacagccgagtgtgcatgaacctacagggtcacacgcttaacgggccggaataaggggattggatggagatccaatatgagcttaattcagatagggatccgaataggagtcctacgggccttggaggcccgagtcatggatcctatatattcgtgaggggtgtgacaggcagaggtattgtatcacgtgagaaaccctagccgccactctccttcccgagcaaaaccctagccgcacgcgggtgctagcatttctgcgcgtagtgttctgtccctatatgtgtggataccggtagaggcgctgctgctttgcggtgctgatcagcgtgtgtgtacgacatggagaacgcacgaggaggagaaggtcgagctggtgcgatcgactacttcctctacatcgacgcgcgctacatcgcgagggttccttcgacttcttagcactttcttccgctgctcagcgtgtcgactggtaatgatctatgatctaatgcttgcatggttcctgatttacgcgatagaaaactttgatttatgctgtcgtagcctacgcgtatccaaacacgtgcgtgtgttgagagatcaccgtagggctgtggctgacttaggttggcttatggggactaggattagtttatatattgatgtggaattgcctccagcgaatgagacttgtaattggagtatattttaagtggtaaccatatccagtgaacccatgggtctataaccttgtccccacctccgactccggccctacagggtgaactgcccaacacctgatcggggaaattgccactcctggtaaaacatggtcacaaatatctaatgcaacgtttggctgacaaaatcttggatataattgaagaattttgtgtttccttcgccagaaaccagtcaagctctttgagaaattctcagccatctcatctgccagcgaggacatgcatgcgcaacaaattctctaccatctcgttgacaaatcaacctgtgtgagacgccttcaaattggttctctacattcaactccgtgaagcagctagcatcttaatttttgagattgctgtcgtcgttgatcactacctcctgagatacacctgccatttgatagcaggaaaattgctcggttttgcaatgcacattgttagctttcccatttgatacttcagtgggtaccactctgttttgtcacaactctatcgaaaataccgaaatttgcccctctttaacctctcttcttcgcacccaacccttttccacgtccaaactccagccagcaaccgctgccatgtggaccgcaccaatgcagttggctggccaatgctacacctactctactaccacttgcatctagactctgctcgccatccctaacgtggccgagctcgagctcattccagtcgaaaaatccatcttgagcaattgtcgaccgaaacatgtgaaacttttaggtctccaatttaaatcataatttgaggtaaccttgttcattttgttcaaacaaaacaatcgctatgaaataatgcaaaatgaccgttgtgtaattcatgttatactatgaatgaaaaaattgagtggatggtcgagctggatgtagatgccgcagcagagtgggtgctgccaggcaatgatgggagtggcggcacctgctggacctcaacatgtggttatgctagttatgcctagccaaagttagggacagttaacttcggattggtgtcaaaataaacatttttaaaatttggcaataccaaaattttgataaattgacaacattatcaagatttggtaggattgactcaatataatttgaccaagatttcataggcattaccaatatttggtaacaataaactaaatataaccacatgattaccaattttactaaataatggtatgctgagaaagacccaaaaatgatagagaatcaatgttgaaacagggaaatttggtatttttgatagagttataccaaaagaagaggtaggattgacatttttacaaagccaacgaacctggtggcacacgagcttacgcttc

SEQ ID NO: 16330 - DNA, 7114 bp, Oryza sativa
  unsure (1)..(7114): unsure at all n locations
gagtctagctaggaagattatttgtaatagatggaatgatatctctgttagttttagcttaaggtagcagagtttagagaggtcaattaagtaatggagatctccatagagcgatttaattatgaatgaaatagctctgggtaagatgtgaatgtgcatttctatacatgactcgaacatgtatactctgaaatcttgtacagtggtttattttggcttgtgctgcaggtggtagcatagttaactaggctgcagtttgatgtttcatacagtagttgtcacttgcagtacatgctcttgcatgtgcttctgtaccagctcagaccatatatataactgacggagcaatggataggtcacgcccagaacccagatggccacaacccctgcactattctcacctcacaagtcatgcttagaattgggaagcattgggaatttcattatgtctaattctcactattgggctggaattttgaggcaattttgaccagaatctgcagcagcatgtacgagaaattatcatttcttacaactggcgaacttcggatggaaaaaagttaattaaatggaatattatttctttttttacgttacatgcttcagcgtttttcttccaaaaaaccacagacggaataggggcgtacacattggacgaaatcatcctgtttataatttgataacccataaaattgcccagaggccacgtccattttatctctaccacatattttttaaaaatagatgatgtcgttgattttcatattatgttcgatgattcatcttattaaaaaaatcggtgtaaatgtgctaaagtatatgagttatacactggtggagaaaccatctttggtcggtcggccaaattctacaatagtcccggttccaataaaaatcgggaataaaaatcatctttagtcccggtttaaaagttaaagggtactttttgatctttagtcccagttggtaacacaccaaccgggactaaagatcatttttagtcccggttaaacaagttgtcagggcgtgtcaggccccaattatttttagtcacggttgatataaacaaccgggactaaagatctatctttagtcccggttgtttataccaactgggactaaaatttaccccaagccacgcgatcttttatctcttcgcgcgtcgatctgtgtctccctcctcctctgtcttatccttagcttcttcccatccacttcttctcctcacttcttctcctcttcctccttctcctcctccccttcccctctcctctgtcttcctggcggcagaaaggggcggccggcgcggaggcccggcggcagcggttgcccgcgcggagggcccacggcggtaggcggcggagacgcgaatggcctcccccggcggcggcaggcggcgcctcgggccgcccggcatgggaattttttttctttatttcctttttaatgtgatgtgaatggctgtgatttgtgccatctgtgatttgtgcgatctgtgatttgtgtgatctatgatttgttcgatctgtgatttgtgaatgataatgggagatatgtgatatgtgaagtatctatgatttgctatttgttatttgtgatttgtgatgcgattgtgatttgttagttttataatgatttggaaatactgaacatgagaaaagaaaacaaaggaaaaaaatctttagtcccagttggttacatcaatatgtatctttagtcccggttgtaagggttacggataaggtataccctctatccttgaatatacgctatacatcgatatggtatatctgcgcgtatacggacgttctatgtatacgctaaggaaattcatcacggagtccacagatggaaagattcctacccggataggactgggtcgtcactgtatcgtgtagggtccgatgtctccgaatcctacttagaaaccacctgacctgcggtataaaagggacccccgggaggacctaaggcatcgaatctcatagccaggacaaccaccacagcctacgaagccggagcctacaggagccaagtcgctggtgatctagtcggaacaactcgactacgatctcgtcggtatcatcgagttccactgtgccctttgtaatctatgacttccatcatataatcccatatcaactggattagagctattacctaccaatgggcctgaactagtataatcactgttttttgtttgcttgatgtcgtactacgtagatactcgtaccagcgtaccccaataccctctatatccggtctgcgggtttcccccgtcgacagtgtcgtcttcccggtttataccacggtgccgatctcgactggtccatcaatgaccggaagcgagaacgccgtggctacaaccccggacgactccatgtcgaaggatcctcccgcagaagtggagaatggaacgtcgacgacatccaagcccgaggaggatcctggtgcggtcaaatcttgtccttccgatgagtgtcacaagccgataaggacaacttccgaggtgacaaggtcatggtgtcctattcacaaaaccagaaaacacaccttgcaagcttgcttggtttttctcaacgcacaagctgagatccgcgcctgcaaagagcgtggaattcagcgcacttcgccgagtcgtgatgtctatggttctattcataagacaaagaatcacgacctctcaagctgcaagattcttctcaacgccacgaatctctcctagagatgtgaacaaggaatgaggaacgatggtcatctcagaccgattcgttggggtgatcgacattgatccccacgagccatcagtcctacactcgctcaaggaccagggttcatcgttgacaagcacaccacgcgatgtgtttgctattgaagggaccagcgcgtctgcgcgcgccgatgcggaagcagagaatcaagtggttacaccggcccagcatattggggccatcaacgcaatactgagggaaaccccttatgatcccgttctgaacgatgatctcgcacggtagacagaacgactacgggaatcagtaaccaacctcaacaacgcatttgaggaggccgctgccgcggcacacccagaacaaccgccagctggcggtgcaaatggcgcaccactagaacagcaggcctcaccccgacaagccacccctccacaccacggcaccagcgatctccgtgaccatttaaatggccgccgagaagcacgacgcgcgcaagacaacgagaatcgttcccgacatcgtctctcttcacgacgtcgagagaacgaagagcgaggaggacacccgagcgagaaccgagaccatgataaccgccacaaccaccatgaacgcgatgatcgcgaacagcggatgccgggcgatactggtcccggacgccgccatgacgatgacgatgacggagatcggcgccggaacaacaatggtgtacgacgagaggattcccgagaacccgggcgtcatcctcggaatcgtacaccgaagccgagtgacccatcgtcgtcgtcatcatcctcttcatcctcatcatcagagagacatccgcgaaggacatacgatcgccgacaacccgccgcccccagcgccaggtgtagagctttcaaccgttcgctacgtgatgtccgacggcctgagagattccgactgggagcaatagagaaatacgatgggagtaccgacccagaagaattcctacaggtctactccacggtactctacgctgccggagcagacgacaacgcgttggcaaattatttgccgacggcattgaagggttctgcgcgttcatggctgatgcacctcccgccctactcgatttcttcgtgggcatatctgtggcagcagttcgtcgctaacttccaaggaacttacaagcgccactcgatcgaagacgatctacacgcgttgacatagaatccaggcgaatctttgagggactatgttcggcgctttaatgagtgcagaaatacaatccctgaaatcaccgacgcctctgtgattcgcgctttcaaaaccggtgtcagagatcactatactacccaggagttggcaacaaggtggatcacaactactcgaagattgttcgagatcgtcgatcgatgcattcacgcagacgacgcactgagacgcaagaacgacaagccgaaaacggggggagagaagaaaccagccaaggacacacctgaatcaagcaagaagaaaagtagcaagagtgggaaaaggaaagctcaagcggaagtcctcgcgtcagaatacgagcgccctcccaagcacccagacacacaaggcaacgtcacgaagagaatatggtgccctatacacaagtcagacagacattctctgaaggattgcctagtcttccaaaagtcgttggaaaagcaactggcattagagaagggcaagcgagtacgtgtagtcgagaaggccgctgaggcaaccactcaggactcggactcggcacacccagattccgatctgcatgtctcgcacatgttcggaggttccacggtgtactcctcaaagcgagaatacaagaaagtggagcgtgaagattgttcgacatggcagggggctgcacaaaagatgaagtggtccgaacagaagattgagttctcagatgaggaccatcctaaggctgctgtcatcccaggacgatatccgatcgtggtcgagcctactattcggaatatcaaagtcgcgcgagttctcatagatggcggcagctccatcaacctcctcttcgccagcaccttggacgcgatgggaatcccatgaagcgagttgactcccaccgatcaaccaggtgcacaaagactacaagtgctctagcccagagttatccaagtacctcgcggaggtcaggaagctggaaaaaagatttgatggaatcgaggtccgacatgtataccgcaaggacaatatcgaaccagacgatctggcgcggcgtgcgtccagacgggagccactagaacctagcacctttctggacgtcctgacaaagccatcggtgaaagagtcaaacgacgaaaataacacagtcgcctccgacatcagctcgggggctacataggtagaacgcgccgttgccgacatcgagaccacagacgactggcggatcccactcgttaaattcataagtagcgatgagttgcccgacgacgatgtagaagccgagaaaataacccgctaggccaaaatctactgtatgatcggcaatgatctatacaagaaggcgccaaacagggtacttctcaaatgcgtctcgtccgacgacggcaaacacctcctcgtcgacatgcacgaagggatctgtggatcacatgccgccggtcgtacattggtcagaaaagcctttcgacaaggatttttctagccaactaccctcaaagacgcttgtaacatggtacaatggtgtgaagcttgtcagtttcatagcaaacacacaaagctaccagcccaagcactgcaaaccatccctctcacttggccgttctcgtgctgggggctcgacatactcggaccattcccacgaggacagggtggctacaaattcctgttcgtggcgatcgacaagttcaccaaatggatcgaagcaacactcacaggggaaatcaaggccgacaacgccatcaaattcattaaagggatattttgcagatatggattgcctcaccgcatcataacggacaacggcacccagttcatcagtgccgacttccaggattactgcattggactgggagtcaagatctgcttcgcttcggtctctcaccctcagagcaatggacaggtcgagagggcaaacggcatagtactacaaggaatcaagacccgtgtctacgacagactcatgtcacatgacaagaagtgggtcgaagaactcccttctgtactttgggacgtgcgcatcacatcgacaacgtccaataaggagacacatttcttcctcgtgtacggctcagaggccatgctccccaccgagctacgatatcagagtacacgagtacagaagtactccgacgaggatcaggaggaacagcgaaatgacgatgtgaacctactcgaggaacatcaagaacgagttgtcgtcagagcagctagctaccaacaggcccttcgtcgataccacaagaagcgcatccgagcacgtacgctttcgatcgacgactacatcctccgacaggttcaaagccaagcagggcgaaacaagctctcacccaaatgggaaggaccgtacacgatcacgcaagccctacggccaggcgtattcaagattgcagacggcgatggtcgcgagttggcaaattcttggaacattgatcaattacgtaaattctatgtataaatcaatagcatccattcttgtaagacatcttacagcttcaataaagccttttttcaggaaaagattacaatcaaagtgttccttcccgatgatcccttaacccgatgacacctagcgttgaaacctatcctcatgtccctttacgccatcttgacaaggcctccaaggaacctaagggaacttcggcttgggacgcccagagccgataaggccttgtcggatcctgtagagacgaaagaccatgtaagatctggtcgtgtaagagttctcgccgtgcatattaaccaagccgtgtaatcggaaatcgggttttccaacttcacggctgggggctaggatcagtgcttgttcaaccaaggcaggtcaaaggtccaagagccatatcttccaagaagaattctccgatgacaaggctgggggctagggagagtgtatgactcaagtgactgatcgaagtcacaaagtgagaagacactcgtacacacagcatccagagtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16331 - DNA, 1151 bp, Oryza sativa
ccgcctccatcccgtatccccattacgcggaggaggtatatttgtgccaatattttttatgcatgtatataaacgcaaaatattgaaaaaaatatgtattttcaaatttaattcataaaagtgagttgcactccactttattgtgcattttagaaatgagtgagttcctccttttatagggcaattatgacggttatggatgtcggttcacccacaatcgccattctccatggacctccacgtgaaaagtggagatgagggggcctaaggtcggtttgaccaaatccctggttcgaccgacctgtgggtcttaccactctctactaggggtgaaaacggtatggaaactttccggattccagacctattttcgaaaacggaatctgtcggtcagaatttttttggaatttttcggaaaccaaaatgaattcggaaatattttctcgcaaatggaatcggaaattataagcgcagtttccatcggaactcggaatcggtcggaaactttccgaaaattttctcggaatttttggaaattgtctcggagttatcagaaattttgtgactgcaataccctggattctttttttaagcactaaatagcgaataccatagtgtttggctgttacctttttcaaaaatatttgttatgcaaatctaaaattacataagaatatttttttcctacattgggatttattaacaacattactcttttgaacatagataatttattcaattggatttatcagtttgagaggttttttattccgataatttttcgttaccgtattcgcgccggttcgttttagctccgttttttgtttcgataatattcgattctgttttcgtatccggtgttccattccgattctgattcccgaaaaaaaatatgaaaacaaaaacgataaagacggtttccgtccgtttccgtaccgttttcacccctactctctaccgtctttcaacccattaaatttgatattatattttgtgttcttttatgcaggagttagataactcccggatctaatgttttatcccaaattattctataatttatttatgattatataggtatatagccagctacaacgtaagaaacatgttagtattactactcaaatactccctccgtattttaatgtatg

SEQ ID NO: 16332 - DNA, 2541 bp, Oryza sativa
gctgatctcggcgcttcttacagaagtgaaaggtgaattggcttccccgggcagatgcaattttgttaggaacgccatggagactcacgatcctaccgaagtagagctcggatagtttgttccctccataggtggtcttcacaagaataaaccgagctaccttggttagtcggtccacaactacccatatagaatcatatccgtcttgggtttttggaagtccggtgatgaaatccatcccaatttcatcccatttacattctggtacttggagaggttggagaagtccggccggtcgttggtgctctgccttgacacgctggcacacatcattcgtaaagcaacattctgaacccctatagaaggcatcggtgtaaaaacaagaggaacttccaatagccgaatccgaatcaaatccttccacatcatctgtgtcggctaaggaatcctctcccaagccatcagcaccgaagaacgaagaatttcaatcttcgggatgcgctctagactttagggatggtcttcataacgatcatgagaacaccttgacggacatccctcctggtaatgctcccatagaggaagtaatggcgattctgcttcatgagtcccctgaatcccttttagaacaggatgtttatcatttcattcaaaaagaagattccggcgagacccttgaagtgttatccatagaaccaccatcgcaacctcatctcgagcctaaaccttgtccctctggccctcgagatgttgttcttgatagttgtcaggaaacaacctcgatcatgcacgacacatcctttggcaaggagaaccttcaggccatggacaagcttgagacatcagctctggtggacaagagaaatcactccacaaatgagcatgaaaccttctctttcaaaatccctcatgattcatgctcatataaggaaaccccagactcctgttcgattagtactaccccctcgtgcaaggaccacaaccactttacaatttttttttccacatgttaaaaaaggggtctggaacctttatttatcataaatctgcagatctcgtatatgttttcacactaatcttacatgatgatgtcccaaaggtaagcttaagtgtcacgcccggaatttctatccaaaattccaaacgcttacatgtgtgtgaaccctcgtccaggaatcagccgaggcacacaataacaaattgataatagagtacaattattactctaattaataagcgtataaaatgtcattacagaggtagatagttcctctcaatcaataaagatctaagcagcggaaaaataaattaaacggcgtagacggcttcactccacaggcagcttgaccaaggctacacctactcctccacaccatcagcctcattgaagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttcagaatttaataaaacagttaagtaataattaaacaatattaatccaacactatacaacataccctgttgtataggcccaaccattctgtacaaccataccggctgcacagttctatctccaaaccaggaatataccattccaaaccaggagctaatcaaattattaccaattatagcatcattcactaaggtgagaagtgtgaaactaatcacgaaagacattgttagacccgcccataaccgcgggcatggctattcgaatagttttactctggccagaggtgtaccactgtacccacaagacacaaccccacattatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacatttcagtctggcgccccgcaatgaaccatgctatacaaaagataaagccgttgcccatgctggcttgtggttggcatggttaatgtttcacaaccgaaacttgtgaaccggtccttaattgtcatgagcacgaccatcaaaaccatgtgctcacaacccaccattaccaggttttagttggcacattaattaattaactaatcacgattgaccatcgtgaactatcattaagccatcattaaataatagtgagtcataagttatcccgaatgtgtactaatgtttctaagcaagctaagcaattatatctaatatctagttgaactaatataaataaagctcaactagttaaattgtaataacccaaggtatcaaggaatgtagtaatcaagtacaaaagggccataacaaagaatatgttaattccacccaatgacattcgaaaataaatgcaatagttgaatagaaacaatagctttaaataggatcaacatgctcaaagggttgtttgggatctgtgtgacttgcc

SEQ ID NO: 16333 - DNA, 3005 bp, Oryza sativa
ttcccctgtatcaattcggccggagaaggaaagggacggccggattggaaagcggcggcggcggcgcgaaactagggtttcggcccgaggaagacgacgggcctgacaggtgggacccacctgtcagcgacagcgagggcgcgcgcgcgcggcagctgcggactgggccggactgggccgaggagagagagagcggttttgggccgactttcggcccaaagccaaaagagactttttaaaacctttttcaatttaaattatttcttaaatgcaattccatttattaaaaatacttccttagctcaaataaatcccagaaaaaatctaggaattatagaattaagcaaagtatttaatgaaattttatctggccccattttatattggaatttattaattaaaattagatcttttcttcaagacttttaaaattatttctaaaaattccaattaaacaacaatttataaattttgaattttcagggtgtgacaaacctaccccccttaaacagaatctcgtcctcgagattcggaagaactggcgaacagatgcggatgagctgacttcaattcatcttctcgttcccaagttgattcttcttccgagtgattactccactggactttgcaaaaacggataactcgattcctggttcttctctcatttgtttccaagatacggattggtttctcaacataggtcaaatcctcttggacttctatctgctcaatattagcttcttcggtaggtacccttaaacactttttcaattgtgacacatggaacacattatagactcctgccaaagattgaggtaattctaactgataagcaacctctcctcttctactgacaatcttataaggtcccacaaaacgcggtgccaattttcctttggtgtgaaaacgatgaactcctcgaagaggcgtgacacgaagatacacataatctccttcttcaaaactcaaatctctacggcgattgtcggcataactcttatgacgagactgagccacacgcaatctttcttgaatgatctttaccttttcttctgcttctcttaagatatccgtcccgaaaacctgacgttctcccgtttgatcccacaaaagcggagtgcgacacttccgaccatacagtgcttcgtaaggagccatctgaagactagcttgataactgttgttatacgagaattctgcataaggtagattcttatcccaacttccaccgaaatctaaagcacaagctctcaacatgtcttccaaaatctgattcaccctttcggtttgtccgtctgtctgtggatgataagcagtactaaagttcagcttagaacccatttcttcctgaagtttcttccagaaatttgaagtaaactgactgcctcgatcagacactattttcttagggacaccatgcaaacacacaatccttgccatatataattctgccaaccgacttccggaataagttgtctttaccgggatgaaatgtgccactttggtaagtctgtcgactattacccaaatagagtcatggcctgatgacgttctgggtaaaccagtgataaaatccataccgatttcttcccatttccattcaggaatcttcaaaggctgcaacaaaccggcaggtttctgatgttctgccttgactcgctggcaaatatcacataccgctacgtattctgcgatttcacgcttcatacttgcccaccaaaatctttccttgagatcctggtacatcttagtactaccagggtgaatggagtataaagtatcatgagcttctttcagaattgcatcctttaaatctttgttgtcagggacacaaattctctcgcccaaccatacagttccttgctcatcctccaagaaaccgatagcttttcctcttctcatattcttcttgatctcttgaatatcaggatcactaatttgagcttctctaacttgatcaattagtgtgggcttcgcttctaaggctgcaacaaaacctctactgacaattcccaaatttaatctttcaaattccttgcataattccaatggcagctgtcatccttcggtagcattgcaataacctttcctgctaagagcgtctgctacaacattagcctttcccgggtgataatgaattcccatgtcataatccttaattaattccaactatctcctttgtctcatgttcagatccggctgagtaaagatatactttaaactcttgtgatcggtatacacctctgtacgagtaccgaaaagataatgatgccaaattttcaacgcatgaactactgcggccaattcaagatcatgagtagggtagttcttttcatgcggacgtaactgacgagatgcataggcaaccaccttcccatcttgcatcagaacacaacctaacccaagtttagatgcatcgcaatacacttggaaacccttctttggatcaggcaaaatcaaaataggagctgatattaaacgacttttcaactcttgaaaactctgctcacattcttccgaccacttgtacttcacatatttctgaagcaggcgtgtcatgggcttagcaatcttggaaaaattctctataaaccttcgataatatcttgcgaggcctagaaaactgtgaatctctgaaactgtctttggttgcttccaattggttacggattccacgttagtaggatcgacggcaactcctccggctgagatgacgtgaccaaggaatttcacttcagacaaccaaaattcacacttgctaaacttagcatacagttgatgctctcgtagcttctccaatgcaaggcgaagatgttcttcatgctcttctttggttcgggagtagataagaatgtcatcaataaagaccaccacgaacttgtctaggtattccataaatactttattcatcaagttcatgaagaaagcaggagcattggtaagtccaaaagacatgacgtacattcgaacaacccatacctagtggtaaaagcggttttaggtat

SEQ ID NO: 16334 - DNA, 2845 bp, Oryza sativa
gaccatcattgctgatgagagttacttttctgttggcacagtctatcacacctttatgtttggctaaccagtccatccctagaatgacgtcaaggtctttagattctaacaagataagattggctagaaatggtaccccttgaatttctattctgacagaggggctacgttgcagagagagtgcttgattacttggggtactaaccatcaaaggacgtctaagatcttctacttccatcccatgatttcccgcaaaactcatagataagaatgaatgtgtagcactagaatcgaaaagcacagttgcaggaactgagttaacagggaacgtacccaaaatcacatctggagcatcttgagcttctgcagcagcaacatgattgacacgggcctttgatgctggtacagcagagttattctgggcagggacaaccttcacgcgtcggggcttcggacacttgtcagcataatgtcctgggtctccatagttgaaacacaccacgggcttgctgccttgcttcctcttggcaggttgttgctgtgtcgaggcagcaacaggacgtgggacttgattacggatgttgttgccagcattgttgttgaagaactgacgctgcggacgaacaatggacgaagaacctccctgtggcacagactggggtcctaaagtaagacgcggcttctgattactcccctgttgtgccttgaagtgagcaatccggcgtttcttctgctccatgcgattgtacttgtcctcctgacgtatagccttatccactaatttctggaaatcaggataatctccaaccatgagtgggtaagaaagctcatcattaagtcctcccaaaaacttctcctggcgctcttcatcattgcgcagatcttccggagcataacgagcaagacgattgaactcgtgcagatactccgtaacagagcgagatccctgggtgagcgacctgaactccttcttcttgagagacaccactcccgatggtatatgcgtcttccggaaagcagcggtgaattcaagccaagtaataggttcagcagtaatcctattcaggcggaagtgatcccaccattcagaggcagggccaagcaactgatgtgatgcaaatgagaccttctcctgatcagtgcactgaagcaaatccatcttcttctctatggcatgcaaccaatcaccagcttcaacaggattagtggtactagagaaaataggcggcctcacacgaagaaattctgctaacttgttctggggaggtgcatggttatttccttggttttgctgattctgaagttgctgcatcatcatgttcattaactgagtctgttgagcaagaacttgagcaagtgttgggttctctccattgttgttgttattgttgctgttggggccattcccgttgctgcgagtgagcaccatctggcagggcacaagaagagaaaccgggggaaactacttaggatagagaattactttaacttttattgatcttaactgagtttcattattacaaactgaagactctcacaccactaaactcaccaacttcctaacactcaaaagcaaacaaacgcatgcacttacatcccaccactgatgtaaatcacatgcgagacacacacaagcaaacttaaagcaagcaaactaacacaacgatctaagacaacgacttaacaagtcactctagttcttccgagcatcggaggtcgattgtaggctcgttcggctcgtcttcatcatcttgagttgctacccactcaatcttggaatgggtgcgcttggattcttcttcttcatcatcacttatgatgatgaccggaggatctgctggggcaacttctttctccaccacacgaacttttggcgccaattgatagcgagggacaaatagagctctcttccttgcggtaagacgaatcctggccttctgcggtggtgcttctcccttcaacgcggctagttccttctccaaacgatccaccttgtcttctaacttgcaaatcttaccacgattccaatcttcacgatcttgagccgctaacacagtctctgcacggctttcatccatagcccacagcatctcaactaaatgccttgtggtagcatcattctcaattccttcagtctcaaggtagctgccacggtcacttccctgtggttgacgaggatggtagcgatactcagtgtcagccaaccgatcactgtagcgatcacggagctctcctatggcgatccttgccacttcctgacatgcatggatgtagtttcttcctccagcttcgaacatcactgaggggacatcttcactattactattcaaggtgactttgactcggcacttctcttcatgacgatcatgaggaatctgagcataaaaaggggcagtcccaaatcctatgacaaaggacatcgtacgcaactcctggacaaaaccctcaacaccaaacaggtactcaggcttgtagcgcggcatctaaagacaagtgaaaggagggagttaagacatctatccaattaacagcacaagtttttggattaatttgaataaagtttagaaaaatcagagtaaaaaggtaagtaaataaagtaaaccaaacttgcaagataagttaaaacagttggaaacaaggtcacaaattttgtacttttgaataacaggtttcaaaagaaataaaagaaagttataaaatcaacatgctaactttattttattgcagcaagattaaataaaacaatattgtaaaacttttgctgataaataagccattagtacagtaatagatgtacggtactaataacactggaataaattttgaatgagaaccattaaaaggg

SEQ ID NO: 16335 - DNA, 596 bp, Oryza sativa
gcgtaattaggctcaaaatatttatcttgcaaattaatcgcaatatgtgcaattagttattttttagcctatatttaatacttaatgcaggggttcaaacgttcgatgtgacggggtgtaaaagttttttttacgttggatctaaaatttttagtggtagtcttcaattcaaaacacgtccaatcacaagaacagtttaaccatcacatcgaaggtacagaacacaaacatcgacggatccaaactcatcaacctgaccccgaatcccactgccacacgggccccaaatcccacggcccacatccccccacccacaccacaggccgcggatacttcactggattcccaatccgacccaacccaactggcacgccaggcacaccaagtaccccaccaccaaccagggccccacactcccaaactcctcccacccgcacgccgccgttgccacagaagatccacgcccagttctacgccacctatgaacacgcgcgcacacacgccgcgcacatacatgatcaaatctcattcgctcgccaacgccgcaagatcgagcgaaccccagcgaatccgagcgcccacgcagccacatccca

SEQ ID NO: 16336 - DNA, 434 bp, Oryza sativa
ccgtaagcctccgccgaagcggcagcagctggaggaggaggttcctgtgccggttatggcgccgcctcctgttctgccaccaccactgccacacagcgagctaacaatgggtactggtgggatgtatggcgagccgttgctgtccccctcttcccggagaggactggcagaccatcggctgttccgaggatttctgcatcagaggttgcgcggagatattatgagcccccacaagttatgctacctccgttggcaccaatgcagctcacacgagctgagcaccgggtgattgattctgtggaacgactgataggggagccgctccgggaggatgggccagtgcttggtgtcgagtttgatcctctccctcctggcgcatttggggcgcctattggtatgtttttcatgcccatgatgcttccatcctgcatttt

SEQ ID NO: 16337 - DNA, 28452 bp, Oryza sativa
  unsure (1)..(28452): unsure at all n locations
ttaaatgaagaaaatcgcaaatattcatttaaagagcatagaaacttcaaatggccataacttgaccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcgaaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatctagccatgcctaattacctttgttatgaccttattattattgttattgttagtatttccttgttcaccctagatcaaacaaaaccccaactagtggacactctactcatggtaccactagcatgattttaggtagatgcttcgctgtttaattaggtaacattaggtggttttacaactctagactttgggaatattcatatcacctggacactttggaactattggattatcgtggaattggcttcacacctccccctctattcaaaatccccaaaatggttttaggctgggctcggggtgcatggttttgatagtagcacctcggccatataaggaccggtcttcgggcctctgttgcaaagcactacggtactttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggtgttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgaccaatgtacccaagttagtgttttaattcttaaaacctgcttaacaactaaaatgtggaatggttggcctgggttggcttgggacgagctgggacccagggtcgggttgccagttcggtctgaaatcatcgtaggccttgggttaaggcaggttcgtgtgggttcacggccttgataaataatattgtatagtactagattcgtgtttgcaaaatagccctgagcaactaaatatctttaaatgctgtttactgcaaccctaacccctttatagtataactcctttgtactcccttgcatttattcagcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtgtgtctttgtgtgtgctgggccttcgctgcccatgtaataaattatctatttacgcttccgcttgttaaactctgaattgtatcaacttttggtgtaccttgcctcctgggacaaggattaatgcacgcacacaaggaacgcccgttgggtcagttccggtcgtgacataatgtttctaagcaggctaagcaattatatctaatatctagttgaaccaatataaataaagctcaactagtcaaattgtaataacccaaggtatgaaggaatgaagtaatcaagtacaaaagggccataacaaagaataggttaattccacccaatgacattcgaaaataaatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagaacaaaatcaccaaaacagcacataaaaaagcatgaacagtacatgtggatatttttaatgtgtagatctcaattttagaaaaatttagagacttgaaccaactaaatcggagctaagatgaattagttatgaatttttaaagattaaatcggattaaaacacttatatcggcttaaattgaattatgacgcaataatgaattatttttgaaaaggaaaagaaggtttattgcgtcagcgggctagggtttcggtggaccgggcgcacgggcggcggttcacacgaacggacggccgagatcaacttgatccaaaacggacggccgagatcgatcgggtccacggcggctcacggcggacgaccccgatgacgtcagcggtgacatcaccgacagcggcggcggctcggcggaggagacggctcgaacggcgcacgctcgtcggcgaacggcgatgctaggacgcaaacagagggcaccaagacggagaggacaacgcggcgaactcaccggtgacctaaacggcggcggaagaccaacggacggtgacggcgacgaggaggaagcggcgggaaccttcgggtcgacgacggcgatgctgctccggtgatctccggcgacagcgaagaggcggacgaggacggcgacgacttggcgagcacgacggtggtcttcccgagcgacggcgacggctgaaacgacggcggcgcacggctggagcggcgacggcgacggcaaagctagggcacacggcgctagagcgattccgacgacgtgaggcgaaggcgagggtggcgacgggtagaggagacaccgggggtccttttaaaggggctcggaggtgacggcaaaggcccacggcggccggcggcgaggaaggaaagatcgggaagaatgaatccgagacaaactcgaatccaacgctttccaaaacgatttagccaaagattccaaaggagaaaaggtagaggagatcccggagatcatttcccctctatcaattcggccggagaaggaaagggacggccggattggaaagcggcggcggcggcgcgaaactagggtttcggcccgaggaagacgacgggcctgacaggtgggacccacctgtcagcgacagcgagggcgcgcgcgcgcggcggctgcggactgggccggactgggccgaggagagagagagcggttttgggccgactttcggcccaaagccaaaagagactttttaaaacctttttcaatttaaattatttcttaaatgcaattccatttattaaaaatacttccttagctcaaataaatcccagaaaaaatctaggaattatagaattaagcaaagtatttaatgaaattttatctggccccattttatattggaatttattaattaaaattagatcttttcttcaagacttttaaaattatttctaaaaattccaattaaacaacaatttataaattttgaattttcagggtgtgacattaagaccataaacaaagcactgccgggagatacccggattatctttgtaagttttctttccaataaaagcaagaaactgtgtttaagatagtgtacacattcgggtattcttggtcgctaaccatttcacgttgagattaagagcgagggtcatacgatgcctaagaacacgggagccacatcaaccgtacaccatggtgatccttggtaatgcgatacgctttataagaggccccagtatcacatacttggtttttgacgtctcatgacacaaaagaccaagtgtgggggagggaggtctacgagcttgcatgaagaattccatcaaccaagaccatcttggtttacagttggtgttagtcttaccttgctgaaaaaaggaaaaaaaagagaaaaaaaaaggagagacaacaaaaaaatgaaaaaaaaagatgggagaagaggaagagagcaagagagctgacgggctacatttagatcaaagaatgcattatgtgtgagtctttaaaaaatggctatacaccttgctggtagcgatcatgatgcctggctacacccagcctctctcttgagctcatgtgttgccttggcttagccttcatccactcctagctgtgcacaactcctcactcttgcatcacctactcgcacacaagcaagaggagatgcactcttcttttctaggtgttttctgctccactccagttggtacttgcatatttgctcaaaaagagatgcatcctacgtctctacaacattgtaccaacggagagaatttaacttccaatctcttcacccagcgaaataaataaaataagatgtgtgggcgtgccagtgtactaagtacacaaaataaaatagaagaaggaaaatgcattttattataattcttgaagaattacaaaaatacaaaaatccttggtcaaatgcgctccacagctcattgacgaggtggatctgacttggcgactgtgttctcatggttcccggggtctcggaaaacacccggttaattactctcgcgggttagaccgcgagacacctcaaattaagctacgctggtcgtcgtcgtcggtcttcgcttcacattctcccatgcatgattgtgatggtggtgatggtgtcgatgtgtgtgggcgctagtagcggttcacggcctcgtcggtccgtgcgccggtgtaggtgacatcgacttcatatagactccacttgtccgtgccatttagcctcatcagtcttaaaaagcgtatgtagttggcataggttttttggttgtaagcactaggaggctggtacaactcttcttgaccgtcttggtgccatgtcaatagtgggagaataattgggagagaacattgaccaatcgttttgctcgattatcgtcgcggtaggtctctggctcggtgtagaggtacatgttggtatggccttcagtcgaccaatcaccgtgacactcgggatagcgctgcttttctggtttctagcacaatggctgaagatcattgtggtacaggagtatgccttccgatcattgcactgcacactcaagattaagtgattttaggggatgttaggggcgtagcctagcccgggaacgatgagatacgttctaggaactgggtggccctcttgtatatgtgcctgacaatcggagccgaacccaaattttgttgggtcgcctccgatcgtagtggcttaactcgggagtgcaccgacgacggccacgacgaaatcatacgtcatgtgtatgggcgttgtggagtgagagacatcggtggggatgccgaactcgtgatcactagatggtgaggtgaggattcatgtgaggatgacgccagtggcagcgacaagttgaagaacttcgccggcagcagtcgagcagcagacggtggtgcatatgcatagatatatgtatatatatccaagaatttcgtcattggacagccggggtcgtcgagcgtgacgacagcgtgagacggacgcgaggtcattaccagcccgcggtgatgccaagaatgttcgtgaaaacagctagtggctccaaacttgcacgttggcgacgaatgcacgattggtaccggcaacgacgacaagaacgggcttgtcattggcggagaaacaatcagtgcgggcgatgatgaccagaaacaggttcgccatcggtgatagccgcaaggataaatgtatgccaatgatcgttgaagatgacgaggatacgtcctgtttgtggacgagatcgcatcaccggcatcgatgacaatcatgaagacgcctcggcggtgcgggtctgagagtatgatcggcgacggcaacgattcggcaatcatcgtcgatggcggtgtacatataaagattttgtcatcgagcggtcaagaccggcgagcatgacaccgtatttgtgggtatgaggatgatcccgacgtgccgaagcgaaagcgtcgtggaaggatggcacgacgacctcagccagctaaagcgaagggatcatggctggacttggcgacgatcgtgcaagcaccaagcaatggcgctccggcattcttctcaggtggctcgacaattataacatgaggaagatcatagcattggcgaggatgatttagtagacatcggcggcaacccgcagaggctacgatgagcgtgggggacagagggcgtcaccgattagtagtctttgtggggcatctctgcccagcaaggctgcatcatgacaggtgccggcacatatagtctgacaataccatcgcggcttgtggatgatatgttaacgacctccgggtatcggcaaccaaccccttggcaacctgagaatggccttctccggtgggcatcggatggtgatggggacaagcgttagttggcaacgcctcatcgtctatggatttgggcggcttagcggcgtccacgggacaacggcaactccaacgagatggctcaagacgcaaccagagctaatgacgcctttgtcagaaaaaaactcacgcgaactggctctcagtctctctaaaacacacactctgacgcttgtaggtgcagctacagctaactgaagaagttccgaaaatacagagtcgtacagaacaactgacgaacagagttggcgctgcgtaatacagtgcagctttttcggttttctcttctatttattcatctccacacagattttgttacatgtataatagaatcaaatcatgacaatctcggatcaactactgaccgcgccatcccacgatccgagccgagtcattgcagctaaagaaggaagcaaatatgctaaaacagaaaaatgctattctactggctagaattcagactccaacagaactctacatgcaacgaaacaaaagagaatataaatgctcaagattacaatccaacaattcaccccctaatcttgaagcatcagactggaactaatcccagcttgcctctcaactccaaaaatcgaatcttaccaagaggctttgttaaaatatctgcatgttgctcctctaaccttatgtattccacctccacccgtttctgatcaacacaatcccagatgaaataaaactttgtatcaatatgtttactgcgatcatgaagcacaggattcttcaagagacttatagcagacttgttatcaaccttgatcagtgcacaaccaggttcttggccttccaactcacctattggtcgagccagccacactccttgtacagcagcagttgcagcagctatatattcagcctcacacgaagatattgctaccaccttttgtttttgtgactgccaactgatcaaactgtctcccaatttaaatagaactccggttgtactctttctatcatcaatatccccagccatatcactgtcactatagccattcagctgaggaacctgttgttgcttctttctgaattccaccccgagattcagagtacctgccacatacctcaaaactacctgggtggcctgcgcaattgcgcggctagcacccaaacaaaatcatatattttttagtattattctacttaaaatttattaaatagctatctcattgtcttaagactttgaaagaccaaaccttatcatcctcgtgtttctaattatatagtttttaaaagttacaccagtatcatcctcgtgtttctaattatatagtttttaaaagtcacaccagttgctacctcctatgtcatctctttctttatttgcttactcgatctatcactatttctattcattctttctggaacctttaaaatttggattttatagttttagagtttattgtcatatagggtttcgtttttataatttccagatgtcccgtcaaacgttgcgattatactcctctacgacccgtccactgtctcttctctttattgtcattgagatttgtcacgtcccaaaacgaccctaaaatatatcctttaaattatgcctagaataattaaaatccgtgtgaaagcctccaaaaattaaaatgtgcaaagtaaaagtcaaacaaggcttagaggatttttgtatatttcctaaaagcctgaaatgtgtaaataaattttagtggaattttcggagcacaaaaaaataattaagaaataaataaagttaaaaaggttttataaaaaaagaaaaaccctaaaagtcccccttccctcctttgggccggctcggcccatctccctctcccccctctctctctctctcctctcccccgcagcccattcggcctccctccccgcgcgcgcaccgctgacaggcgggcccgcccgccaccctcactgacgggtggggcccacccatcatccccgtcctcccgccgctcctgccgccccgcccgcgccaagcgccaccgccgccgccaaatccgccacataccgtcgtccccgcgtgcaataaagtggggggaaatactccccatgattccctctccctttccccccatttttccctctctcgcgttcaaacgggcggatttgcccccgcaaatctcgccgccgccattgatggcggccgaacctcccgcgccggtttccttcctccccagccgctctctccccttccaaccctatttaaacccttcccgcacctcctccgttcgtttccgcctctcgccgcccttcctcctcgccggattcgagctcgcgacgtcgctctctctctccgccatcgccgccgagctccggtccgccgccgtcgtcgccccggaccgcctcccacctcggcgccgcctccttcggcttcgccgcatccttgccgacctcgtccacctctccgtttcggtcgccgaccgccggagcgctgccgtccccgtcgacccgagccttgccaccgcctccctccgctctggccgcctcctccgtcgccgccgtcgcctcggggtgagttgtggaccgtcgcctcctttcccccttccctcccctctctcggccgccgctccgccgagctgatggtctccgggcgagggaagccgcctcccgtcgaccgcgccggcatggccgccctcgggcgcgccgagtggctgccgcgtggggcccggctgtcagccgcccgcgcgctcgggtgcggctgacgtgtggggcccacggcgccggccggcgtgagccagggtgcacccggtccaccgtggaccgtgaggctgccgcgtgggccccactcccatggacccggtccgcgcaccccctccccctcggctgacgcaataaaccctttttaaattaaaatttaaataaagaaattcgcaaatattcatttaaatagcatataaacttcaaatggccataacttggccatttgaactcggaattggaccattcaagtctctaatttttccttaagaagtcaagaacccatttttgtgctttgtttctgcttgttatatggagtttattagagtaaaagccttttcttttctgttggtcgtgtagacgctgcagcttcggaagatccgctcttcgtggaggttgaagccgacgtttgggaaagggagcaaggaaagtcacatcatccttgaacatattgaatcccaatttataaaattattttgatttaaattattgcattatcgctttatttaaattcccgcgttatcattgttttatttagccatgcctatttacctttgttatgaccttattattattgctattgttattattaccttgttcaccctagaataaaccaaaccccaactagtggacactctactcatggtaccactagtatgaatttaggtagatgcttcgccgcttaattaggcaacattaggtggttttacaactctagactttgggaatattcatatcacctggacattatggaatggttcaattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtttgattataaacaaaagtacccggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggaggttccggccgtaggtagggttgggtcggtactcttgtctatggctaggatgggttggaaactatgtcatgtcttccgtctgtataccatggtggtatgtggcacgtggttacatgtgaggaagatgtgtcttgtgggtaaagatctacacctctgatcagagtataacctattcgaatagccgcgccctcggttatgggcaagccgagcaatgtaccaaagttagtgttttaattcttaaaaccttcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctagggacatatttacaaaatagctttgagcaactaagtgtcttttaatgctgtttactgcaaaccctaacccctatattatggctcccttgtactcccttccatttattctgcacttatgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtctttcgctgttttttgtttgtcttcttgtgtgctgggccttcgctgcccatgtaataaattaactatttacgcttccgcttgataaactctgaaatgtatcaacttttggtgtaccttgcctcctcggacaaggaataatacacgcacgtaaggaacgcccgttgggttatttccggtcgtgacaagattttaaaaatcaaacataattatcgtttgggttcatttttactttaagtcccgtcaaaccgtcagcggctttgctattgtactcttctacggctcgcccgctgcctcctttctttattgtcgttgagattttaaaatcgaacatgattatcattaggtttttttactttttggaagttccgatcctttaaaatttgaacgatgccactatgcccctctacagcccgtctgtcgcctactctttattgtcattgtgattctaaagatcgaacataactattgttgaaattcattttttattttctataactcttatacgcccgcccgctgcttctccttttatgtcattgaaattttaaaaatcgaatatgattatcaatggggtttatttttttactttctagaagtcccggcaaccgccttacttgtttgcttcacagcctgcctgacgtccctccttttaatcgtcattaggattctatttgttgttttattaacatttctaatttcagaacttatttttttaaaaaaattagttaataccgtattgtgttctttaaatgtttttattttttttatttttaatttcagttgtttcaaaattgtattcctacttaaactctcttttagtttttcaaattttagatattattttattttttatttgaaattttaattaatctcgtattgggttcttatacggattcttctttcaacattgcttatttttaattccgaatttcagctaattttaaattgaatttctacttgaactcttcttttattttcttttgctaattttgaatttatttttatttttattctgaattttaattaatctcgtattgggttcttatatggactcttcttttaatattccttatttttaattccgaatttcagctatttttaaattgtattccaacttgaactcttctttccttttctaattttggattttattttaattttatttcgaattttggttaatctcggattgggttcttatatggacacttcttttaatattgcttagttttaattccgaatttcagctatttttaaattgtatttctacttgggctctcctttccatttctaatttcggattttttttatttttattccgaattttaattaatctcgtattgggttcttatatggactcttcttttaatatttcttatttttaatttcgaatttcagctatttttaaattggacttctacttggactctcctttccttttctaattttagattttattttttttattttaaattttggttaatctcatattgggttcttatatggaaacttctttcaatatttcttatttttaattccgaatttcaggtatttttaaattagacttctacttggactctcctttttctttttttctttttcttcgattaatgtgggaatttctagcccccacagcgaacgtggtgcctcctttcaaggctgttttaataatataatagatagatatgtttcatggcagcccaatgttcagaggtcggtttctccataaacctgctaacataaccaaccgaataacttagatgaggtcttgtgttcaccaagtacctcaagctcccaattatgcttctgaattgagtttcctccatacattctcctccctcctttctcaacttcaaccgagcatccatgggagtctgacatggattacaatccctcatcccagctttgtcaagtatctttgctgcatatgcaccttgagacactgtgatcccttcctttgcatgtttcacctccatcccgagataataagagagcagaccgagatcactcattttaaaaagagcctgcatctgctccttaaacttgtttatttccatcagacttgctcctgtagtaatgagatcatccacatatacaccaaccacaagtcatgagttcttctctcctcgagtatacacagcacttttgacaccactcttgacaaaattcaggctcacaagactagaatccaacttcgcataacatgcacgtggtgcttgtttcagtccatatagggccttcttcaatttcaacaccttgtcttcttttccatcaacaacaaaaccaggtggttgaaccacctaagcatcttcttccaattccctattcaagaaagctaatttcacatccatctgatgaacttcccatccctgatgagcagccgttgcaatcagcaatcgcacagtctccatcctcgtcactggggcaaatacttcatcaaaatcaactccttgttgatggacatatccctttgccaccaatcgagctttgtacttcacaatgacatctttggcatcacgtttgattttgtaaacccatttcagtcctgttgctctgtggctagagggcaaatcatagagagtccaggtgttgttaccttcaattgattccatctcttcaagcatggccttcctccagcagctctcctgctcagcctccaagaaacttgctggttcctctgctgccataaggcattgatcactgtaattaaaatctaggattggggtcaaggtggcaagcgtgttcaccactgttctgtagctcctgggcccttcatcagtcccttcactagcatcagttggaggggaacagaattcaacaccagatggcagagttgttgcagttccggtgcttgatgttggtgatgttgctagcatggttggagtggctgctgcatcctgggcatgtgtctcactcccttggactgggattgtgaaattctccaccgtaaactccacatacgcgtcctgatctccttcttcatcagtgttgctgccccagtcccagaacgtcgtctcataaaaaaacgacgtcgcgtgacacacacacgcgtcgcaccacaaaatcatacatcttgtaggcttttgatccttgctcgtagccgatgaagaccatcctcgtgctacgatcatcaagctttctcaagtttggcttggctgtcttaacatagcccacacactcaaacacacgcaggtgttcgacagtgggtcggcgaccataccacgcttcatacggcgtcaccccatcaagactcttcattggtgatttgctcaagacatagacggctgcaaccaccgcctctccccagaaatatgccagcatgtttgccgccttcagcatggacctagctgctgccaccacagtctgattgcgccgctccacgacactgttctgctgccgtgagtagggtgcagtgatttaacgtttcacccctgtgtccgcgtagtactccatgaactctatagaggtgaattcacccccgcgatcagtgcgcagcgccatgagcttccgattgctatccttctccacgccggcttaatcgctgccgatgcttcgtgtttggcagagaggagtcgtatccacatgtgatgactcatgtcatcgactaggagcaagaaatacttcttgccccctgtcgtcgccggcgtgattggtccgcagaggtcaccgtgcaccagctcgagcgccgtctgcgccctgtactgcgcctcctctgggaacggtgtgcgatgttgtttgcccgcgaggtacccgtcacacaactgatcaatgtgatcaatttgcgggatcctgcggaccacgcctccttttgccaacctccgaagtgccaggaaattcagatggccaaatcgtgcatgccatcgccatgctagctcggagccgctcgctgccatacagattagtgtcgcaaggttcaacttgagaacatacaggtaacttgaatcacgatttaccttagctagctgcatcccttccgggtcacgcaacgtgaaaacaccatgccaaatgtgtgcgtcgtagccgcgcgcatcgaggcgaccaacactaacaatgttttttctcagcttggggatgtagtacactgcctctagtgagcggtgatcaccattcttgctctgaaacaccacagttccgcgcccctagatgtcaaccactgagccatcgctgaatttaaccgtgcccacaacaccagtgtcaagctccgcgaacgctgagcgtgcgcccgtcaagtgattcgtggccccggtgtccaggaaccactctccagtcttctcctccttacgcccatcctcatggtccagcacaaccttcttctctgtgagatgcacttcctgcacacaaggtgttcgaccaacggccgcttcgccggcgagcgacacccccatcacgtgtgccatgagcagagtcggctcttcctcagcctggaccagatttgcatttgcctctccccgacattggcgacgcggcatacggcactgcttcgagtaatgaccgtattcatcacaattgaaacacttcaccttagagatgtcacgacagccatggccgctggtggccatctcctttcccttcggtgaatcgccggccttgcctcgacggttctggttgccagagcccgcccggcccttgttgctgctgccagatccctcctactcccgctgcttgacaccggcctgccactgctccttagtgaggtacaatttgccaccgtcacttgcctcctcatcatcactgtaggagtcgaccgtcgacagccactcgatgagctcctccagggccatggtcttcacgtcgaggagctgctcgagggaaattgccaccggcttgtacttcttggggacaacacgcagcagcttcttgttgatgtgttcgtcttccatgactccgcccatgttgcgcatgtccgcaacgatggcagtgagccgcatcgcaaattcctccggtgtctcaccgtccttgaagcgcatcgcctcgaactgacggcggaatccctgctccctcgcctcgctcacgcggtcgacaccgacccgcatggttttaatggcatcccacgccgccttcgccgtgtcgtgctttgccaagccgcgcaacatctcgcggggcacagcttggagaatcgccgagagcgctgcacgatcctcgcggtactccgcatagcagggatcgatggccgtccagagcccctgcgcctgcaggttgacgcgcatcaacagcgctcagtctatataatttgtcctcgacaggatcaagagacgggcagtgtgccctgcatcgactagcgggagtgatgccgcagccgttgtcgcttcccccgccgccaccgccaccacgacggccaggcggtgtgtatgacattaccggatcgtctcagcaaagctctgataccaaatgtcagaaaaaactcatgcgaactggctctcagtctctctgaaacacacactctgacgcttgtaggtgcagctacagctaactgaagaagttccgaaaaaacagagtcgaacagaacaactgacgaacagagttggcactgcgtaatacagtgcagctttttcggttttctcttctatttattcatctccagacggagtttgttacatgcataaaagaatcaaatcacgacaatctcggatcaactactgaccgcgccatcccacgatccgagccgagtcaacgcagctaaagaaggaagcaaatatgctaaaacagaaaaatgctattctaccggctagaattcagactccaaccgaactctacatgcaacgaaacaaaagagaatataaatgctctaagattacaatccaatagccttgcaggcaccaagtagtggtgctccggccggcgttctcttcaggcagcaaggcaatgaatgtgaagaagatagcagcgttgatgagggggagcggacgtcgacggcgttgcagagaagaggccgaccagcaaggtgacgacgtccgagcatctcggcgacatctcctcgccatatagaaacatcgtcttcaacatcgccgcgccatatagaaacatcgtcttcaccttgacggagacttgcagacgacgtcaactctggcgactctgacgatggcggtgcatccggcatcttctctgctgaggagcttcataccggcgtgcatgcgctgaaatggagcaaagggatgataagaaaataggctagttacccatggcagtgaactggagcggcatcgtctccctggtgatcgtctcctccttagcgcgcttcctcagcggctcagcgcacgcgcctccttgccggacgccgaggtacggcagccgatgtcgccggccgcagagcacgctcgttcccgcaggacgccgagatactccggccaagacgacgtgcgtgatggttgccgatgagcagcctgtgtccgctctccttgtccttgtgtttctgtgtttctctcctgtgtctctgtgtatgtctctctagggactactgccaaggctgggcatggcggcagcggcggcgtgaactgcaggccctcggctcgtgcctctgtactctctctgctgcctccccccgccgtgaaggaaatggcctgttttatagtggcgatccggccgtatcagagatccattgatgtgcgatcactttccaatcgactgtggcgcaaagagagcatttccttgtatttgtatgcacacgcgcgtcccagccgcgcggacatatatagcaaggatctttggccaaaacaatattatccaccgtatttattttaattccatgcaaatgcatattcgaaatctactgttgattccaaatgagttagagcccgataactatccaactaaagaggattttttttagataatggaatagatcatcccggcctttgctcaaaagagctacaaccaattattacaaactaacactctaaaacaagtaaagttcaaaaaaaaaaataggacaccaatttaagaagtaaaataaccaaaataggataaggagtacacatttattgaagcctatttgtgaatctccatccatagttggtaaaaagttgtataaccgtcgtctcaagtttacgacatgcaacctttagaagatctccgtcttcatcacacctttataattgtgcccaaaatcagagccaatatgttgctctgaaaattatctgcatatatgtaaaagatgatgatttgttaaaaaccatatcattcctgctcaaccacagcgcccaacatattgtagaagctccaaccaatagaagtttactctttttcttgtccacccctaagagccacccatcaaaaatatgagaaatgctagtaggaaggtataaaccaaaagagaattgaactgctctctatataaactttgcatgatgacaattcataaatagatgttaaatagactcatttttcatacagaaacagcatcttaaactgtcattccaattttgtttagtcaaattatctttagttagcactaccactttaagcaagtaccacataaagatcttgatcttaagcagcatcttaagctttcaaattatcttgtttctctcaatgttgccattattaatcaaggctagatgcatcgacctaaccgagaatcgtccactctgattaaatttccaaataaaacaatcaaaagattgattcaactgaacatgtacaatagaagcacacaaatcatgccaagatacaagattatgaccaaccaatgctctcctgaacgaaacattaagcggaacagagcccataacactagcaattgaagaatttttccttctgataatagcatataaggatggatgcttatcttgaaaagcaagttccctaaccatttatctggccaaaatcttacttgttccccattattcacattccaggaacccatattcaagaaagtactcttaactttcatgtggtctaaccaaaaatgagaatcaccttgtttcctatcaacttgggttatagactgattataaagatattttctcttcaataagtcctatcaaaccccttgctcatttattaacttaaacaaccattttctcaaaagacatttattttgtatttcccaattatgacccctcatgccgccctgatctttgggctggcatataatatcccatctagcaagcctttactttttcttatgatcatccccttgccaaaagaagcgtgatctataataatcatttttttaagaaccccttttggtatctcaaaaaaggatatcataaacatagctaaacttgaaagtacataattaatcaaaaccaatctacctccgacagacatatgtttacctttccaactactaagtttcttttcaattctttgtgcaataactttccaatccttgttactaagctttttaaaatgcattggaataccgagatatttgacagggaagttacctaacttacaaccgaagatattataatactgatcataataatcctttgcgtgaccaaaacaaaataattcacttttgtgaaaattaattttcaggctagatagctcaatttcagcttttcaaagaggatattgtgatggaatgcttccattccaaaattttctagcatggaatgggatcgtgtgtgtttccattctgctttatatacgcattgtattgcccagcagagagcatgcatagctgccgatcgattgtcccatatatattgccattcatcatcaggttgacctgtgaacccaggtgatcaagtatagatgcatatggcactgataaagatgtcagacaagcaacccctattactttctggtgcatttgtgcgtccttgtcagtaatcacttcagttaagactaattaccgtgtttaactaatcatggaatttacgcatatagtgaaaacttgtgggaaatgcacacagcttgtttgtttgttccttcgattggcacattcatgatttttagttttacttaaaaaaaatgcacaaaatctcgtccaacacaaggtaaagggttcttgcacctgagatgtgtgcataaccgaagcactcgcttgagttggcgtgatcaaagtgccttcctccaccacaacccgcatcaagacggaggagagatcgacaatcacatgtgatcatgctaccgctccagagatttcaacatatgcatcatgccggcggtaaggtatacaaaagacagcaaatgattcaccatttcttttacacatacttgtctttagatgagtttggcttgatcatacctggttatgcgtcctcagtccattttcgtatgctatggtttgggtggtcgtcgacattcataggctttttaaaattaagcatgatgcttaggataaatagccttctttaattaaagttgacgtggtgtcaagtttgcttaaatgaaccgtaggtccagtactttcatggacttcggatgtatatccttcgtgaactaacccctgcagggaatttttcaaattgacgagcgagtcctcaagcacgagtcacactggaggtaagacagagctaggagaaaaatcagttgctaacataaaaaggagaaacatatcacctatcaaggtgtacggtgcgcatatttctaattgctcctttagcatgttcatgcaaatttaccttagccctgtatgagttttgcttaaatgaaaatttggtgaacaataaaaaaaattgaaagaaagaaagagaaaaaaaagaaaattttgttttcaaagaataaaagaagcgtctctcgattaaaaaaatttgtctctggagtaaaaagaaaaaaagatgatgacaaaataaaattatggcaaatttgtgggatccatgcttattaagaatccaattccttgttagcatggatgtgaacaattaatcttcaggctatgataaaatcttttcaattttttgttgtccctcgggtatttgttatccactaaccttttgcaggaaataaaaaagacaatagaggagtagtgtaaaataactccaacattcataccacgctccttagtctatgagaagacagatgcttaggaaaccaagcagaacaaatgcaaagttgtgctgtattcttgcatccaaatcaaagcttggtaagacctatctggtaataattcgaaacacctcgtgcatcctcgcctcacatatgtccaccctgctaagttacccatcacctcaattgatgccataataaaaataaaaataaaactataaaaattataaaatgaaaataaaaataaaaacaaaataaaagtgaaataaaataaaagtaaatttaggcacttcatgcgcctagagttacttaaataaaatttggctcaccgatattttaccccggtagaagcctattttgctttccatcctttttgttgaataaagacaagccacaacacaagtgtgggggagtcttttcgaactctcgacgcgcaacagcatcgactcaacatgacactgtgatgaacaccagcctatggccgcgcacaaaattcagcagtcatatatgattctcattgcaaggcaatactcctcagcgactatattattaactaccaaggccatatatgattctcattgcaaaacattacatgtataggctgactgacattacattgagctttctcaaattattgtgacccatgtgagatgctttttgatactttcattatcaagatcacgtacactaaacttacaagcacgtaagctaaatttctacactggaagctagcatccattgtccatcatttattttatccattatccacaaaataaatactccatgtcatttatgcctcatcctccaaaattctttcaaaaaaaaaagagagagagaggcatggctacgcaaaataaagaaaaataaatttttgctcatagaaaaatggagcattgaaaagaaaaaaaagagagagaaaatcttgctcatataaagtatggggaatgaaaaaaaaaagaagaaaaaaacggatagccatgcactctctcaaattggacaatgagagaaaattggaggaggaggtatatcaaaggagttgttatcatttatttttcctttttccacccacaaaacaaccatacacatatcacacacatgcacattcttgatcagagagtatgacttgcgatctccttaggtctggtcttttggcttggtgaaatatgtgatgcaggtatgccccgattgatccctaccaagctccacatatacaaccttgtagaattgggacaattcagcaaaatatgccttggtgagaatccacaaatcaaaccacacgagagacttgagagaaagtcattcgaggagtatatctactttgaaaaaatatatgaaaacccaagagattgacaggaggaacaagaaggacttgagccacgacagttccattcatcaattacccaagatggatagttagacactggaaagttcacaagtacttgtatggcttagaataaattgtatacctgtattatatcttggaaagttttattccacattcatccttaaccattactcggaacgagtaaagagctaagtgtgggaggttttgttgatggctgttaaatacaaaatatatgccgtcaatacctgcataaaaccataaatgtaaaacatcaaccatagtggtagggtttatttctaatgatttccactagtgctagtgtatatttgtatgcaggtgacaaattaccagagttgagaaaaaataaacatgtaggcagggggattatacttcccgttggagtccatggagtgatgagcccacaaaccatattaaatcattatttattgggccaacgctggaagaataataaagagggacccaaatgtcaggagatagaagaaggccggaggcagttgggccagcccatggttcggctgaaccgccatgaagcccaattcatcccagccttccatgtgggcgtccaggattgctccctaatgatggttggatggtgtttgggacatttcccataatgtaactatcatatgaagcctataaatagagctcctctccctcattccaacacacaccaagacgtagagctgaattacaagaggctctaagtatactttaggttcattatatgttctatagtacacttagaatagggatagagtaaagtagaagaagtcggaggaatcccagagttgtcgataatcctctctttattcttgtactttgttaattactctggttcaatagaaatatcattctgagtaattaagatttgcttagcgagaattattcttcgttagttcctaattagcatatgggattattgttcactatagtccattaattatatagtgattgctttagtctttagctagcactagagtagttattaattgcgtagacacggtgtctggataattaatttccagtacttgctgcgtatcccacaatacgttagacgtgggtgtagaggtggtgatagccctcaagagcacttaagtcctccctgtgcgggtacatagtagagcgacatctaggaacagcgagttgctagtgcctgaagtatcgcgttaggattaaaattaagctttccttggacactttttctcactaagaaatcctctctgccctgtgcccatatttatcttatgtccttgatgaaccggaggaagagataatcacacacgttcccttggattcgatacccttgaaatactccgtagggaaagtcctacatcggtatatccatgcgcttgcggattctatctgtgatcgtaagaaataccaacaactggcatcccgccatgcctcttgaacgatgctgacctcgatcttgtcggtgatcaggagatgcaagcctactacatgctaaaggatcagatatttgctcacacgcgggcatacgatccggagctactaaaaaagataggtatggatgttaattctcataccatttggaaagttgttggatggcagagatttgcggtggcagatgagcctggttctcgtttgcttactttacaatttcggtacactttgaaagaaatagaagatggaatttcctttcgctttttccgtaaagaatttacacttacatggaaatgattaagtacacttctttgttttcacgatgactataaaaccgttcttcggaatttctgggttcgagaaaaacagattttgggaaaatatttctggtggtccaatttgcaagaaacctagaacgaatgacatccataatcctacacttaggcttatgcacaaatggattgttatgactttgtttcctagaggtgatcttaggcctataagagaggataaattgattatcatgtttgtcacagttaggaagattaaagttgctcctgtgaaatgtgcaatggttagagagtataaagtttactgctcctgttgagtgcacttccctaattactagcatagcatacagacttggggttatttctaatgatcagattgcttatatttcaacccctcatccgtgtgttgacgagaattatttagtgcaaggtcatattcttaagcatggagtagatggatctttgatattctttttccccggttgtacaaaaaaaatcccattacctaactcgggatatcatttgtacaactgtcatgaactaaccattcccgtatagaccatagaagaatcttgtgcaggtggatcatatagggacacacgcaacatggcgagaaatgaacaagaaggttcaacatccgtgcaaatgtacgaagccggttaggaaccaactggggatgcacccggatggacccaagctctacaccatagcctcagaggctcggtctggaagagtgccagcgagagccgacagagagcatctcatgacatacactggggaacatgaacattcattccctcagatcaagcagtatgccttcatcccccaatgaatggtgaatggtgctcaagttcctctcgttaggacttgggagaaattacaaggaggatggataaaattgacatgcaaacgggagagatccaatacaacctcgatgtcgatttctaggatcggcaatatattttaagaggtgcgctagatcaaggagagatggtgacgcagggattatcctggttcaagccctctgagagaggaaataccgtacgtccagtgtgttctttcttgtgtatagtggaaaaatggtcggagaagctagacagaagagtcgtggagatgattcgacctcctctagggaccccttccccctcttatataggatgagggggagggttacaaggaaagtatctagttgattgcaactagatcaacctattctatctataaaagatatgcaggatcctcgggatttatatcttatcccgggaatctctctttctttatttacaagtatgacgcatggggcntaggacacttggcccaccccatgcagtgtggcccaagggttgtcattgggtacccgggtaccgtgtaccccccactcgatgaacacttaacacagacgcaagaatgacaaccgaatgttgatgctcagttcaccaacaccaacaacgcaacctgatgcagcaacagcatgacgaccttcaagcgtactttcgcttccaggggttcaatccttatcaaggaccctgagcgaaaggcaagcttggtgggagacgtctctccccccgctgaggtaacttgtatcacattgcatgtttccctttccaaatgcatgttttattttcattgcatcttataaactaaaaacaacataaaaattgcaaaatagaaaataccaaaaaaataggttagactttattatgctaggtaagacaactttttttttgactagaaatactgccaggactttgcccagcagtgtagttttatagaactcaaaaaatgttttcaaaattacagaggaaagaaaccacacaaagactataaagtttttaaccaatcagaaacaatttgttttaagggacatatgtagaagaatttctttcacaaaaagtgatctccaagcttggaaagatggctgaatattctgtaaagtaagacaacttagttctctttgttgaaatgatgaatagttgctctgttttatatctctcatatatggggtcatggttaaatactctctcaaaagtcgaataagagtagccaacaaatatccgggagcctaagggaagtgagctgcacttgctgatttgagtctaagttgttgtgagatatgagatagtaaataagagttgttatgaccctagtctgaatttgacttgaattccaaatgttttctttttctaaaataataaactcatgaagttcctcatttgatataaatttctaccaaagccaaaagtattcttattggataaaccatatacattttggttggctgtaattccattgaactttatcaaatttttgtgacttgtgtagatacttttcatgctctatgattaagatcatacacccacatatatgcacatgctaaacttctacactggaagctagcatccatccatttcatcttgatattccttcataccaccatccaaataaattctccatgcttaaatgtgctttcttctcctagaaagaaaatcctttcttaaaaaaaagaagagaaaataaggagggaaaggcatggctatgaaaataataaacttatgctctctcaaaatataaatcatgatgatgaaaaaaaagtagccatgccctctccatatttatgaaaggaggattttggagaagaaagtaagcacaaaggagaagcattttctttattttccacattccattttccaccatataacacacacactttgcacgatcttgatcttgagaatgtctagtcatctattttagtccaagtttttgacttagtgataaatgtgagtacaagtatgccaatgccatcgagatcatctacagtatcttcggtgtagaaatttgaaccctcaacgacgccctcaaaacaacaattagggctctccatctctaactggttgtatatcacaatcggacacttttagataatctccatcccaaacttttccagataagcaatcaactccatccatctcccaaatagtcaaatcggcattaccaacattaactgacttgtcggctggcacgatttctatctggtctcctttccattggatcaagctctggtgcatggtcgaaggaatacaacaatttgcatgaatccaatcccttcccaacaacatactgtaagaacctttcccatcaatgacaaaaaaggtagtagaaattgtcttgctgccaatagtcaactccactttcaaaattcctttggttctgaaggattccctccaaagtctttgagcaccatcttagtcttgatgagatcatctgaattcttccctaacttcctgaaggtagaataaggcatcaagttcacagcagccccaccatcaactaacatcttggagatcggcttgccattgacaaatcccttgacatataacggcttcaaatgccgatgccctgttccttctggcttctcaaagatagcttgcttaggtgacagacccaacttagccaaagattcttccatgatttctgcatcggctggtttagcacaatattttgctggcaatataaagaccatgtaaaccaatgaagaagcaacagccttccctttggctaaccatctcgccttgtcggcttcgacctcatcagctgagacaaccttgctcttaacacgccactcattccttgtcctctttagccgatgattgatctcttctttggcctcttgaatttgctccatgttcctcgtcctttgaattcttctcttctggttcttagtgaaaatgccagaaggacaccattggggtttcctagtttcatcttcatcttcagcatcctcctcctgaaacgaatcttgatgagttggacccaatctctggtgaacaggcaactttttctgcacttgccgatcctctctccttgcatgtgatcgacttgaactcccaacatatctccttctagagccaccacatcctgggcaatcttctattgacggcaatctcatcccctcattctagcagaacctgaaaaactcgcaactccaatgaggatcaaaattgcaatcatcttcataatatttttcttcttgcatctcatgcttcctctggtattttgtcgcgtcccaaatcgactctaaaatacatcctcgaaattgtgcatagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtccttttcccccccttcctctcttgggccggctcggcccagctccctccctctctctcctctcccccgcagcccatcggccttcccccgcgcgcgcgtcgctgacgggcgggcccgcccgccaccctcgctgacgggtggggcccacccgtcatcccctacctcgcgccgcgccccgcagcctcgcccgtgccctagcgccaccgccgc

SEQ ID NO: 16338 - DNA, 10580 bp, Oryza sativa
ttatgggcaagccgagcaatgtacccaagttagtgttttaattcttaaaacctgcttaacaactaaaatgtggaatggttggcctgggttggcttgggacgagctgggacccagggttgggttgccagttcggtctgaatcatcgtaggccttgggttaaggcaggttcgtgtgggttcacggccttgataaataatattgtttagttctagaatcgtgtttacaaaatagctttgagcaactaaatatctttaaatgctgtttactgccaccctaacccctttatagtgtaactcctttgtactcccttgcatttattctgcacttgtggatgtgtcttgttgagtacggtggttgtactcagtcttgctcaatttttcccaaccccagaagaggagttgcaggaggatgaaggcttcggtgtctagctcgtgcctgccgtcaagcgcctgtggtcatcgccctagtcttccgctatttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttggcttatttccggtcgtgacatatttgcttatcatcctaacaaaattaaactgaccagactgataactcttccaatcggcagctcccccactcgtgtgaaccatgttgacagtaaacggattaccatcaatcttcatcggcttctttggatcatcaaactttatccttccttgttcaatagccgattaaatctgttgtctgaaatgcaatcattagtgaaatgagatcctgtgttatgccacttgcaatatttcctcttccccaattcattagccgatgggattacatgaccagcgggaagttgaatatgtttttctcaaagcaacaaatcaaaaatcctatcagctttagtaatgtcaaaatcaaacttcacttcccttccagaattcctaacccattgacaagtaacaatcttcttgttcctagcccactcagttgcagctacttcgggatcatcttcatcagactcagaagcatattgatcaacattattgatcttttcttatgccttcctagcctcatggaatctttgcttatgtgctgatactttttgggctagatgagctatactctcgaaggcttgaactaaaaatatctctttaattggtgtcaataagccttggaaagtaagattggctaactgagaatctgtcaaagccaagatacagcatccattcctcatatccctaaatcattgaatataatctaggacagactcctttggcttctgcctgattgctgtcaaatcagacaacttcatctcatgcactccactgtagaaatacttgtgaaattgcttctctagatctgcccaactttgtatagaattatttggcaaagatgaaaaccatgtaaatgttgatccagacaaaatcaaaggaaacaacctaacttttaacgcatcattagccgatgcttctccacactgaacggagaatcggctaacatgctcataagtggacacattgtcttgtcctgagaattttgaaaaatctggaaccttgtatcggtttggcaatggaaccctttcaaagtactctgggtacggatgccaatacaaattaccaccgtccttgggcttaagaccaaattgttccctcatcacattggctatcatatcaacccaaggttgctgtcgaggtgtccctcccaattgctgctgcatctgatgtaactgattgtattgaggcaggtattggggttgaggtgatcctcttggccgatattgtacctaaggtgaataaggatgtttacattacctcccatatgatgttggggagattgatgtgccaaatggatggattgttcagggatgaactaagtaccaggagcctaagacatccccatctactgctgctgtggaataaatgatggttgccctataggaatttgctgaatcggctcaaccactggctgctttgtcttgaacaatgcagcaacttgttctagagaaagatgaggtatattgtgccccccatgctgaggctgttgcctgaacaaaacgttaggaagaaactctggctggccatgatccgatgttgatgcccccaactttcctagagccgatgccgatgcaacttgttgtttcgggatcactcctgatatatacaggctactgtttgccaccaatcttagtattgagggttctgtattgtggaaaattgccttcaggaaggaatactggccccttaacttggtgctcagctatcgtaccatcaaccacagtcttgatcatattggttaaggtgttgacaagcactcccgactggttgatcaatccgtgataaatagctgaatcaatgcgatcttgcaaagtatggaactcctcagtacttcatttagctttctcatctttacccattatatccttaggagagcttgccccttcatcatcgaacggtaacgtgaccttgtgtctttggattaccgtaccgtgccgagtcaatgtgaacgaatgtagatactgattttgcaactgattcatcatctgttccagagtcgccttctgctcctctgtcagtttatctagcatcaccgggatgatgttttcatcatcgatatcatgttttttatcaaccatgatgaagaactaccaaaggttgtcccactaggcgtgccaaaagcgtgttgatgcaaaaaacacgcactggcctgagagatttgctttactctagtgcaggtcctaaatttgcttttgggttcagagcgtgccagttggtttgatcctgcaatcaacaagaaacaaagaaaccaaacttaaatccatcaacgataaccgatcatctggattgctgatgacatatcgtctgagagcaagccgatgcggtatatttcggatcagcagtgatatatatagtaaacaaagggctaaatttactttatcggctttagataataacaatatataatctatacttcgaaatgtgtttaaaccaagcgattgggatagatcggatggctgccgagacagtataaatcacttaagtttaaaagtacttcaaaggaaagattatttatgttcattgcatagctgataggtaaatctagtgtgtatcggctattgctccaatacatctttatactaagatatcattatagattaaatatattaaacaagtgtcggtctactattaggaagacccaagtagattgagatcaagcttaatatgtttagtcttagcgagatcttaatataaatggcagatttagcatgtcaagtaaataaataaagaacaagataactaaaccaggtaagatcggctgaaactccgatactatctctattagcaatcatgaagcaagctagagattatggttctaaatattacttattagatcaaacttaattgatgtagcattaagcatagagagaaacataagatctagtaaacaagccaatgaaaactttttcgagatggtggatatactatatgatctaaaccaatgatattacctgattctatcggctgatttcgatgatagagacgagccgacaagaccagatagtaaaatcaatctagattatattgcatttatgataactcgacgattcacataaacaagattagagtgtcataaagatgtgagcactaatcccgagaacgcaagccgcaataacaagttttacctctcgccggagatcgaaaacgatgcagcccaactagagaacaagaactcgtcgaaacaatgaaagtagaaaaaggtcgcgatgcgccgaaagtgtattgaactgatgtcacgtcctgataaattcgtcccgaaattaaaaatcattcgctaaaaggaataatagaattaattaaaattcggaaagaaattggcaaacactaaaatacgtacaagaaaaattcaaatgtggcccggagaatttttgttaaattcgccttggtctaaaaggagccctcaaattttacttgaattttcagagcaccggaaataattattaagcaacaaaaacaattaacaaagtttattaaaaataaaaacctaaaaataaccctccttcctcctttgggccaagtctggcccaaagtcctccctctctcccctcggcccgcggccgaagtctccctttcctccctctctttctctccctctccttctctccctcctcttgggcccccttcccctcggcccagctccctcctccctctctctcccgggctgtctctcccccccccccggcctgccggcccaagccgcctccccctcctctcctcctgggccggccgcccggcccaacccgagcggcgccctcccgcccgtgccgcgcacgtgcgcgcgcgtgcgcgccgttgccgcgcgctgaccgcgcgcccgaccgcgtggggcccacgcgtcaggcgcgtcgtctccctcctccagccgcccggccacctctctctctctctcccggaaacctagctcgctccctcctccaaatccgcttgattcaattggccaattccaaaattaattggggggttttaatccccattgaatcgtcttcaattgcccccaaattcccccttgattcgtgccttcaatccccgggaacggacgcgccaagtccggtcgctttccatggccgtcggccgccattcccgccgccgttccgacctcccccgtggccggctccctcttctctcatataaaatgggatcctcatcccccgttctctcgttttagccccctcccgagcctccccgtggtccctagccatctccccgccgccctcctctctctcccacgccgccggccgcctccagccgcctgtgccgcctcgaccgtgcgccggccggccgcgccgtcgcctcctccagcgtcgccgccacctcctccaccccggcctgccctccgtttcgcgcggtgaccgccggaggcgcgttcccgccgtcgcccttctctttcctccgcgccggccgcctccagccgcctctccctcctcgccggagcaccgtccggccgcgccgtcttctccctcggcctcgcagccacctcctctccctcggtcagccctccgtttcgcggggaaagcaccggagacgcgtcctcgccggcaaaacagtggcgttgccgccactggtccacctccgggcgccactgtcgcgtttcccgtgcgccggccgacgtcgccaccacctccctcggctccgcgacgccgccctccaccccggctggtcctcggtttcgccggaacgccgtcgccgcgccggcctctccatcctcttcgtcgccggcgtcctttcggccacccattcctcctcgtcggctcgtcgccccgctaaaccaccaccttctccaacatcgcagcagcgcgttccacgccgtcccctcctccgctcagccgctgctgcctgccatcatcgtttcctcgtcaccgttcgtcctcgccgatcgacgtcccgtcggtcgcctggctcgtcgtctcgcggcgccgcctccgtcatcatcatcgctgcggcgtgttccacgccgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcattcgtcaagcgagccgctgcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccctctccctcgctgccccgtcctcgtcctttcggtgtcgcccgtgctcgttgtgcggttctcggccccggtacccgtgtaccggtgtcggtagtcgttcacgcgtgcgggtggtgaccgtgtagtgtccgtgttagtgtgcccgctcggtagccgcgtggtttccacgtgtgcaggccgtgtggtgtttagtggagtccgtttgtcggccactcgcctcggttgacacacggggtctgcttccgtcgacccgaggaccgtctctgtgtacccggtctaccgcggtcctttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgagctccgaatcgacccgttcaagtctcttaatgtttgttataacctaaagaactgtgtgctttcttttttatgtgttgttattgcttctttataggcttgtagctttgcttgtgtgctccgcgtagctttcgtcgttccggaggttcgcgaagcgtggtttgcggtcgttgccgaaggttcggaaggccgttctctctgagcaaggcaagtcacatcatccttgagcatattgaatcccagtttataaaattattttgatttaaattaatgcatgatcgctttatttaaattcccgcgttatcactgttttatttagccatgcctatttacctttgttaagacattattattgctactgttattattaccttgttcaccctagaataaacaaaaccccaactagtggacactctattcatggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctagaacaaatgaaggctacacgagctgcggcccggtagtcgagatgtcatggcacagggttggtgccctgctgctgggggctcagtcctgcctgcctgtcccggaggttccggccgtaggtgggattgggtcggtactcttgtctatggctaggatgggttggaaactatgtcacgtcttctgtctgtataccgtggtggtatgtggcacgtggttgcacgtgaggaagatgtgtcttgtgggtaaagatgtacacctctgatcagagtataatctattcgaatagccgcgccatcggttatgggcaagccgagcaatgtacccaagtcagtgttttaattcttaaaatttgctcaacaactaaaaggtggaatggttggcctaggttggcttgggacgagctgggacccagggtcgggttgccagttcggtctgaatcatcgtaggccttgggttaaggcaggttcgtgtgggctcacggccttgattaataatactgtgtagctctaggatcgtctttgtaaaatggctttgggcaactaagtgacttttaaatgctgtttactgcaaaacttaacccctatattattatccccttgtactcccttgcattaatcatgcatctgccggtgtggcttgctgagtactgtggttgtactcattcttgctcaatcttttcccccttcagtaagagaagctttggagaagaagtcttaggtggagtcctggcttataccccagttgagcgcctgtgaagatggagccgtaggcccgctagtccgctgctgtttatttttgaatgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaactgatgttaattgtttacaaagactcgggcatatatttatacccaaaatacatgatatgtccatatcggacacgactcgatttgtattacaactctaaaagacgaacaagtcccttaggcgaactcttaccaaaaatatatataaggaaactattaaaatatcctaattaatatagacatttgccttcttctaacgtgatccatgcctggcaatacttttgcaacatttatattgagtccgacaatgactctaagcccctttgtcgaaatcagctgcatcggcttctccttatccgatttggtactagccgatgcagagtgcagccgatgcacactctgttttcgggaataacgaactccctccaaacccgcttcggttttgactccaaattcaacctatgatttaccaaatttggtcgttaacaggtactccttttagagcttcccctcactctctacctactctactagagcaatgcctaagtatgaaagtgagttgtactccactttattgtgtgttgagagttaagtgagctcccccttttatagctccaaatgactacggttaaagtttgtaactgctgaggaaaccgccataaccgtcattggggaggcatgaggaagcgacatgtggaagatgggggggcgatcagtcgaaccaattttactgcctttctcccccattctcgcttgagtcactgtcctgtgggccctcataacggtgtatgggggttggcctcaaatatgtcggttttgctatggtttgtgggccctccaatccgagtactcgcatctgattgggcggaggtgtgtttcttcacatggcgggtggttttcatccataattcacctgcatacgaatatttaccaagacttgtggaaatagttagtaataaccactacccgtaagtttgatattctattttgtattctttcattttcttttatgcaggatttgacggtcagatttggtacttaaagaccatcaatatacccagaatacccataaaggaaatataagaaggaatgatttgccagtcgctctaacattttatcagcgaagggtagcgtgaagttgttcttcttcgtagccttattgagatttctatagtcaatacacatcctccatcccaagatatatgttatgggatcaacttgttcttcgagttttcaacaactgttgttcctcccttcttaggcactacctgaactgtactaacccactcactatatgacacaggatagattatcctggcgtgtaggagtttcaagacctctttttatttttacgacctctctcattgtattgtttagccttcattacggctcccgaggggacgcataagaaggatctaaagggatatggtgtgtgcaaagagccggactaatccctttaagatcttgaagagagtagcctagaacaaagcgatgcttttctagcacggccgtgagtcgagaggtctcatatcaatcaatttgtaacttatgatgatgggcgactccgtatcaccatgtagaaaagcatagcgaagaactgaaggaagtggtttgagttcaactggaggccgtaaagttggattggttttgggtaactctaccaactctgcaagattgtcatcttccttgacgagtgcattggcatcatcttcgaggagggattcaggggactcaaaaggggagaaaaccaacacttcctcactagtccctccaccacttgacgctcgtcggtgcaggaagaagatgggagaaagaaggaataaaacggaaaaaaaagagatggatggaaaacgtgacggctgtgacatgtttttaattttataaaattttactggcacagctatcaaatcagtaattaagagtggcataacacaaccagcaataaaatctaaactagactattacacctagccataaatatcaaccacaagaaggtccagtgtgatcaactatgaaattgcagtcaataggcaatacttcatctgtcccctaatataatggattttgatattttggttacgttgtttgaccattcgtcttattcaataaattttgaattattatttattttatttgtgacttattatccaatgtactttaagcacaatttttctttttttatatttaaaaaaaaatgaataagatgagtggtcaaacagtgcaaataaaatgtcaaaatcccttatattaagggagataagatagtagatgagtagtgacctttcagcttggtcgtcggagagactcaccatatgtccatttcaacataggttagtaaaatataagcgatcgatatatgaagtcctgaatgaaaggaagtgttcaaacctaaaccatcccaccatgcatattctttcagagttagtacgtacaaacaactgagcgaatagaaaatgaggttgaacaggatattcgaatgaacctgacttttagcagccaaatgaaataa

SEQ ID NO: 16339 - DNA, 3437 bp, Oryza sativa
tcctttatgaaacacttccaaacctgactaaagtgaaatgcaaaagattttcttgtgcctcgcaaatgttgtagataaacgaataaacaatatgattcattcattgggttacattatttatggttcaacatgtgcagacaattgtcatccttgggttgatcttacaagcaaaacaagttcaccaacaaatatcagaaggcagaccaatttcttgcaaggctccattctaagctaaatctataaaaaaaaacacaaactaggttgtgtttcagatcttgtactgttgcaaagaacctgtgagcgttgaaaaatccttgaactttgaaaattttggcatatttaagcaccatggaaactaggggaatttacatgcatgcttggttcaaatcctgactcatattttgttgtcatcctggacaccagaagcaagtcaatatactctaaaatccaaattcataatgttgggacatttagaagattgaggcgattatagaacggaaaatcgagttaccgttaggatgcaagcgggccgacctgcgagttcacttatagatcaaataaatgataattcataggttttcggtttgtggtccggtttgctacatctagatatgcaagtgggtcgatccataaacccatttacaggtcaaattaataggtaacccgcgagttacatagaaattttgccaacaagtgggttcacggacaagtccacttacatccctagttaccgtcgcctccaaaatgatgccagtaccgtagccatggaacgaagtgggctaaagtagaaccctggtaatcttgacaaagaaaattgcatgacatatcctttgtcacagagaacagtagaaaataggctgacgtcaacacaaatcactaagcacattaataaatttatttaaattcctcagaaactgtaaatcaaaatcatagaacgattaccaaaattctagctaccaaatcaggagtcagatgagaactccacaaggataacctgcacaggaaaatttttgccttgaataacatcgagaaatcttttgcaaacttagtatcatgttttcttgtcatttttcttgataatgcattgattagcatcctgtacagtgaggaatccaaacttgccatctggaaaaatggttctttccatgggtactccaatactataaatacatgaaaggaaatgaaacagaaagtgccagtacaaatctgcatgatattaagggatataacagcagcaacacttcaggatcatcattggctcactgaaaatgaaactaaatgtaacaaatgggaatgcatgatccacggttcagtttcaaacctttttacatcacttggtatctaaaggagtgtctaaagttattcttaggaaaatatgcaagaaacaaaaatggtatgctatatcggtggagtttagttgatcactggttggtatcgaatagtattaagcatgtaaatttcacactgaaaaaaaaagttgaatttcagaataacttgaacaattttattgtgaagcacaaattaaagtgcaaaaccaattgagcacacgaaatggcacgtcatctttcccaaattagctattaaccactatatagaaacagatctaagagtgcaatcattaatctccaaatctgtggtatataaaaagtctcaggaaaaaaaattaaattaagttttcatgcaccaatgaaattacagttgcaaacagggagaagtaatattattatataccactgcatctaggaagataaattgaagaagaagcatgtgtaaacaacagggagaagtcacaaacataacagttatgctgaagaaaaggaggaaccccaaactgaaatgctatggttaacttgataaaaattatgagaccccagacttctttgatactgtcctagtcacctcgtgatccccattagtccagagacattttcctgaacaatatatgatcaaattcatgaaaaggcaagagctcagatttcaataatcccagatctttgcatttcagtatgtcgaaatgataaaattagaacttaatatttatcatccccatgaagtaaaaaggctctaaaagtgggtggtttctgattatagtgatagggaacataaagtagctagttttagtacactggtatttctcacaacatagacatatgaacaaaataaaaacagtaatagttactgctagtataattagcttgttaatggctcaaaatttgtaaagtgaagagaattgatgaaattgggtgaccaacagaacaacacattagtcaattgtttgtcggtgtgccagttacacttacatcaaaacaaatataagggaacgaaattttaggaaattgatggaattttacactgtttgaaccaaagaaaacaatcataagtaaccagaaactttgcactatccaagaaaaacatagagaaatgtagcatttaagtttgaaactagcattaatagctagttccaggactcacaacattttgcgctattgcacttcaaattatcggagtgcttgcaaataacatctcatcattggccaatccacaagatataacagaacagttgattttttttttagaataggggataacagaacagttattaacaaggaactaatataaattgatcattgatgcaatttctctttcatagaaaagagggtcagcacattggcataattaaaatgcattcagcattcatacttcaaacaaagtataacaaagaggatcacaatgcaggcacataataataaagtttccattgagataggtcgataaatatcagaagatcttgcactcttgataacaataactcaggatcacaactaaaatagaacgagacatgaaaggcaaacatactagctcaaacatttcttgtttccacttcttagttcccctcaaaagaaaaaaaactagctggattgcaggataaagataaatccaagacagaactcagacgtcaaaggggttgaaccttgggaggtcgatgaccttcaccttcctgaggtagctcagcgggcgaaggaccttcttaacgaggcggtgcatctcacgcccagtcaagccctttccctcgtggacagcaccgaggcaagcctcgacggtgctcatcgcttggtgagcgagggagagcgccatcagccgcacctccccgttgtcgaacacgagcaggtcagcggaggttatcacggctggtatggcctcgcgcgccctggtgagcgcctcccccagaagagtgttgtagaagagtatctccaatccctcctcgccatccgggtaattcttcagagtcttgaggacgcggcgcgcctgcagcatcatcttgcccatgcgcccaagagcatctgaggcggtcggacgtccttgaggccggccagatttgggatttcccaatccggccgcatctccatcttctggagctgctgcaccatcagcggggc

SEQ ID NO: 16340 - DNA, 2058 bp, Oryza sativa
ttgttcccccgcccccggagtccggtgataaaaaggttactgttacggtacatttaccacacgtttgtcactggtgtgtgtgataacggcctcctttttacagtgatcaactgatcatgcattcttcccaagttgatacttgccttactgtgtgtaggtatggggaaaataagaattactgtgccctttattatcaacatttgctttcttgctcttacttcctttctttttttttcttttcattttatttaatcgccctctcatctcacctcgcttaagtatatctttaatttttctaagaaaaaactaaaatgtattttgccattagcctaggcccagtgttaagcaaatcaaaatattctctccttatgttcgaactatttgttttcacttttacctaacatatttacaattttccacattgttaactgttgacagggtagcaaccaaccaattacacatgttggcatcagttcaactatttgatttaagatcggtatcatctctcaggttctcacaagataaggtccacagcctcatatgaaatttaacattttatctggtagggttagctagttatgacataaatactgagggaagaaaattctaaacgtacaaagagaaacagaacatcggagtgtatacacatgttctatcccactgcaaacatcatattgctgttatcactgctattacacctcccacgaatacacatgcaaagtgtatgcgagtgttatcttcttgtgccgtcgatcacaaaataaatgtactgaaatgccatcaaatgcaaagctatgttgtgatttgagatgatccattagcacattgacctgtaagaaccttggatatattgtgactacctacagatgcatggatcaatcttttttagagaatcattcttcaaaaaggtccttgtacatccagtggcggacgcaggatttcgaaggtgggtattcaaaaatttacatggcgaatttgttttttaaaaaatatggttaatatcatcaatgcaaatactatttcttaattagaaaagttataaactatagaaaaatattgaatgaaaacatttatcttgttgggttaacatgattttgaaatataatcgatgtatgcttaaaaaatattgtgagcttatggaagaaaaatccaaaaacaggattgaataatcgagaaaaaacgagaaggaagctaggaatcgaacctagcacctgttgacccaccaaccatttgggcaggatatacttgatgatatggggtatagctactttgtaaaaaaaatgggtattcagctgaatacccatgaacgttgtagcgtccgctatctgaagcctaaactattcactttgtgtacgaagtgatgttcttactatcttcattcactggggttcttcaataccgcctcctgctaacctgcaatctgcaaaagagaacatacataagtctacaatatcattcaatttcaccctactagttggtggctgaattcctacctaattggctatccattttgtgcacagtaactggcacttgtattgcaaattgcaacgtaaacattgtcctacagtatcaaattagcataatatatgcaatcaaaagatcatctggagttctggatgatagacaaggttggaaccttttactttaagaaaactaaaggaataatgaatggttggtaactgggtcagcactatcaaggaaatgaacccatcaattttacatgacgtaaaagggggaattagtcagcacccagagagccactgaaccaaatactatcagaagcacatatgtagtaaccaagtaatatttcacatcaacaaccttgattagttagaaaaacatggacgaaatagaactacttaaaacaagtaaaagacctagaagttctaagccagtaaccaggcccaaaataaagagtaacagaatgtgaagtaatccagataatggatggaacacttccatatggatgggaggaacaacgtaagagaggtaaatcctaactaagaaagttacactaatattagcacagataaaatatcacatgattcaggcgttatt

SEQ ID NO: 16341 - DNA, 1136 bp, Oryza sativa
gaggatttaaaaactttttccaattaaaataatcactgaaatgatctttgaattgttaaaaatacttccaatgctcaaatgatttcaagaaaaatcctgaaaatacttggacactcaacgtatttaacaaaattaaaatcagatcatttaatgattaatttaatatttaaataattgctgaactgctctttgtattattgaaattaagagttgagctccgaaaaatccgagaaaatttcagagagtataattaaccatggagaatttaataaaacttaaatccagccatgctttatatttaggaaattttatttctcacatttaacttcacttgtaaattaatgaacatttaatataaattctaataataatttattaaataatttataaatcctaagacgaaaatcaggatgtgacatcatctaagcatggtaaagctaagggaactaaaggtagcacagttgattcaggtgacaaaagtggggagcctaaggatggtgagattgaggagattgaagaagaggagattgaggagcaagaggccttgaagttcaataatttccaggatcaagttgattatgctgttcatcaagctttgattaatctatcgggtgctggtcaatactttgacaaatatcatcaagactgtggttgatatcacaattgctgagcattaggataacgggccagtctttctgccagaaggtgggttccatacatatagaagcttggtgacatgtaatcaacagcctgtctccaatgtacctccagggcagccgatggcgtcagcttcagctttgagaccaggagcatcatcttctacgtagagaccagtggtcaatcctcatgtactgactagggaacaacctcggcatgctgggaaaaacgtcaatcggctgactcaggaacagattgcagctatatttgggccatctcaaccggttgtcgagccgattcaatcgacaccaattaggcagcaagtggttcagccgattaggcagcagatggttccccaaataccggcaggacagagaacacctattattcagcaaaatcagcctgttggagctcagtttgttcctaaacagcagatacataatgtgcaacagcctcctcagaactatctgggctgcagg

SEQ ID NO: 16342 - DNA, 379 bp, Oryza sativa
aaccaagccaccttgtactgtatgcaaacccaagctcatgttgagcacaggcaggcccaaccatttcaacctgcacctcaacctgtgcagcgacatacccagaatacgccacagactgtagttgacgcacaacaggtgacaagtcaggccccagacttctacattcaacctcagcagcaatgggcacatcaaactgggcagcaagttcaccaggcaaggcagccacagccacaggttgtgcaacagcaacattacaacaatattcagcaagttccagcacagatagttcaaatgcaaacttcttctccacaggctcaaagtgcaccacatgtcacactgttggaccctccttatggatctcaacaacctgcctgtgcta

SEQ ID NO: 16343 - DNA, 1801 bp, Oryza sativa
ttcctgcagcccctaaaatttatttacgcattttaggcttttaagaaatatacaaaaatcctccaagccttatttgacttttagctttgcacattttaattgttggaggctttcacatggattttacttattctttgcataatttcgaggatgtattttagagtcgttttgggacgtgacactgtcacttcctgatttttgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaattttctcggatttttcggagctcaattcctaaatgatacaaagaacagttcagtaattatttgatcaataatgatctaattataattgttaagttcttttcttgtttaaaatccttaaattataaattgttgtttaaaaggaattattagaaataattttaaaagcttaaaagataagacctaattttaatttgttaaatctcaatataaaaatgagctagataaaattttattaaatactttgcttgttcctctattttctagaattttctaggaattgtttgagcaagggaagtattttaataaatgaaacatcatttcacgaattattttaattggaaaagtttttaaaatcctcccctaagtcgttgggccgatttcggcccaactcttctcttccccgcgcggtcgaaccggcccaagccggcccagccgacgccgcccgccccctcctcctcgggtcaccgacatgtgggacccacatgtcggacccatcttcctcctccagccgccggccaagccgagcccgagccgccctaccgcgccaccttgtgccctcaaatccgcacccaatccgaccccgattcttccgatttttgaggggtttttatcctctcatcctcctctatctttcccctcaagaatcggagcaaatggttgggtattttatccgaatcgagttcgtttcgattttatccccaaaaaccgagtttagattttcccgagccgatttcttgcgggaggagtccgatctctttaatccaaggctataaataggaccctctagttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaatgcagcggaaaacaaaagataactggagctaatccttgactcgaactgcagcgggaacaccactccacaggcatcctcgacggcacggacaaagcctactcctcggagaacccgccatcggacacatactcgagctctgggattggggaaaatagagcaaggctgagtactacccactgtactcagcaagtcataccggaacgggggtatgatgcagggattccacaagggatagctaagcaggttcatttgcataaatactggcatttataaacaggaattgaatgcgaaaacagttgtaataattaagcagtattaatcatccactgtccaacgctacaccacgttgcgacaggcccaaccatccacctaaacaatccaaattcaaaagattacactagggtgagactaatcacggtgaatctggttgactgcccataaccgcgggcacggctattcgaatagttttactctgatcagaggtgtacaaatgtacccacaagacaca

SEQ ID NO: 16344 - DNA, 9557 bp, Oryza sativa
ttagagagagggagatgaaccacggcgaccggaaaccatggccgaaggcagcggtagaggtggtgctcacccgtgcgcgaggggatgagggctccggcgacgaaccttgacggaggagaggtggacggggtggatctcggccacgcgaatccgacggcggtgacggcgcggcctggcggcgaccctaacggcggctagcggcggccggagaagcggaaaatggcggctgcggaggttgcacgacgcgggggcgatgggaggctcgagagagtgcggcgaaatggggaaaaagtgagagggggcgacggcggtgcttaaaaaggggaagagagaaccggacgtggccgggagaggcggaaatcgccggccgacgtgggggaatggggaagagagagaggcgggattcgattttcgaatcccggccatctcgggcgcgggcgcgagtgggagatagaggggagtgggcgctggagacgcggcgcacgcgcgggcgtggtcgacgtggcccggggaaggcggggacgtgggcgcggcggcggtttcggcgcggcggcgcgagcgcgagatcggcgggaggagggagacgggcccgacaggtgggccccacctgtcggcgaccccgagagaggaggcggcggggctgcctggctgggcctcggcctgcggccggcccagtaagggggagggaaggaaggagggaatgggccggcggcccattcgaaagaaaggaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacctgtagaactcaagaaaaagtcccacatgtcaaatccgattattatttgcattactttcttagggttttctcctgatttgcaccggtattttcttagggtcatttataaattacaattttggcttgggagggaaacttcggggtgtgacaaacctaccccccttaaacggaatctcggccccgagattcggaggagctggtgaagaggtgcggatgggcggctttcaactcatcttccctttcccaggttgcttcctcttctgaatgatgattccactgaactcggcaaaacctggtgaccttatttctggttcttctttcgctggtatcaagtatacgaaccggcttctccacataggttaggtcctcttggatatcaatgtgctccgaatcaacctgttcttcaggtacccttaagcacttctttaattgggacacatggaacacgtcatggatgccgatcatgttggatggaagttctagctgataagcaacttctccccttcgttccaaaattttgtatggtcccacgaagcgtggtgccaacttgccttttgtctggaaatggtgtactccccggagcggagtgacacgaagatacacgtaatctccttcctcaaaagtgagctcccttcgacggttatccgcgtagctcttctgtcgagactgagcaattctcaacctttccctgatgattctgactttctcttctacttccgctaatacctctgttccgaacagttgacgttcgcctgtctgatcccagaataaagcgcatatggctgtataaagcttccgaccgtataaagcttcaaacggtgccatctgtagactggcctggtagctgttgttgtacgagaattccgcatatggcaagcttttgtcccaagctccaccaaaatcaagagcgcaagctctcaacatatcttccaagattaaattgactcgctcggtctgaccatcagtttgcgggtgataggccgtgctgaaatttaaacgggtccccaattcttcctgtagcttctgccaaaattttgaggtgaactgactacctcggtcggatactatcttcttgggtaccccatgcaaacacatgatccttgcgaggtacaattctgccaatctctttccgtataggtggtatgcactggtataaagtgagccaccttggtgagtcgatccacgactacccagattgaatcatgacccgatgatgtccggggcagtcctgttataaagtccattccaatctcctctcatttccattccgggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttagtgctgcctgggtgaatggagtactgggtctgatgagcctcggtgagtatcagatccttcaattccttgtcgtcaggtacacacaatctttctaccatccagatcgtgccatgctcatcctcaaggaaatcccgagcctttccgactctcatgttctttttcagctctgctatttccggatcatttacttgagcggctctaacttgatccacgagcgtaggccgtgcctccagagcggctacgaacctgtgttcaacaattcccacgttgagatgcccaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgccggagatttaggtccggttgggtgaagatgtatttcagactcttatggtccgtatatatttcgcagcggttgccaatcagatagtgcctccagatcttcaaagcatgaaccactgctgccaattccaagtcatgcgttggataatttccttcgtgtggacgcaactgccgcgaggcatacgcaaccactctgccctcttgcattaggacacatccaagtccgtgacgggatgcatcacaatagacttggaagtctttcgtcgggtcgggcagaatcaaaactggtgcggatactaatttcttcttgagctcctcgaaactcttatcgcactcagctgtccatttaaacttctcatctttcttaagcaactgagtcatgggtcgggcgattctggagaaattttcgatgaatcggcggtaataacccgcaagtccaagaaaactccgaatctgcgacacggtcttaggtggggtccatttggtaactgactccacgttcgatgggtcgactgccacaccctgagctgtaatgacatgacccagaaattttacttccgtcaaccagaagtcacacttgttgaacttggcgtatagctggtgctccttcaacttctcgagtactagacggagatgttgttcatgttcctcctcggactttgaatagataagaatgtcgtcgatgaacaccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatcctcttcccggattctcaactggtggtagcctgatcacaggtctatcttagaaaacactttagctcctttcagttgatcaaacaaatcatcgattcgcggcaaagggtatttgttcttgatggtgacctcgttgagtgcgcgataatcaacgcacattctcttcgtcttatcctttttctccacaaaaatgaccggagcaccccaaggtgaagtacttggtcggatgtaccctttctgcagctgctcatcaacctgcttcttgacctcggctaattcgttggccgccattctgtacggtctcttgtaaatgggagcggttcccggtgccaagtcaatccggaattcaatctccctcttgggtggtatggtagtgaggtcttcagggaacacttctggatactcggagactatgggtatgtcttccaatttcttcaaattcttctcctcggtgaccactgggacttccatctcgatctggttcaaggagaccccttgctttggcggggctagtgatttgtacactaccgtttctcccttctcgttggtcaaggtgactgtgcgattcgcacaatcgatgactcccttgaacttagtcagccaatccatcccaagaatgacatctaggtatttggattcaagaagaatgaggttggctagaaatggtaatctttgaatttctattagcactgaagggctaaaactgactgaggttgaactattccccggggtatgaaccctcattggtgtgctaagctcttctttccttaacccatacatccccacaaatttctttgaaatgaaagaatgcgttgcaccagaatcaaaaagtactgttgcagggattgagttaacagggaacgtacctagtacgacctccggtgctgtttgtgcctcctctgcagacgcgtggttgacacgagcctggataaaccttggcccggcacgcctgggcttcgggcatttgtcagcgaagtggccaagctcaccacagttgaagcaggaccctggttttgctcccgtctccttcttggcttgcgcgggcgggcctgactgtgccggtgccatgggtgggcgtggagctgcaccgcggttgggctgacctccatggtggttctgactgccactagagccctggtggaagttgctggagttgaacgggcggtgctgacggacgatcatggtggtaggtccaccctgctgtccgggagtgaagcgcggcctctggtgacttccctgaggtgccctgaactgagcggccttcctcttcctgtccatcttgttgcgttgatcctcctggcggattgccttgtcaaccagccactcaaagtcagcgtagtccccggatatcagttggttggtcagctcatcatccaaacccgccatgaacttctcctgcttctcggcgtcggtgcggacatcctctggtgcatatcgcgcgaggcgattgaactcgtggaggtactctgtcacagtcctgttgccctgatggagtgcacgaaattccctcttcttttgtgccatgaccccatctggcacctgtgccttcctgaagctacggcagaactctacccaagtgacttcagtacccggtgggcgggtggccatgtgattgtcccaccaggctgacgcaggaccctgaagctggtgtgtggcgaaagcgaccttctcctgatcattgcactgcaggaggttcagcttcttctctatcgcatggagccagtcatttgcctccatagggttggtggtgctggagaaggtgggtggcctgacacgtaggaactcaggcaacttggactgagggggagggggaccaaactgctggtgctgctgttcggcgtgctgcatcatcctctggtgcatctgctggtgctgctgctgcatctgctgcatcatggctgccatcatctgagtctgatgtgccataacttgggctagcgtcggattctcaggaagtggtggcggaccattgccggaatcactgctggggtgcacaccattagcgcgttcttcgccgttgctgccctcgcctgttgcgcggctaccagtcctggtgtagaccatctggagggaaaagcagacgggggggaaagaagaaaaacagatgctcagaaactaagctttattacaaaggaattaaaactgcaattgttctgatctgaattaaaacacttaaagagcaagcaaaaatccttattaagacagccatatcataggcacatgatatcgaccgtcgactgaccccaaacaagcaacctaaacacaccaactaacaagcagaagctagacagtcgataaactaatgggaaaaacgagcctaatgctcggaacggctcctgcggtcggtggagtcgaaggcgtcctcctgctcgtcaccaagtccctctgagcgactcctggagcctggcagatacgtctcgccgctgccactgggagtagcagacaaccaacctccggtgccactggctggacctctggcggctgatgctggagcgaaggagagagcggactcgggagctggagctggagctgcaggaactgcgggcggaactggaggtgctgcgggagttgctgctggaggtgggttcctgggcgcaagctggatgcgcacgggtgccgtcgtagtcttgcggggcgtagtgcggatccggactcctcctggcgctggaagaccctttagctgagcgttctccttcttcaggcgcgctatctcgtccttcagagcaacgatcctcatgagcttcccatcgttcaaggccttggtcgccttgtgcaggtccgagtgcatcctgtccaatcccctcatcacagcacacatgtgaccaaaggtggtgtcgttctcgccagctgtcggacagaaggagctgacgccatcaccgttggctcgacgggggtggtagcggtacgccgtgtcgtggaagatgtagttgtcgcgctcccgtagtctggccatcatcaagtaggctgcctcctgacaggcgtgatctgctgtgcctcctgacgcctcaactgccatgttagcgaggcaagtccccacgtagccatggacctccaagcggacacggtgaggaagctcgccactaagcggcggaatagtcgtgtactccggcgcgttggggtagcccaccaccagtgtcatgcgtgccagctctgccacaaagtcgatcatgccttctccgcggtggttgggtgggtggccagccatctagagaagacaaaggagtaggatcaatgcatgctcaaatccaaatttaaataaggcaataaaagactcaaataagggaaacgaataagagcgaaatttttatgcatagatcattttgcatgagagcgaataaacaagacagacccacataacgataaaataatgagaaattagatatatactaataataacaaataaagcataaataccttgcaacccatgttcctgagctaggacctaatgcatttcacccatcaaaccccaactgactgacgaataaatcccaatagttttactaaaaccctagactgacccgttttgaaaaaactcacttaacgagcgaccaagattttttcccttgaaccacaaaaacagatcccaattttcccggaataaaatccaattgcaaagaacatatgcaatgaaaaggattcagagggctcttaggtttttccatttggcttgtcctacggtcaaggtcggctctgataccaacttgtcacgcccagaaattcccgaatagaattccaagcagaatgtgcattaaaatccccgtccaggaccagccggggtacacaaacaacaatgttgacattcagatccacgtcttacaaacatcataaaagtcttacaaaaatgcagcggaaaacaaaagataactggagctaatccttgactcgaactgcagcgggaacaccactccacaggcatcctcgacggcacggacaaagcctactcctcggagaacccgccatcggacacatactcgagctctgggattggggaaaatagagcaaggctgagtactacccactgtactcagcaagtcataccggaacgggggtatgatgcagggattccacaagggatagctaagcaggttcatttgcataaatactggcatttataaacaggaattgaatgcgaaaacagttgtaataattaagcagtattaatcatccactgtccaacgctacaccacgttgcgacaggcccaaccatccacctaaactatccaaattcaaaagattacactagggtgagactaattacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggccgtgacaggaccattcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcaaaccggtccttaactgccatgggtgcgaccagcaaaaccatgcacccacagcccaccatgcgattcattttaattaaccaacacccaagcggtgtcactagtccaacattatcatataaacctatagtctaggttttaaatgagatctccccattgtgtgctagttgaactaagcatggctaagcaaaccctagtcctaactctaatcatgttataacccaagctaacaaaggagcatggtatcaaattagcatggctgtaacaataggtaaccatcccatagtaatattgcaaaacaaatgcgatatttgaaagaaaacattaggacatttgcaatataggatcaatatgatcaagtgacaagcatgacttgccttgctctgctgctggagggacctcggcgactatctcgaagtacaccggagcgtcggaagagccggaatctagcgacatacaaggcaaacattgcaaacaggctataagactactgaaacagggaacaaaaccatttttaatggattctacacatttttcttgatttactgagacttgaatgggattaaacggagctcggatgaattagttatgaattttagaagattcactgtgtttattactataacaaaaatccttaaataatttattgcgcaatattaaccaggactgacgtcagcacgggggcgcggcgccgacatgcggggcccaccggtcagcgactcgggagagggaggaagggcgccgacacacgggacccactggtcagcggcgcgggagagaaggggcagcggcaccggctcggcttggctcacggccggccaaccgaccgcggcgacggcgacggcgtgcgcgcgaacgcgttgtcggcgacgacaaccggcggcgaaggcgacggcgcaaaggcgatgcggaggcggctgcgctaacggcggctaggaaggggaggaggcggcgataaaggcggccgccggctcggctcggcatcaaaaccgaccggccggctaggtctagcggcgacggcacgcggccaacgacggcggcgaccggcggcacgggaggcggcggcagtcgaaggcgacggcgcgcgacactaagaggagaggaaggggaaaagaagggaggggtgcctcaccgagggtggccggcgcggaggaagacgatggcgaacggcgacggcaagccacgggaggacgacgtcggcgagcggacgagcttcggggtgccctaaggaaggaggagagagggattaaagagagggagatgaaccacggcgaccggaaaccatggccgaaggcaccggtagaggtggtgctcacccgtgcgcgaggggatgagggctccggcgac

SEQ ID NO: 16345 - DNA, 4851 bp, Oryza sativa
ggttaaaattatttctagagctctgaaaattccactaaaaatcatgttaatgaatttcgacctgtagaactcaagaaaaagtcccacatgtcaaatccgattattatttgcattactttcttagggttttctcctgatttgcaccggtattttcttagggtcatttataaattacaattttggcttgggagggaaacttcgtggtgtgacactagtcctcctctttcgtttgccccttttcccgagctctctagtgcgccgtagagtcgccgccgcgtcgctttagccgccgccgtcgccggccatcctccggccacgctgcgccgccgcgtccgccgtcgttgccacctctcgttgccgccgttaggtgcgcacgggagcggggaagctcggccaccccttctccgccgtcgccggccgtcgtagcgccgttcccgccgttcaaccgagccgccgccgcctcttgcgtcgtcgccggccgtcatcgttcgtcgttggacgctttggtgagtaccgttgcgttcgtgacgtcgtcctctacgtgtagatgcccttggatagcccggccgatctctctatcgccggcgaggtcgtcgcccatgtcatgccggcgatgatgacgtcagcatgacgtcatgattcctcttttccagtttttttctaatagattaaatcttcggaaaatcataactaaataaccgtagcttcgtttcaggtggttcaagttgctaaatttttctaaaataaagatctacatattaaaattgtccataaattgaattaaatttatttaattctttttaatgggctttaattagatttaatcttgtaaaattcatattaaattcatttgaagtcagaatagggccgttcaagtctcataattcatctaaaatcatgttctacatgtttgtttattttatatgtattgtttatttggtttttattagtcttttactttgttttgcgtgttagcttgtcgtttccgtcgttgcgaaggttcgtgagtgcgctggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgtattggatgccctattccttgataccttgggtaataaattgattagcttgaaccttatatattggattggttcagctaaatgctatatgtaagtttgcttagctatgcttagaaacattagctaactaaaggggttaattataagctatgttatattattattaattatggttacattaaatggtagctcacgatggttaatcgtgcgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacaatggtacacctctggccagagtaaaactattcgaatagccgtgcccgcggttatgggcgagttaagcaatgtttttcgtggttagtctcacacctctcacaataattatagatgttatacctggtaataatttgcttagctcctggtttggagattagatctgtacagccgggtatggttgttcaggatggttgggcctatgcagcatgggtgtgatgttcagtgttgattaaaatttctgataaattactccactgttttacttctcttaaatctttgctaaatgctgcttttgcaaaagagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttctttgtaagtatgtaacgttattattaagatggatttgtatattaaattgtcagtttgtgtacctcggctgatgcctggacgaggattttatgcacaaattagttcggaaattattagtgaatttccgggcgtgacatctgccccgcgtgcaatcaatagggggaattattccccgggatcccctccccctttccccccatttttccctccctctctccctcggattcgtttggaaacccctcccctaacctcgccggaccgtggggctgccgcgtgggccccactcccgtggacccggtccgcgcgcccctcccctcggctgacgcaataaatcctttttttaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagacccgctcttcttggaagttgaagcccacgtttgggaaagcgagcaaggcaagtcacatcatctttgaacatattgaatcccagtttgtaaaattatgttgatttaaattattgcattatcgctttatttaaattcccgccgcccgtcagcgagggtggcgggcgggcccgcccgtcagcggcgcgcgcgcggggaggaggccgatgggtcgcgggggagaggagagagagggagggaggtgggccgagccggcccaagagggggaagggggggaggaaaaagacttttagggtttttctttttataaaaccactttaactttgtttatttcttcttatttattttttgtgctctgaaaattccactaaaatttatttacgcattttaggcttttaggaaatatacaaaaatcctccaagccttatttgacttttaaatttgcacattttaattgttggaggctttcacatggattttacttattctttgcataatttcgaggatgtattttagagtcgttttgggacgtgacaaacctaccccccttaaacggaatctcgaccccgagattcggaagaactggcgaagagatcgggatgggctgtcttcagctcgtcttcgcgctcccaggtagcttcttcttcggcgtggttgctccactggaccttgcaaaaacggattacccggttcctggtcctgcgctccatggtgtccaggatttttactggcctctccacgtaggtcaagtcttcgcgaacttcaatttgctctgagtcggcctgctcggatggcactcggagacatttcttgagttgtgacacatggaacacatcatgcacgttgcccaaggaggcgggcagctccaactggtaggcgacttctgtcgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtcctttttcccccttcctctattgggccggctcggcccagctccctccctctctctcctctcccctgaggcccatcggccttcccccgcgcgcgcgtcgctgactagcgggcccgcccgccaccctcgctgacgggtggggcccacccgtcatcccctacctcgtgccgcgcccgccgcctcgcccgtgccctagcgccgccgccgccgcggattccgccgcatcccgccgcccccgcgcgcaataaagaggggggaaatcactccccgtgattccctccctctttccccccacttttccctctctctctctcggattcgtttggaaatcctcccgcaaacttcgccggcgtcattgatggagccgagatcgccgcgccggtttccttcccctccggccgccctctctcactcccaacactatttaagcactccccgtgcctccctcctccgtttccgacccttgccgctttctctccccgtcggaatcgagctcgcgccgtcgtcctctctctccgccgttgccgccgagcttcggttcgccgccgtcgtcgccccggacctcctcccgcttcggcatcgcctccttcggcttcgccgcgtcctcgtcgacctcgtccaccccttcgtttcgcccgccgaccgccggaacgccgccgtcctcgtcgacccgagccgcgccgccgcctctctccgcttcggtcgccgttcccgtcatcgccgtcgacccggggtgagccgaggaccgccatctcgcttcccccttccctcccctctctcgggcgccgctccgtcgcgccggaggtcgccgccggcgaccatcggggcgcgggcgcg

SEQ ID NO: 16346 - DNA, 12538 bp, Oryza sativa
ttcctgcagccctgaaagagcatataaacttcaaatggccataacttggccatttgaactcggaattggactgttcaagtctctaatttttccttaagaagtcaagaacccattttgtgctttgtttctacttgttatatggagtttattagagtaaaagccttttcttttcggttggtcgtgtagacgctgcagcttcggaagatccgctcttcgtggaagttgaagccggcgtttgggaaagcgagcaaggcaagtcacatcatctttgaacatattgaatcccagtttataaaattatgttgatttaaattattgcattatcgctttatttaaattcccgcgttttcactgttttatttagccatgcctatttacctttgttatgaccttaatattgttattgttattatttccttgttcaccctagattaaacaaaaccccaactagtggacactctactcatggtaccactagtatgattttaggtagatgcttcgcttttaattaggtaacattaggcggttttacaactctagactttgggaatattcatatcacctggacactgtggaatggtttggttattgtggaattggattcacaccgcccccactattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatagaggtggatgaagtcgggagtcaatggacattctccagggcaaatgaaggctacacgagctgcggcccggtagtcgagatgtcatggcacagggccggtgtcctgctgctaggggctcagtcctgcctgcctgtcccgggtgttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatcttgtatagttctagaatcgtgcttacaaaatagctttgagcaactaaatagctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctgcaagatgaaggctttggtgtctagctcgtgcctgccgtcaagcgcctgtggtcgtcgccctagtcttccgttgtttctcgtttgtctttgtgtgtgctgggccttcgtcgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacagaggttcatggagaacttctccaaaatcgctcgacccatgacacagttgttgaagaaagaagagaaatttgtgtggagcccgcaatgtgagaaggcgttcagaactctcaaagaaaagctggttgcctcgccagtgttaatcttgccggatactcgcaaggacttcatagtgtattgtgacgcttcgcgccaaggattggggtgcgtgctcatgcaggacggtcatgtggtggcctatgcctcacgccagcttcgacctcatgaaggcaactaccctacccatgacttggaattagccgcggtggttcatgctctaaaaatctggcggcactatctcattgggaatcgctgtgaaatatatactgatcataagagtttgaaatacatcttcacccagtcggatctgaatcttcggcaaaggagatggttagaactcatcaaggattatgatgtgggaattcactatcatcctggtaaggccaacgtggttgccgacgctctaagtcgaaaaagccattgcaacactcttaacatccgtggcattccaccggaacttaatcaacagatggcagccctgaacctaaacatagttagtcgcggattcttggctgcgttggaagccaagcctaccttgctcgatcaaatccgcgaggctcagaagaacgatccggacatgcatggactcctcaagaatatgaaacagggtaaagccgctggtttcacagaggatgaacacggaaccctatggaatggaaatcgggtatgcgttccagatgtcagggaacttaaacagttgatacttcaggaagctcacgaaagtccttattccatccaccctggcagcacgaagatgtacttagacttgaaggagaaatactggtgggttagtatgaagcgtgaaattgcagagttcgtggccctttgtgatgtgtgccagcgtgtcaaggcagagcaccaacgaccggccggacttctccaacctctccaagtacctgaatggaaatgggatgaaattgggatggatttcatcaccggacttccaaaaacccaaggtggatatgattctatatgggtagttgtggatcgattaaccaaggtagctcgattcattcctgtgaagaccacctatagagggaacaaactagccgaactctacttcgctaggatcgtaagtctccatggcgttcctaagaaaatcgtatctgataggggaagccaattcacctctcacttttggaagaagctccaagaagagctgggtacccgattaaacttcagcacagcgtatcacctgcagacagatgggcagaccgagcgtctaaatcagatcctagaagatatgcttcgcgcatgtgtcctggatttcgagaagacctgggataagagtctcccctatgccgagttctcctacaacaacagctatcaagccagcatacaaatggcaccttatgaagcgttgtatgggcgcaaatgccggacaccgctaatgtgggatcaagttggggaaagccaagtgttcgggactgatatcctgagagaagctgaagctaaagtcagaaccattcgggataatctaaaggtggcacggtcccggcagaaaagttatgcagataaccgtcgccgtgacctggaattcgcagtggacgattttgtatatcttcgggtcacgccattgcgaggtgtacacaggtttcggacaaaagggaagctcgcacctcggtatgtgggtcctttccgtatcgttgctcgacgcggagaagtcgcttaccaattggagctgcccgcctccttgggcaacgtgcataatgtgttccatgtgtcgcaactcaagaaatgccttcgagtgccatccgagcaggccgactcagagcaaattgaagttcgcgaagacttgacctacgtggagaggccagtgaagatcctggacaccatggagcgcaggaccaggaaccgggtaatccgtttttgcaaggaccagtggagcaaccacgccgaagaagaagctacctgggagcgcgaagacgagctgaaggcagcccatccagatctcttcgccagttcttccgaatctcggggtcgagattccgtttaaggggggtaggtttgtcgcgtcccaaatcgactctaaaatacatcctcgaaattatgcaaagatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtcctttttcccccttcctctcttgggccggctcggcccagctccctccctctctctcctctcccccgcggcccatcggccttcccccgcgcgcgcgtcactgacgggcgggcccgcccgccaccctcgctgacgggtggggcccacccgtcatcccctacctcgcgccgcgcccgccgcctcgcccgtgccctagcgccgccgccgccgcggattccgccgcatcccgccgtccccgcgcgcaataaagagggggaaatcattccccgtgattccctctccctttcccccccacttttccctctctctctccctcggattcgtttggaaactctcccgcaaacttcgccggcgcatcaatggcggccggatcttccacgaccgattccccctcatccggccgctctctcctcctcccaacactacataaacactccccatgcctccctccttcgtttccgccactcgccgctctctctccccgtcggaatcgagctcgcaacgtcgtcctctctctccgccgtcgccgccgagctccggtccgccgccgtcgtcgcaccgggcctcctcccgtttcggcatcgccttcttcgggttcgccgcgtcctcgccaatctcgtccaccccttcgtttcgcccgccgaccgccggaacgccgccgtcctcgtcgacccgagccgcgccgccccctttctccgcttcggtcgccgttcccgtcgtcgccgtcgacccggggtgagccatggaccgcccatttcgcttcccccttccctcccctctctcgggcgccgctccgtcgcgccggaggtcgccgccggcgaccatcggggcgcgggcgcgccgcctcccgtcggctgtgccggcgaggccgccttcgggcgcgccccgcggctgccatgtggggcccggtcgtcagccgcccgcgtcctcgggtgcggctgacgcgtgggacccacggcgccggccggcgcaagccgcgtgcacccggtccaccgtggaccgtgaggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgttattgttattatttctttgttcaccctagattaaacaaaaccccaactagtggacactctactcatggtaccactagtatgattataggtagatgcttcgcttttaattaggtaacattaggcggttttacaactctagactttgggaatattcatatcacctggacactgtggaattgttggagtattgtggaattggattcacaccgccccctctattcaaaatccccaaaaatggtttaggctgggctcggggcgcatggttttgatagtagcacctcggccatataaggaccggtgttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgtgtttacaaaatagccctgagcaactaaatatctttaaatgctgtttactgcaaccctaacccctttatggtataactcctttgtactcccttgcatttattctgcacttgtgggtgtgtcttgttgagtacggtggttgtactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttggaaataaaaatcctttgtatttgtgaaaatcctctagtctctctctgtcttgctgcttcatttatcgccaaaatctgacctttaaaattttgcttttctttttgtttttgtttgtagatggccggcagcgtcagccgtcgtggtttggacatgactggcttcgtcttggagctgcggggcatgtgcgtggtcctggggcatccacatggagtggactaccaggccaggccgcttccggagcaggagggtgacgatgcggagccccacgctgcttgggaggtcactgcagtgatcctcgctggctctcccgagcggacttcgctgacagtcaccgcgggtggggattccttccccgccgcttgccagagcgccgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccatcagatggtgcgtcgtgggatggtcgagaacaacatgaagatcctggagctgcgtcaggagaacctgcagctcaagaaggacctagatgcggtggaggcgcagctgcatcagctcaagatcgcccagggagagatctgccgccccaagcatcgccgcgtctaccgcagccagaagatcaccgcccgcaagagcacctccaggcccgagcttgttcgtcagtccctggcgtggacttgcttcgtggagacccctcgtgccgagcccgcgcccgtggttccccaggagggggaagcctccggcgttggtagcacggaggatgcgctgttgctcaccttccgtcctggcccgtcacagcagtagacgagcagttagtaggcttgcgcgtgtgttctttctcgtttgtcttcttgttgggttgtgtggggcacggttatgccggtgtgtggtgtaactttgtcggagcctgtctttattttatttgtttaagcaacttgaactttaatgaaccaatttaatagcagtaataaattcaagaattatggtagtcgtgggtggttagctttaattgtcagctctctctgtttgctggttctatgtggggttttcagatggtgatgaccaggagaaatgctgccaccagtgatggcaaccaacccgaagacagcaaccacaacaaccatggcagcccacctccacctcctcctccgcctccaccaccaccaccagataccaacgccattctcacccaaatcctcgcccagcaggccaacatgatgactgcttttctccaccacctccaaaatccgccacaacataatgctccaccaccacctccccaacactctaaactcgccgagttcctccgcatctgtccacctaccttctctagctccaacaaccccgtggatgcgttggattggttgcatgccgtggggaaaaagctagacactgtgcagtgcagcgatgaggagaaagtcatcttcgccgcccaccagctgcagggacccgcatctctatggtgggaccatttccaggctacgcagccagagggacagcctattacatgggctcgcttcaccgccgctttccgaagaacccatgtgcccgccggagtcgtggcccttaagaaaagggaattccgagagttgaagcaaggcaaccgctccgtgatggagtatttgcacgagttcaacaacctggcccgttacgctccggaggatgtgcgggaagatgaggagaagcaagagaagttcctggcaggaatggaccctgagctgtccgtctgtctagtctccggggattatccggatttccaacgtctggtggacaagagcatccgcttggaagccaagcacaaggaactggagtcgcacaagcgccgcttggcgaatttccacaaccaacagggtgctaaccaaagggtccgctacaccaatccctatccagggggatcctcctcgcagcagcaacagcagcagcagcaacctcgctccgcgcctcgacctcaattcgtggtgcgcgtcccacagccgcagcaggagcagaatcaacaagggactcgtgcgccccgtcctcctccaccgactgtgcagcctggtcaaggccgcagggacgctcaaggtccgcagcgtctgtgcttcaactgcttcgagcccgggcactttgcggataaatgcccgaagccaaggcgtcagcaaggccaagcgcctccccgccccaacaacggtggtaaggacgtcattcggggtcgtgtgaaccatgtgacggccgaggacgtgctgacaactccagacgtcatcgttggtacgttcctcattcattccatccctgctaccattttgttcgactctggagcttcccactcatttatatctgtgccattcgtggggagaaatcagttgggggtagaaaggcttagaaaccctctgctcatcaccacccctggaggggttatgacagcaaagtattatagccctgccgtccctatagaaattcaggggattccttttccctcggatctgattctgctaggcaccaagaacttggatgtgatccttgggatgaattggttggctcaattccaaggagtagtggattgcgcgagacgcactgtcactctgtaccgagggccggaacaaccggttgttttctttgcacccccaacctcagtcagaagttcagaacttcatcagatagaactgtcagaaattcccatcgtcagagagttcggagacgtgtttccggaagaactacctggtatgccgcctaagcgagagattgagttccggatagatcttgctccaggaaccgctcctctgtacaagcgaccctaccgtatggcagcaaatgaattggccgaagttaagaaacagttggaagagctgaaagaaaaggggtatatacgtccaagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcaatcagcttaaaggtgccactgtattctccaagattgatcttcgttccggatatcaccaattacgtattcgcgaagaagatattccgaagaccgcattcaccacgcgatacggactgtatgaattcacggtgatgtcgttcggtttaaccaatgctcctgccttcttcatgaacttaatgaacaaagtgttcatggaatacttggataagtttgtggtggttttcattgatgacattctgatatactcacaatcagaggaagaccatcagcaccatctccgtctggtattgggaaagctgcgggaacatcaattgtatgccaaacttagcaagtgtgagttctggttgtccgaagtcaaattcttagggcacgtgatatctgctaaaggagttgctgtggaccccgaaacagtgatcgccgtcaccgattggaagcaacccaagacagtcactcaagttcgcagtttcttaggtttggcaggatactaccgaaggttcatcgagaacttctccaaaatcgctcgacccatgacacagttgttgaagaaagaagagaaatttgtgtggagcccgcaatgcgagaaggcgtttcaaactctcaaagaaaagctggtttcctcgccggtgttaatcttgccagatactcacaaggacttcatggtgtattgtgacgcttcgcgccaaggataggggtgcgtgctcatgcaggatggttatgtggtggcctatgcctcacgccagcttcggcctcatgaaggcaactaccctactcatgatttggagttagccgcggtggttcatgccctaaaaatctggtggcactatctcattgggaatcgctgtgaaatatatactgatcataagagtttgaaatacatcttcactcagtcggatctgaatcttcggcaaaggagatggttagaactcatcaaggattatgatgtgggaattcactatcatcctggtaaggccaacgtggtcgccgacgctctaagtcgaaagagccattgcaacactcttaacgtccgtggcattccaccggaacttaatcaacagatggaagccctgaacctaagcatagttagtcgtggattcttggctacgctggaagccaagcctaccttgctcgatcaaatctgcaaggctcagaagaatgacccggatatgcatgggctcctcaagaatatgaaacagggtaaagccgctggtttcacagaggatgaacatggaaccctatggaacggaaatcgggtatgcgttccagataacagagaacttaaggaagatgtacctagacatttcgggtatgctgatacttcaggaagctcacgaaagtccttattccatccaccctggcagtacgaagatgtacctagacttgaaggagaaatactggtgggttagtatgaagcgggaaattgcagagttcgtggccctctgtgatgtgtgccagcgtgtcaaggcagagcaccaacgaccggccggacttctccaacctctccaagtaccagaatggaaatgggatgaaattgggatggattttatcaccggacttccaaaaacccaaggcggatatgattctatatgggtagtcgtggatcgactaaccaaggtagcacggttcattcccgtaaagaccacctatggagggaacaaactagctgaactctacttcgctaggatcgtcagtctgcatggcgtccccaagaaaattgtatctgatcggggaagccagttcacctctcacttttggaagaagctccaagaagagctgggtacccgattaaatttcagcaccgcgtatcacccgcagacagatggacagaccgagcgtctaaatcagatcctagaggatatgcttcgcgcatgtgtcctagatttcgggaagacctgggataagagtctcccctatgccgagttctcctacaataacagttatcaagccagcatacaaatggcaccttatgaagcgttgtatgggcgcaaatgccggacaccgctattgtgggaccaagttggagaaagccaagtgttcgggactgatatcctgagagaagctgaagcgaaggtcagaaccattcgggataatctaaagatggcacagtcccggcagaaaagttatgcagataaccgtcgccgtgacctggaattcgcagcggatgactttgtgtatgttcgggtcacgccattgcgaggtgtacacaggtttcggacaaaggggaagctcgcacctcggtatgtgggtcctttccgtatcactgctcggcgcggagaagttgtcacgaccggaaataacccaacgggcattccttacgtgggtgcattaatccttgt

SEQ ID NO: 16347 - DNA, 2307 bp, Oryza sativa
gcagtaataattcaagaattatggtagtctgggtggttaccttaattgtcagctctctctgtttggtggttctgtgtggggttttcagatggtgagaccaggaaaaatgctgccaccagtgatggcaaccaacccgaaggcagcaaccacaacacccatggcagcccacctccacctcctcgtccgcctccaccaccaccaccagataccaatgccattctcacccaaatcctcgcccagcaggccaacatgatgactgcttttctccaccacctccaaaatccgccacaacataatgctccaccaccacctccccaacactctaaactcgccgagttcctccgcatccgtccacctaccttctctagctccaacaaccccgtggatgcgttggattggttgcatgccgtggggaaaaagctagacactgtggagtgcagcgatgaggagaaagtcatcttcgccgcccatcagctgcaggggcccgcatctctatggtgggaccatttccaggctacgcagccagagggacagcctattacttgggcccgtttcaccgccgctttccggagaacccatgtgcccgccggagtcgtggcccttaagaaaagggaattccgagagttgaagcaaggcaaccgctccgtgatggagtatttgcatgagttcaacaacctggcccgttacgccccggaggatgtgcgggaagatgaggagaagcaagagaagttcttggcaggaatggaccctgagctgtccgtccgtctagtctccggggactatctggatttccaacgtctggtggacaagagcatccgcttggaagccaagcacaaggaactggagtcgcacaagcgccgcttggcgaatttccgcaatcaacagggagctaaccaaagggtccgctacaccaatccctatccagggggatcctcctcgcagcagcaacaacagcagcagcaacctcgctccgcgccccgccctcaattcgtggtgcgcgtcccacagccgcagcaacagcagagtcagcaagggacccgtgcgcctcgtcctcctacgccaactgtgcagcctggccaaggccgcagggacgcttcaggtccgcagcgtctgtgcttcaattgcttcgagcccgggcactttgcggataaatgcccaaagccgaggcatcagcaaggccaagcgcctccctgctccaacaacggtggtaaggatgtcattcggggtcgtgtgaaccatgtgacggccgaggacgtgctgacaactccagacgtcatcgttggtacgttcctcattcattccatccctgctaccattttgttcgactctggagcttcccactcgtttatatctgtgccattcatggggagaaatcagttggggatagaaaggcttaggaaccctctgctcatcaccacccctggaggggttatgacagcaaagtactatagccctgccgtccctatagaaattcaggggattccttttccctcggatctgattctgctagacaccaagaacttggatgtgatccttgggatgaattggttggctcaattccaaggagtagtggattgtgcgagacgcaccgtcactctgtaccgagggccgggacaaccggttgttttctttgcacccccaacctctgtcagtagttcagaactgcatcagataggtctgtcagaaatccccatagtcagagagttcggagacgtgtttccggaagaactacctggtatgccgcccaagcgagagattgagttccagatagatcttgctccaggaaccactcctctgtgcaagcgaccctaccgtatggcagcaaatgaactggccgaagtcaagaaacagctggaagagttgaaagaaaaggggtacatacgtccgagcacttccccctggggtgctcctgtgatttttgtggagaagaaagacaagacgaagaggatgtgcgttgactatagagctctcaatgaagtcaccataaaaaacaagtaccctcttccccggatcgatgatctgttcgatcagcttaaaggtgccactgtattttccaagattgatcttcgttccggatatcaccaactgcgtattcgtgatgaagatattccgaagaccgcattcaccacgcgatacggactgtatgaattcacggtgatgtcattcggtttaaccaatgcacccgccttcttcatgaacttaatgaacaaagtgttcatggaatacttggataaatttgttgtggttttcattgatgacattctgatatactcacaatccgaggaagaccatcagcaccatctcggt

SEQ ID NO: 16348 - DNA, 1409 bp, Oryza sativa
cagtttctatacgtatggatactgttgttatactaatgtgagtcaagttgggacgaacttgggctcggaatatggtttcttggttgttgcatgtgcaggtgttgcttaaggccttgggagagtgttgccggtgatagatcgtagtcaacttgggagaagttgatgtccagggatcaagagatcatgcgggatactaaaggctagaggacaatgcacgtggtgatgaagaaatccatatggtatacaagaggaattgtgtacgtatggaaagaggagtcgaatttggaagggagtccgaattcgggaagtttgattgagataaggaaagagataagttgtttacttgcaaaagagggtttcctacgtgggttaggagtcctaagttatgttagattcgtgggctttgcacagcctacctcatgtataaatagagagggagggtgaggcctcccggtatcgattgtagagagactagaattgagagcaagttagggttttgagtttagttcgagattttggtgaggagtgttgttggtgcactttgtaaacactagttgatgcaataaagtcaaaaagtttcaatctacatcttcgagtttgtcatctaccggtgtttctgggtcccgatggtctaaccataggtgtacgcgcagtctgactggtgggatagctgcggtctgaccgcaggtgtccgggcggtttgaccagcgaggcgttggcggtctgaccggcggcaggagggcggttcgatcggcggcaataggacttcatcatcgtcttcgttcgagggtaatctttaattgcgcaaagattttcgggtttttggttttccctgccattcacctcccctctggtaggtttgtttggtcttgtgtgatcttacaagtggtatcagagccacgttcttctatttgatctttactggtctttagatttgttgccatggctgaaaagttttcaagcaaacctcatatttacaatggagttgattttgattattggaagaaaaagatggagtcttacattacatctcaaggctatgatatctggatgaaagttgctacagtctatgagattcctggccgtattgaaactgttgcccagaaaactgattttgaaaacaattgtaaagcacgaaatattcttcttagtgggatttctcgttctgattttgatcgtgtttcacatcttgcaactactaaatgcaattaggaacttggtgcaatatcgatctacatatcgaattaaatactcccgtaattctattatatatacagagagctcagtttatttgaatgatcatcatttcatgtgtacacatattatggcacccacctacattattcaaatattttaatatttgataaaataggttaataataacttttcttttatttgattttaatatc

SEQ ID NO: 16349 - DNA, 2881 bp, Oryza sativa
  unsure (1)..(2881): unsure at all n locations
tcctgcagccccggccgattcttggcccaatgtggtgaggcatcggctgttgatgctttgagggtcatattgtttcctttgtctttgtctgggtcgacattcacgtggttttcttcgttgccttataattctgttcatggctgggccaatttggagaaacagtttcatagttacttctacagtgggaaccatgagatgagctttccgatttgacagcagttagacagaggcatgatgaaactatgcaagattacatccagaggttcagagatatgaggaatagatgctatagtttggttttgaccgattcctagttggccgatcttgcattccagggtttgataactccgatcaaggagaagttttcgtctcaagattttgaaagcttgtctcatcttgcacagaaggtagccctacatgagcaaaggtttgcagaggctaagaaaaactttaaaaaggtcaaccatttttatccttatatgtatgaatatgaagaagaatatgactctgaggtagcagcagccgagtgggcgaggagctaaaaggttgtgacatgtcagtgggttaagagtcttggaaaagaggaaaaatatgattttgatatcaccaaggctgacaagatttttgatttgctacttcgggagaaacaaattcaacttcctgctggttatataattccattagctgaggagctaggggagctagggaaaaggaaatattgcaaatggcataattctgggtctcatgctaccaatgattgcaaagttttccggcaacaaatccagttggctattgagggaggaaagattaaattcgatgattcaaagaagccgatgaaggtagatggccatccttttcctgtcaacatgatgcatatgtctgggagagtagtcgatgggggaaaaatcggagttctcagctaaattcagctaggattatcaataaatattaaagaaggcatgataagtagcaggaaaggtattttgagcaagatgatggtggctttgacccacattgggattgtgagatttttaggttttgctggaacgaagggatgagactgccatcgatagaagattgccccaggtgcagtgacaatgcaggggtccaagccgatcttacaatagaggaaatcggctgaatcaaaaaatagtgcctgttcatcagaggttgggtccagtacaccaggatcgttttcaagatgaggatgaagacgggaaatcacatggtgcccttctggtatttttactaagaatcagaagagaagtgtccagaggatgaggaacatggagcgttttcaagaagtgcaacaagaaatcaaccatcggctgaaaaagacaaaacaagaatggcgcattaagagcaaagttatagcaaccgatgaggttgaagccaacaaagcagagtggttgctcaagggcaaagctgttgcatcttcatcggtgaatatggtttttatgttgcctgtggaatatgaggctaaacaagccgatgttgatgtggaggaaacctctactagattgattttgtcaccagagcaagcaatctgtgagaagccagaggggacagaaaatcggcatctcaagccgttgtatgttaacagattcgtcaacgggaagccgatgtccaagatgatggttgatggtggagcggctataaatttgatgccatatgctacattcaggaagctgggtagaaatacaaatgatctcatcaagacaaacatgattctcaaagattttggtggcaatccttcggaaaccaagggagttctaaatgtggagttgacagtaggcagcaaaactgttcctacaacatttttgtcatcgatgggaagggttcctatagcctgttgcttggaagggattggattcatgcaaattgttgtattccttcgaccatgcaccagtgcttgattcaatggcaaggtgacaagattgagatcatgccagccgacaggtcagttaatgttgctagtgccaatttagctctttgggcgatggatgggattgattgcctgtctggaaaagtttgggaaggagattatctaaaagtgtccgattgtgatatacagccaattgaagatggagagcccaaattattactttgaggacgtcgtggagggttcaaatttctacaccaaggacacggtggatgatctcgatggcaagctaggacagggtttcatgttggctgacaatctggaagaagttgatataggtccaggggcgataggccaaggccgacatttatcggtaagaatttatctgcagaattcagaaccaagttgatagagaatttgaaagaatatagagattgctttgcttgggagtattatgagatgccaggactcacctgatcgattgttgaacattggcttcctattaaaccaggatacaaaccatatcagcaacccccaaggagatgtaaagccgatatgtatgatgctatcaaggctgaaattactcatttatattatgctggttttattaggccgtgccgatatgctgagtgggtttccaacatagtcccggtcatcaagtaaaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16350 - DNA, 658 bp, Oryza sativa
actagggattactgtgagtagactgggatttgtgccgaccaacctacgaaaaattctaggagtgctacacatacaattagagaaggtcctgccttagagcaagtttaataatatagccaactatttgcttcaattcatttataaccaatttaatagcttattcatacaatagttacatactacattattattacctggttccacctgtcatacacacatcgcgtcttaaagtccgtgctatagctggctacaaatctgtagcccactactcttctctctcctcatttatctttttaaaatatatttgcagctagcttataacccgctattgtacctgctcttatcattgaccaccgttttgccgttttggccagatcaaactggtgtggtccgatcaaccgacgtggcacgacggctggggcagcgcaatgattctaccggtgataaatccacatttaaaaaaatcagaaatggaaaaaagtgaaacttatcaaaagcagcaaatctcaagtacaagcaccttttcttcagatagtaaaatcatgagttcgaccacgaagatgggtgcccaatattttcccaaaaatgaaaccgtcgagcttaccgatcactgtttctcatcgatctgtagtagtactccttagtggtgctctgcttg

SEQ ID NO: 16351 - DNA, 1901 bp, Oryza sativa
gatccggacatgcatggactcctcaagaatatgaaccagggtaaagccgctggtttcacagaggatgaacacggaaccctatggaatggaaatcgggtatgcgttccagacgtcagggaacttaaacagttgatacttcaggaagctcacgaaagtccttattccatccaccctggcagtacgaagatgtacttagacttgaaggagaaatactggtaggttagtatgaagcgggaaattgcagagttcgtggccctttgtgatgtgtgccagcgtgtcaaggcagagcaccaacgaccggccggacttctccaacctctccaagtaccagaatggaaaagggatgaaattgggatggatttcatcaccggacttccaaaaacccaaggtggatatgattctatatgggtagttgtggatcgattaaccaaggtagcacggttcattcccgtaaagaccacctatggagggaacaaactagctgaactctacttcgctaggatcgtaagtctgcatggcgtccccaagaaaatcgtatctgataggggaagccaattcacctctcacttttggaagaagctccaagaagagctgggtacccgattaaacttcagcaccgcataccacccgcagacagatgggcagaccgagcgtctaaatcagatcctagaagatatgcttcgcgcatgtgtcctggatttcgggaagacctgggataagagtctcccctatgccgagttctcctacaataacagctaccaagccagtatacaaatggcaccttatgaagcgttgtatggacgcaagtgccggacaccgctattgtgggaccaagttggggaaagccaagtgttcgggactgatatcctgagacaagctgaagcgaaggtcagaaccattcgggataatctaaaggtggcacagtcccggcagaaaagttatgcagataaccatcgccgtgacctggaattcgcagtggatgactttgtgtaccttcgggtcacaccattgcgagctgtacacagctttcggacaaaagggaagctcgcacctcggttcgtgggtcctttccgtatcattgctcggcgcggagaagtcgcttaccagctggaactgcccgcctccttgggcaacgtgcatgatgtgttccatgtgtcgcaactcaagaaatgccttcgagtgccatccgagcaggccgactcagagcaaattgaagttcgcgaagacttgacctacgtggagaggccagttaaaatcctggacgccatggagcgcaggaccaggagccgggtaatccgtttttgcaaggtccagtggagcaaccacgccgaggaagaagctacttgggagcgtgaagacgagctgaaggcagcccatcccgatctcttcgccagtccttctgaatctcggggtcgagattccgtttaagggggtaggtttgtcgcgtcccaaatcgactctaaaatacatcctcgaaattgtgcatagaattagtaaaatccatgtgaaagcctccaacaattaaaatgtgcaaagttaaaagtcaaataaggcttggaggatttttgtatatttcctaaaagcctaaaatgtgtaaataaattttagtggaattttcagagcacaaataataattaagaagaaataaacaaagttaaaaaggttttataaaaagaaaaatcctaaaaagtctttccccccctttttcccttcttgggccggctcggcccagctccctccctctctctcctctcccccccgcggcccatccggccttcccccgcacgcgcgccgctgacgggcgggcccgcccgccaccctcgctgacgggtggggcccacccgtcatcccctacctcgcgccgcacccgccgcctcgcccgtgccctagcgccgccgccg

SEQ ID NO: 16352 - DNA, 543 bp, Oryza sativa
tgcatcaattctactataatttaatatcacaatgcacaggagtaaagagttcaaaatttcaaaactgaaaattgaaaaaaagtaaaaaaaatagaaaacctatttttttttttggcttggtgcaggactgcatcactgcgggcgggcgttggcggcacacgctgcaggtctgcagcagtgcgctagtgcggcactgcggctgcagctgcggcggcagccggccaaggtgtcgacgcgcgcgcgtggcccggtggcgctcgctctcacgatctgatcagatcgctgatcgcgtcggcgtcgcgactcgcgagggcgaggaggagagatacagagagtcctgtgacggcgcgacgcttcggtttcttaattccgatcgattagatacaccatacacgcgcgtgtagggtggggcctgtggtaatctaatggtttaaaatattaggtacaccaatttaagtgaaaatcgacggttagatttgatagagctacgtggcagcctaagaacgtttgtaggagtcccacgtggcagcttgagtgcgtttg

SEQ ID NO: 16353 - DNA, 407 bp, Oryza sativa
gaacaacattttcccctcacaaacaaaacttagcctaatctctaatgccacatcaacattgcaaatcatcatccaatcaatttatacattttcattcacttccctgcatgaaaaaacatgccgaaactgaatatcccacagtcgtggcgggttttcgtcgaattggaatcctcgatgcggcgaattgagaaaaggtcagcaccggtggtggcagtgtcaccgctgtgatatcacggtgagggaaggaatgtatgaggctagaggctatggacccggtggcgacatcgcgcccgcatctccatgatgaaacaaatgaggacggtatagactatagaggcactcatcaagaggtggtggtgacacctcatcgagggacagaaggggttggggattgatgtattctatct

SEQ ID NO: 16354 - DNA, 1076 bp, Oryza sativa
ctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagtactagattcgtgtttgcaaaatagccctgagcaactaaatatctttaaatgctgtttactgcaaccctaacccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagcgcctgtggtcgtcgccctagtcttccgctatttctcgtttgtctttgtgtgtgctgggccttcgctgcccctgtaataaattatctatttacgcttccgcttgttaaactctgaattgtatcaacttttggtgtaccttgcctcctgggacaagggttaatgcacgcacgcaaggaacgcccgttgggtcagttccggtcgtgacaagttggtatcagagcccccttgaccctaggacgagccttagatcccaagccttagcaatattttcaaaataaaaatcccttcttatttgtgaaaatcctctattctctctctgtcctgctgcttcatttatcgccaaaatctgacctttaaaatgttgcttttctttttgtttttgtttgtagatggccggcagcgtcagccgtcgtggtttggacatgactggcttcgtcttggagctgcggggcatgtgcgtggtcctggggcatccacatggagtggactaccaggccaggccgctttcggagcaagagggtgacgatgcggaaccccacgctgcttgggaggtcactgcagtgatcctcgctggctctcccgagcggacttcgctgacagtcacc

SEQ ID NO: 16355 - DNA, 466 bp, Oryza sativa
ttcgcagtttcttaggtttggcaggatactaccgaaggttcatcgagaacttctccaaaatcgctcgacccatgacacagttgttgaagaaagaagagaaatttgtgtggagcccgcaatgcgagaaggcgtttcaaactctcaaagaaaagctggtttcctcgccggtgttaatcttgccagatactcacaaggacttcatggtgtattgtgacgcttcgcgccaaggataggggtgcgtgctcatgcaggatggttatgtggtggcctatgcctcacgccagcttcggcctcatgaaggcaactaccctactcatgatttggagttagccgcggtggttcatgccctaaaaatctggtggcactatctcattgggaatcgctgtgaaatatatactgatcataagagtttgaaatacatcttcactcagtcggatctgaatcttcggcaaaggagatggttaga

SEQ ID NO: 16356 - DNA, 761 bp, Oryza sativa
gatgttggtgatgttgctagcatggttggagtggctgctgcatcctgggcatgtgtctcactcccttggactgggattgtgaaattctccaccgtaaactccacatacgcgtcctgatctccttcttcatcagtgttgctgccccagtcccagaacgtcgtctcataaaaaaacgacgtcgcgtgacacacacacgcgtcgcaccacaaaatcatacatcttgtaggcttttgatccttgctcgtagccgatgaagaccatcctcgtgctacgatcatcaagctttctcaagtttggcttggctgtcttaacatagcccacacactcaaacacacgcaggtgttcgacagtgggtcggcgaccataccacgcttcatacggcgtcaccccatcaagactcttcattggtgatttgctcaagacatagacggctgcaaccaccgcctctccccagaaatatgccagcatgtttgccgccttcagcatggacctagctgctgccaccacagtctgattgcgccgctccacgacactgttctgctgccgtgagtagggtgcagtgatttaacgtttcacccctgtgtccgcgtagtactccatgaactctatagaggtgaattcacccccgcgatcagtgcgcagcgccatgagcttccgattgctatcctttctccacgccggcttaatcgctgccgatgcttcgtgtttggcagagaggagtcgtatccacatgtgatgactcatgtcagggccgcaggaat

SEQ ID NO: 16357 - DNA, 675 bp, Oryza sativa
aaagccatttgcatgcatggcctctcaaagctcaaagcctcaaagccatttgcatgcagccatgtacagtgccatgcaagcaaaccataataggcatcaacatgctaattaaaaccgcatgtatgcataacctatgttttttaatttgttaactgtgcctccctgtagtaagcacgtactaaggcgtcatgaactatatgggcaggtataaatatcaggaagagaaggcgctaccctcctgatatgaaacgaagcatatatgctttgtgtttagagagatcaactaatggcatcataaaggagggagtgaccaaatctgttgctaacgacatgcgggtggggaaactgtggagagttgtccaacgtgtatggcggccgcaaaaaaacttccctttaacgctaatgcactggtggagaaaccctttgtagtcccggttcgtaacccccctttagtcccggtttccagaccgggagtaccaatccgggactaaagatcgagctgacctttttttttttgaatggccctgttgctgcatggtttatatatatatatatatatatatatatatatatatatatatatatatatatatatatatatataaaaacccggcatatatatctttcaatacatatataggcatacatatatataggtatatatatatattatat

SEQ ID NO: 16358 - DNA, 1121 bp, Oryza sativa
tgggtcccacaccattttgtcacctgggttgccacgttggtatgccacgtgggcaaaagtggtaaatagttaagatgccacatctaagaggggcaaaaaaaaaagagcaaacgtaataagggtatttggataattgccaaacctaaaagtggtaaatagttaaattccccttaattgcaaggcatataactatgtgccgggaatgctcgtgtttatagggtagttaattgctagggaaaaaaaatctgctaggaattctctttcgctacaggactttatagggcagtttttaagtgccgagaatacattattgcccatctagggcagttgcattgaggggaatactaggtcatggagtagtgtatgcctgtatggacacagatcgatcgacgtcgtaactggtcagaggttctgacatgcatgggttgttcaaggaaatcaatgccatgttgcatgactgaccactatactgcaatacttctatgctgtatatatgctccctgtaattgtgtcgattttgtacattctagttccatgaaaacatttctgccttttgaataaaaaatatagggctagctctagtgctctacacactgttactgaaactaaaactttggctaggtagttaactagtactgatatcgacatacattgactgaaattataagttttcaatcgtttgttagcaaataattcttgtgcatgcagttcatttctttcttgtgttctgtttagttagggcatggcgcagcacgccctgatgtgtgggatggcacaagaagtggacgggcgtggcatgtgcagtgccatcaaggccacgatctagtttctgttttgtctatttaagttgcaatatcagataaagaaaagctgctgcttcgcagcaccaaaaactctccttgtgttccaagttttttcatcaggtgttccactgatcaccgtgtgtagcttttctctgacatcattgtgaatcttcagtttatctatgttgaataattatgaggtgttttacaaggtgataagcacctgaggagaaataaaatgtgaatgtagaacatgttgacatggcgacatttatcccttctagctagttgtagacatggatactagatagttctaga

SEQ ID NO: 16359 - DNA, 2940 bp, Oryza sativa
atcccatcccgacgagtgtgtgcccacgcgttggaagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaccaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgattattatcttgttattttggattaaaatatgccgaattatgaccaaatttccaacaatccaaaaacctgataggtcattttcggtagttggctttgctgctgcactgaaaccacatgcctttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatgttatggagcagttctatgactacaagatggtcgatgaccgttctgtagttgaacaagctcatgagattcagatgctggctaaggaacttgagaacaacaactgtgagttgccggacaagtttgtggcaggtggcattattgccaaactaccatcttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaaaaaaagcaagggaaaggcaaagggagactgctttgtgtgtggcaagtctgggcattgggccaaggactatcctgagcgcaaagacaggaagtctgccaacatgatcattagcgagggcggaggaacatcggggtacggtaaaatattacctacagttctctctgtttttcattcacctgattggtgggtggacactggtgctaatattcatgtatgtgctgacatttctctattttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataatgctgtgaaccatattagcgagaatgatgagtttaatgtgtgggcatttcgcgactctgtcatatgaatttcggttgtatgacgcgcttagctaacatgagtttaattccaaaattcactttggtaaaaggttccaagtgccatacttgtgttcaatcgaaacaaccttgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcatttctttaaaatctataaagctgaggtagaaaaccaacttgaaaggaaaatcaaacggttgaggtctgatagaggtggggagtattttcccaataagtttgcatccttttgcgaagagtttagaattattcatgagatgacgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcggaaacttggaccaaaaactgttgattgtgtgtttcttgggtatgctatccccagtgtgggttatagatttttaatagtaaactctggagtacccgacatgcatgttggtacaattcttgagtccagagatgctacattctttgagaatgaatttcctatgaaatatacccctagcacttttagtaaagaaactgtcatgccccatgagcactttgcaccgatagaacccaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtacgcagtgaaatggactcga

SEQ ID NO: 16360 - DNA, 11286 bp, Oryza sativa
ggaggagatctatatggatcaaccagacgggtatgtactagaaggtcaggagggaatggtgtgtaaactattgaaatccttgtatgggctcaagcaagcacctaagcaatggcatgagaagtttgacaccacgcttacatctgcaggctttggtgggaaccaagctgacaatgtgtatactatcgctatgggggggagaaagggtgatcttgtgcttatatgtcgatgacatactgatctttgggaccagccttaatctgattgaggaggtcaaagactatctgtccaagagttttgaaatgaaagatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcagctgaaatactctcaaatcattggttcattgatgtacttggctagcgcaacgaggcctgacatctcatttgctgtaagcaagctgacccggtttgtctcaaatccgggagatgatcattggcaggctctggaaagagtaatgcgctatctaaagggtactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatcttaaaaggaacacacctatatgagttcgactgctagtcacagtctatgagatttgggtgatctctagatactcatgaaaggcctggagtatgacttataagctccaacccgagggaatactaatggttgcctagtttcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatgactagttgatgacaattagttgctccattcctcttcctattccatgactcttactcttcatcttccattcctcttataaaatgggaatggatttgatctcccgcgagaaaaagaagacacactttcatccattttaaaaagctgttgttgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgattattatcttggttatttggaataaaaatatgccgaattatgaccaaatttccaacaaatgctaggcatgagaagtataggattttaggagtaatgatacaacatggatgccctgtaagtgtgaggaagcgggatacatggaccaattattgctagattcaggtggtagggataaagagatataaggtagcgatggaaactttctcgcatgccaagggtcatggggaggttgaagaggaacggctttttccccgtggaacccaccttattttctacaccacccataaatgtggtgtttgcaccactaataccacatgctagggtcctctttccgttaactttcattggagagaagtaaatattctctattgtaaatttgtaataatgtgtgatatcttaaaacacatttatcaaaccgttattggtgcttctacgacgaaagtttaatctaaacatgtgttatgacatccgtgatttgtattttaacatataataaggattaaatgctctgttcctacctggtaggaaccatttgagagtggtaagtagtttcaacccggtcacacgactacaaccgataaaaaagagttaaaactatattattttacatgatggttcctaccaggtttttatagaagaaacatcatttgtgaaccggggattgcaatcggtgattctttaagccgcacccacgttattcctgaccaacacgctaaaacaatatggagcgtgtgatagcttaccactgcttgcaacccaggcttacactaagtagcattgagtagggcatgtactccctccattttatattataagttttttttctagttaaatgtttttaagtttgtagaaaaatatagcaacattttcaatacaaaacaaacatgttatcaaaatatattcaatgttatatttaatgaaactaatttggtattagagatgttgctaaatttttctataaagttagtcaaacgtaaaaaagttttaccgagaaaaaaaatcatatgagacggagggagtgcaacgacaatcaatactatactcttagtcaaactatagggagggagtatagaaggaaaaaagaggatggagaagatacacaaaacaaggtgagccattagcgaatgattaattgagtattaactattttaaatttcaaaaaagaattaatatgatttcttaaaacaacttttctatagatttttttttgcaaaaaaacacatcgtttagtagttcgggaagcgtgtgcacgaagaactagacaaatctcctctctatgttcagctgccgaactcgttaacaagataagtttgctgatatggaagagagagaaacatcgttgttttttttaagaaacatcattgttatgcacaacaacggcttaatatcgactcatagtgtctataaaagaaaaatgatggaaaaagtgaaagaaatataagaaaaaaatttcagtatattaatggttagaatcttttatcattttaagttggtaagagaatagtctcagattggactaaagaggtcctatatcatgctctacttttaacatgccctttggttctaccttgaatcaatcttgggtcatatttaatcgtccataattgggaaacttggcagaacatggtttaataaaataaatgggaaaatttgaaccattccaaaatttgtgatatgccaccctgacccatatatcattgactcatgtgggtcatacatgtcattgagatacgggtggcatatctcaaattttgaaaaattagagtggtatggttccaacgaacccttaataaattcggtaggatgtccaattcggtaaatagaaagaaaaaaaaatctggcacttgagactcttgacgcgcgctaatttgttcggaaaataccacagctttccacagaacgttgaattgaaaggaccgaaatacccttcaattggggaagtttgttctccttcctcggacgctttctcctccaggaggagagggagggacgagcagcggcgagaagagatgcgcggccgatcgagggcaagaagagagagagagagagatgggattagggcatgggctggtatgtatgttgttgtcaagaaattgagtccacattggagtgtagtatggatcttggacaatcccttgatttgtgttcttcagatgaatttgtgctagtttgttttcttggtttggtgattttggttctgaatctggcattctgactctagggagtacaaagaaaaagaatccaaatgcaaccatctccatgtaatcaaatctagtgtgttttgcatcttctgatttgactactcccggcaatgcctaatcccctcctgttctttctgctagatgattgaccatcgacgacctgtgttagacgagtgacgagccagcgttgaatggagaaggggatggcaggctcaagctcaagctcgcggcgccggtggtatccagcaaagtagactatttttttgggtggtattttccgaattttgcatcctgcatcccacatgtgctatgttaaccgatttttccattcttttttatttatgtgatttaatttcgttggtctgttttaggtgctgagacaaggaaggtgttggttgtatatgacattgttggtgatgtgcttaaaaacttgacagtagtattgcttgcttacatgcattctcaaggtatagttgaattttattggttcagaacataggttcacagtttccatcccactagctaagaaaatgataaatctggagagctgtaaaaatgtttgacctccacattgaaaagtagtgggaatctggtcctctaggcaatcaaccttcaagaaatgaagtatacttcatttggtggtgctggtttcaactctcgaccagtttcaaatgccattggttgcaactattgagaatttgattcctctggcagaactaggaaagaagtcatctggccctttatctcccgttcttcctacaactaggctaatcacatcatcgcaaaaaaaaaaaaaactaggctaatcacatcagtacctatctcctctggacctatgagttcatctggtggtgcgacctcttttgctcacagccgggctgttacaaatctgaatgtagaagatggttactcaatcaagggcagcattccgaagtcaattctctggatatatggttgttcttctctttgtgatggtgtttcatagcaggtggattcattcttggcgctgttcataatcctatattgctggtagtttgtggtggtgatactttgtttctgtcgctgcaattgcgatttggaatattaatttactgaggaacaagaggcatgattttgttcatcagtcgctatcctgattctgatcttagaacagcaaaagatggacagtgcatgaaagttactggggtgtgactgtcagaaatattgattttgctccatcgttctgctgagcagttttgatttgtaggtttcacaaaatactttagatggtcatctgtagtaataatattgatattaattagaaacaagaacaaacttctaggcacatggatgctttgatcatataggttagtttcacaagcaggtaactctactaacctgtacttgacactaacatgatttcttctcataatatattttcttttgacagtaatcttgtggttatagaaacttggattgccttttagcaatatgctttatttttcacatcgttaacaactagcatatcttcacaggttgttacttatggaaattttcccgtcgagtcctcatttcaaagggttccaagatgtttgtacattggacttgcctgtatgagtacagcctacaggggatgggtatcaaaagctgctaatgctgagcattgcagattaatttaacttgggactcgggtcaatggaggtgagtttctcttcaactggaaatttgattattatcaagatgatgagatctcacagtgcgctagtgtttaatgccatgaggattttattgaagaatgcaaactgctataattcttcccaacataaaccctgcaatctcacattttccttgctatgattgtggcgacatgctgtcgatttctacatttctgatttccaatctggacggcgagcattggtcagaaaaggatatggggcacgggtaacctctaatgttgatgaatctgttgttactgacataaatccggataacaaggacgtcctgagatcctgaaacggctacgagaaaggaatgttttaagtgatgatcgtataatgttcctaaaaaaagggtactcttatttgttctgaattttggagttatatgaaatcatttcacatgcacatttacatgcagaattgcagatacatcaaggagggcagcagagtttgtattatgggggttgttcaaaggaacgacagtgtgttgatgattgttcatccatctgaacccatctcgactggcacgaagatacatcaaacatgctgagaaagagaatgcctgtcgaaatccctggatttattttgtgggatgttagagttgaaaaggatgtgcaaatgcaggttgtgattatgcattggttgtatagtgttttatgtatttttctctgttttttttctcttctgttgggctttggatacttgtaacatggatggctttagttttaccatggagctgtttggggattctcagtggaatagagttcacaagtttttgttgtgaagaattccagaagtgttataaattgttccagtttcaattttatgtgcatttcattgtaaaatttcattcccatgttatatatatttcatacataatataattccatgatctttgtacgatattaaaccaaaccattgagaaaatcgcatagtttcttttgcattttattgtgagcctaaggtgagtacattggtgatataaaagagcagacatcaggcaactttcattttattctctgtttatgacatcttctttttcttccataaggatcagatatgattgattggacgccatgtggagttagttgccaaccctcttaaagtttgatattcctgtgcgtccgttttgtgatatttttccagttcattcctatgtttggtttgaatgatatttattcctccatttaaatggagtttttgagttatttcctgtaaaactcttgcatttaaactaaagccaaaaagaagagtgaagctgaagtgtcttgtgagcctaagagatgtctcatgtcaatttcagagaagcatcatatggggagacgatggagaaaataattggtagtaataataaacaaagaaattaaggtacaacaaaattgagggaggaagggacatgaatctctgaattctctccctacaacagaccaagaatcactctctgtcacagtgtcactagcctgttgtcagctaatgctgatttccattagtataaaatgtaacaactcctactgggataaggatagctagtagattgttatccaatgagtgggaaaacaaaggaaaggatacaatataaaacatcgttaagtcgttataattgttaccattaacatacctaaaagtagagagggtatgtaacatatgtttaaataatgtttttagttgtgattttgatttcaagtatctccctagtagcttagaaactagggcccatttgatatggatgaaatgcggatgaaagctaatgaatgatatgtttataataaattaaatatgatttattgtaaacctaaccaatagattaggtggtacgttctcagtagtttacagattatagatgatctccgccacacttttcaaactcataaacgttatgttttcgcaaaaaaattcctccaataattttcttaaaattttttaaatcaacttatcaacttctaatatttaatttattcatttgtgccatcgactaattgttaaactcagtttccatctatcattatcctattttgagagggcacattgaacaagtggtctgagcaatattgatttagaaagttaatggacaaatcgtatttttagaaacatgacgtgaataatctgcaaataattcgtagcaattaatctacaaagaacagggctgcactcatagcttaaaaactagtagctttagcgatcgcaccatataaatagcattcaaataacattcgatccatgtatgacactatgtatatttggcgtattttgtgtaagaactaatgctaatatgttatgttattggtgtacggacaaatgcgttggatatatgcattcaaacgcttccgcaaatagctctagctcatatatcatagtcgccatcacctacgactagtataaaaaacgtgtattgagtgagcaatacgaatttgatatttagtgagtgaattgcattcgacatattacacatgagtagggagtggagctatgtgtatgtgagcctagtctatggaagaattgagctaatgcatatttcggaagctggaatacaagtggcaatacggcaaatggcataatgtccgaaattccctttttttaataatacatttaaaaccggtttctacgtccaacacggatgtacacagccaatgtactcactgcgctgcgtagccggtgtgctgccaagggcgttagcccataaataggtggtgaatgctgctgtggtgatcaatggacacaacaaattcatgagacaacaaactttggaagctccaagctgccatgttttcagtcaggaggattcctaagctcacatgtttttcgctgtgagcccaccagcaaccctccctctccctctctctctttctcatgcctttggttggtaccacctaatttggcatcaacttcaacaaactacacacgatcagaaactcacaatcaacattatgctgacaagatacacatgaatgcatccattatccctaaaaacagaaattaatagaaaaaaagaaaccatcaaatgatccccaattaactaacttcagttttggcctcttgtcatttgaggaccatgtatataaactctctaggctagggtcctagctaggtgcctaggtggtgatctgaattcatacatgatgtgcactttggtaagagactgagaggcagctctactaggtagcaagtcttgatcacttactgccttaatggtctttttattttttttgtatctttaagtacacggcacatggtgagttagtggggctcagtacaacacttaatgacgttgttagcgacggtattaagtgcaccacaatgcaagttttgtcctttgttttcttctcctcccttttattttttttttctgaaagtgaggttgtgctgcaagtagggagcagcatgtgccatggatgtacaatacaggctttaacacccaatgactcttgattatggtagatcctggaaagcaatgatgcaatcatgccctttcgtttttctttaaaggaacaactgatcatgttgtttagaatatcttatccgtgtatctgatatgaaatctatagtcaaaaggcaagaaatcaaatctctttttcgcgagggtgactcgtgtttcttgctacattcaacagagaatttggaccggacacacgcaatcagttcagatatgcaaacataccagtatcatgaggccacagggcaggtcagtgataacttttgtttttgacaagaaatggaaacagctccagtcatagactatataattttgatgcaattatgcaatacgaccatgacaactagaccttcaaatggactttagtgcattcttgctccgacttgaagcctgatttatccaacatggtttccacctgctcttggacgaacacttcagatccagcacttaaaacccaacattaatatcaaatcgcacatacataatcaaatagtgagtgccgtaggaagcaaccaaccagttacattcatatgctcacttgacagcagctctctcttatagatgaggcattcccagctataaatttagaatgtaatcaaatttgcttcgcaggccatgtccaccaaatgcacatacagttgaccttttaggtctcaacaagtcaaatatgacattacaacatgcagttttatatggaaacaaattcaagactggagatggaagtagatgtttttatctcagcgctttgcaaacattcttttttttttcttggcacaaagagccatccacagtccttgttggattccagctagtgttccattttctatggctgttgcagaacacaaacacaagcatccagcttctccctccatgttttattaccgtgaaccaaggctatggcacaagggctggtcgatacaataacactacagcttctgagtgaaatatacagattgcaacccaatcatagcagttgcaacagattatcttcatagtgcaaggggtggggtgattaattagcacttgggtccttgccgtcatccatatgtacattggtcatagcagagacgtgtaaccctgaacaaccttttcttgtagaagcctgcagaaaaagaatttcttttagccgaatcatagtttttggagcacatagtaaggacacaagcaaacaaacaggtgaattcccagaggaaacaaggctgtctgcgtgtagcctacatttttacaggctctgcaatcaaaaattgtacaaggcaccagagtttttaaaattttaagacaaatttacccattgacccaagttttaagttcaatgatagattcagataaaatccca

SEQ ID NO: 16361 - DNA, 11248 bp, Oryza sativa
ccctttgaaaataattaattagtcaggtgacaaattaagctaaatctcaaataaaaatggccaagaataataatcttcaacaaggttttgaaatgcatgcacatggaacaacagggaaaaaacataacaaattattggggagaaagatatgtcaactctatatactatttgttcagtgaaactgatatgttgtgttgatcagtgttggcacacagggtcaggaatatataatagaataatgccttgagaaaaaaaatcaacaagataaatattcatgcctagaatatataatagaaggtgatgtacttctgaagaatctatatagaccaaatggtatagacactggaagggaagaatgtaatatagaccacatggcatagacactgcaagggtacaatgtaaactctacagccattactaacacaatttaccaattcatgttttgtacggaatacacaagtaatgtcctgaagtaaacaaatcaactacaatggtttaatgtttgcctatgaactactgcacgtctgcaccttactataagttcaattcttagtttttaaatcaccatatagatttttgtgctatattttctagatgatggaactacaaagacctaaaagtgcaaaacagagtaattaacaaaagaggaacattgtttgccaacactgtttcaagacatgccatcacaattcatctttcatgtgcaagcgaataaagatctatagtgtatcatttgcacaagtgctatatggatatcaaatttagcttcatatttcccccctgccacacaatatttgcatgatatatccctagattacctagtaatttagggcgcacatgcaaatgagttggtgataaaataagagagatctccaaaagagaattacaaatatccatgtctagggtatttaattgtgatttaaagggtgattttaataagtgcaagccatcaaacctagaataacatatcaaagagtccatacaaatagtataatatggtgtcgtgagtcacaagagagtaactgcacatgcaagtacaaaagcaccgaggtaggcaatggataaatcgaacagaacaggcaccatggcacatgatgaagaatgtgccagtgttgaatgcccttactcttttgtattgtagagactcaaaacaacagacaggtaacaaacctaacagaaattaaaaattgcttctaaaaattattgtagcaagatattactacctccgtccagaaaagtaccgaggtaggcaatggataaattggacaaatagaacaggcatgatggcacatgactaaagaatgtgccaatgctgaatgcccttactcttttgtattgtagaaactcgaaacaacatacaggtaacaaacctaacagaattttaaaactgcttctaaaaattcttgtagcaagatatcgttctacccgtcccagaaatgtagctgtttctaggtatgcacctggacacaggttgtagttactagagcatagttatctgaattgtatagattggcatactacaacattgcaatttggtctaagaattcagctcaatagttgtagctaaataatgtaatccagttcaataggtggtagcttaaaaaatgatggtccacaatgaataccaaacacagaaaccgatgtggtgcgctaataatgttcttgaatcaaatccacaaaacaaaaatcaattaattctgcataacccgagctgggaatccaagatctcggccagccgaggccagcggctcaccttcgacgaagtaggaggccgacggccagccccgcgcggtgaaaaaggagagcgcctcctcctccgtcatgggcgcgtacacctccggctcgtacgcgagccctccggccaccacctccgcgtcggccccggacgccgccgccgcgatccggccgacgaggtccgcgaccccgtggggccgccgcatggggggaacccagaacgagcccccggggacgaaggggagccagtcgggcgccgcgcggcgcaccatgacgccgtggatcgcctcctccaggcgcctgaccccgaccacctccaccgacgcgggggaggaggcggggcccgaggtggaggcggaggagtcgtcgtcctcggcgaggtcgatctcgatgacctcgaccttggtggcgaggccgcggagagggaagaaggggcgccgccgccgccgcagccgggcgggctagggttagggttagggtttgcgcgaggaggcgagccatcgaggaggaggggggaatggagggatgcggagattgggacgaacgacgacgacgacgacgacgaagggcgaaggggatagggacgggggaggagagatgtcagatgccgcggagacgagaggagaatgggttagctcacgtgcgaggtgcgtgcgtatgtgggcccctggtgtcggtgtggcaggagcgtcggcacgttactgttggccaaaaggcctacggcccgacggcccggcccacggcatggagatttggcctggtccaggcacggcatggcccgattgttgttgggcctctgccggcccggcctgaccaatgggctgtgtctgggccttttcctcagcacgacgggcacgacaaccagggaagcaaaatagacttattccaaggcacggtccaaagaaatgaaggatgtaaaatgggcttattttaagccatataagtcacgctctaaagagatgagggaggtaaaatagatttattctaagacgagcgcgatgaattggtcgtgctttcaggccggatggcacggcccgcatcttatgacgaagagtatgacgggccgtgtcgtgcctaggctacaagcacaatatgtgggttggcttggcacgacacgacatgaagagtatgacgggttgtgtcggcctgacattttgccttgggttgtgctctagtcgtgtccgggcgaggccgtgttagatgacccatttgaccatctatatcaccggtggaggcggagtgtcggcagcgtcgtcctcggcgaggtcggtctcgatgacctcgaccttgatggcgaggccgcggagagggaagaggggcgccgccgctgggcgggctagggttaggttagggtttgcgcgaggaggcgagccatcgaggaggggaggaaagggggaatggtgggatgcggagattgggacgaacgatgacgacgatgagtcgtcgccgatgaaagggctaaggggatagagtatagaaagtttgtaaacgtatacattaaaaaccaaaaaaccgacctggaaagaaaaacgagagaaaaagacgcatatatgtggtttgttggtttttaatgtatacattttttatatatgtatacaaagtttgtatatatgtattaaaagtttgtatacatatgtataaaaaaaggaaaaaaaactaaaaagaaacggaaaaaaactaaaaagaaacggaaaaaactgaaaaagaaacggaaaaaaaagaggagagcgaaagaaaaaaaaacaaaaaagaacgagagagcgtgccgtccaccccaccccccaccccccactccgcgtgcgccacgtgtccggtcgcgcggggggaccgcgcgcgcaactagccgctaaatagtcatttcgctacacatgcacttcactctatatattatatacaagaccacaaaatcttatgtccaaactcaactcacacattaagtataaaaaaataaatttggatatgaatataatagtgatactatatatattcattcttgaatttgtttttttctcaatgtgtaggttcaatttaaatttaattttggtggaattgctagatgtgaagtgcggtgcgtgcccgagcgataagtgctcggcttcctcctgacttacctctcttgagaaatggctgagaagtgctaattaatccgtatcttgtttctcttactagatttaaacctctcttattatattcttactacttcctcagtttataatcatattataagattttctagcattacctatattcatatactacatgttaataagtgcccctttgatttgtaggaaaaatataggaattttggaggatttcaatcctatggaaaaaaaaatcctatgaaggtctttgaaacaaaggattgaatcctatccaatcctttaaaattcctatggaatgggtaatcctatgcacattttggaggaaagttagcaagaggtctaacctcttggaacatttcctctgagtctatctctctcatctgattcctgcgtttttcctgtggtccaatcaaacggccattcctgtgtttttcaaacctctgttttataattgtattcttgtcagaatcctgtgtttttcctattcctctattttttcattcctacgatttaaagggggcctgaatctagatactgtgtctagattcattaacatctatataaatgagaacaatgctagaaagtgttataacctgaaacggagatggtatattcttagatgtataggctattgcttccgtttctatgggcaaaaaaaaaatactatgttagtttatcaatgataataacaagtttaccttgtacttagatatataaatcaggacatatagtgccataattatgaaggtagtatattcacatgtcactaaaccagttttctcattattttcatgatagaaaaatctggatgttacattttactccctccatcccaaaatatagagcgtacctgctctggacacggagacgaaggatatatgtacttatcttgcccatcccaacgcgcgacgcttcgcttcacgcgcgccctcggccttcccagcgcgtagcccatcccacgtcctattttcgtgcacgtatcccatatcccacgtcctattttcacgcgtttatgagacttcttgatcgctcatgcttgcccgcgcgcgttaatttctggccccgcccgctgacaataaaaatttggaaagcatcaactaaaattagcaccatgcatgccagtttgatcggagatttggaaggcgccatcaaccaaattaaatttggaaggcatgaacgaaaattagcgccactttgagcttatcctataaatgtgggcaatggccattcacagttcacacttcacctctcttttttcttctctcgtaaaccctcacatggttcaacgtaatggctggttttgatctgaatcagcctatcaattgggatgaaattgacgatttagagggagttgtaccttatttgaactatgatttcgtttgggatcccggcaacgaaggtgctcattcatgatttgttttccttttctctcttttgtaatctgtcttttttcgatctgtacttgtttgatgatccaattttgtttcgaacgaacagatggagaaggttctggagaagagcgcagcgacggagatgacgacgccggcggcggagcggacgccggcgacggaacggaggccgtggatgcagctgaaaccacaggtactcactagtcgtttagctgtttgagctcaaagccatttgcatgcatggcctgtacaagctcaaagcctcaaagccatttgcatgcagccatgcacagtgccatgcaagcaaaccataataggcatcaacatgctaattaaagccgtatgtatgcatgacttatgttttttattttgtttactgttgcctcctttagtaagcacgtactaaggcgtcatgaactatatgtgcaggtataaatatcaggaagagaaggcactaccctcctgatatgaaacgaagcatatatgctttgtgtttagagagatcaactaatggcatcataaaggagggagtgaccaaatctgttgctaacgacatgcgggtggggaaactgtggagagttgtccaacgtgtatggcggccgcaaaaaaacttccctttaacgctaatgcactggtggagaaaccctttgtagtcccggttcgtaacccccctttagtcccggtttccaaaccgggagtaccaatccgggactaaagatcgagctgacctttttttttttgaatggccctgttgctgcatggtttatatatatatatatatatatatatatatatatatatatatatatatatatatatatatatataaaacccatgcatatatatgtttcaatacatatatatgcatacatatatatatgtatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagctaaggaccggtgaattgtgtttccgtcgtagtagaattcacccttgggatcaaggatttcttcgttgatgaatcccatgagttgttcttgaaccgctgcgataaattccttgtgtgttgtcaggttatccctcatacgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacagaggaacttatgacggtacctgtctataagttcgaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattgaactaactctgtgttgtacggcaacagtatgaacgtcttgtaatgctgcgccttcaggagatggacgagattgtcctctgtttcttgtggatattggtcgagcattgcgacgtttactctccgagggtcgatgaatccagtatcgaaaaccctttgccgtcgggccctttgaatctccattctacaacgataaaagggagtattttattttatatagtctacttatatacaaggacctaattaattaaaggagacgtatagtaagaaatctaattgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaatggctcgatctcctggtttggttgctctccaagctgagggactggtttggactttccagaagatgctttcttcagcgttcgctcatagtccgatagcttgatggcctccttgacagatgcagacatacccctgaagaagttcttaacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcgatggagctgggggggcccttgactttgaaggtgccggaagaggagcttgcggaggagtatgtgtaggagcccgaggaggagtcggtgcaggatcctgagaaggagtcggtgctggagcctagggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctaaagggtccgttgggatggccatgcccgacgccaccttcatgttgtgagagattatttattagtaatcaacatatataagcagcaactagcggaatggctaaatcttacctttattgataagttcttgaaaggaatatgtagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcagctggggatcatgggaccgatgtgcggccatgcgttcatcaaccttccttgccacctccttttgcatgttgagttcgtagctcgatacccggaactctaggtctgcaatcttcgcctcggtatctttcttgctcctcatccgactcctggacgtgtggatgtcctccttgaaaccaattttccaaggaatcacccctttcccttgtgttcgtcctggatgctctggagtctgcagggcaagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgatgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttcaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagctttttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatccttgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtggtaagtctaattacaaatcgtgatataagctaagtctaggtgacgtatattatacaaccctagctagtaaataattatatactaagtctaattacaaataaaattatcttatattaaaactcaaataatattacatgctaagactaaaatagtcatgtatatgctaagtgtttcgtgcgtaaatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctcctccaattccttctagggctagctcttccactcaggcttgacggacgactccgacaacacgtcttttctgcaagatacaaaaagatgtattaggataaatgcgaagtaacatatatatatatatatatatatatatatatatatatatatatatatatatatatatatattgcatttcacgttaacgttcgctcgttcacgttcgttcgcttgttctcattcacgttcgttccctcgttctcgcttgtcttcgttcgattgttctcgttctcgctctcgttcgttcgatcgttctcgttcttgttcacgttctcgcggcaacgtacgttgacgtgttcgttctc

SEQ ID NO: 16362 - DNA, 6183 bp, Oryza sativa
ggatctttactcctggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatatatgacttataattaataaaaattccaatatatatatatatatacttagcatatatatgaatgatattattatattggtaaaaactctaattaagatatatatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcatgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgattttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcataaatcattacgcctccactagtcaacctaacccattggcaccggaacagaggaaccttgagaggaccatagtcaagttcccatatgtcctcgatggcactgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcaatcgacccagacggtcccctcgccaggaaggcaagttgttggttgatcgactcgttacccatgagatgttgtcgtagccacgcggggaaagtatcaatgtgataccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgttttccttccgagagttccctttccccgtagtctcccttcatggcgtgattcaggtaccccgattgggcgaaggtcttggataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtgaaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgagcagcagcgctcgtaggttaaactcatcctgtttgtcctcgtcccacacggggacacattccttcttccacaactgtttaagatcttcgaccagtggtcttaggtacacgtcgatgtcgttaccaggttgcttggggccttgaataataatcggcatcattatgtacttcctcttcatgcatagccaggggggagggtgtagatacacatcgtaacgggccaagtgctatggccgctgctcatctttccaaatggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccctggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattggcgtcttccacttcatcttcttccatttcaacaccttgctctccgtgggatgtccaacaattatagcttggcatgaaccccgactcaaacaagtggaaatgaatagtcctggatgcaaaatactccttctgatttttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataacgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaatttttggagacaaaaaaagtgtgcaaaacataggtgcaaatgtagtatgacaaaaaaaaaacattggaggatgaagttgcaaaccttttaggcacctccgatttgtatgtaatcaccaaaataaatttaatagaaattttggcatgacctcccctcttttttgaagaaattttgaagcttgctcgggcagctggaggaggaagaagacatatatatataggggtgagactttagtcccggttggtagcaccaaccgggactaaagatcccggggggggggcctgacatgacctgacagcattcgaactgggactaaagatgatctttagtcccggttggtaacacaaaccgggactaaaaatcaaatatgcccgttacccttttgaaccgggactaaagatcatctttagccccggtttttattacatccgggaatattgtggaaatcggccgaccgacgaaagatggtttctccaccagtgaatggcatcgaagatgtgccggttagacagcgccatactatcaaagacctcgccaacgctttgcaaatgtcactacaaagaaaacaatttttcatagcgtcactataattttccctgacggttatatgctaaaaccgtcataaaaacataaggaggggtgggggtataggaccgccagtgaaaactgattttctctggtggccatgttaagacgtccgccataaaaaatactctatttttcgaggcggacctcttaagtatccgccagcgaaaaccaatattttcattggcggttactaaacagttccgccagcgaaaaaacagagcccgctaaaaaaatttgacgacatttaaaatctgcgcgggctgagatattttccctcacccacccatatagcaggccaaacgggcggcccggcccagcacgacacggcacgccgacggcacggcccactacggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaataaaaaaatatgagaaatatatgggaaaaattagaaaatcgtaaaaaaaataaatgggccggtgggccgtgccatgcctgggccgtgccgtgccggcacgctacagtaaacgtgccgtgccgtgccagcccacgggctgaggcatcggcccaaacacggcacgggataacgggccgtgccggcacagcccacaagctggcgtgccgtgccgggcctgggccggctacagtactgccgtgctcgggccggcccggcttggcacggcccatttggccaggtatacccacccacccg

SEQ ID NO: 16363 - DNA, 5267 bp, Oryza sativa
ggccttcccatcccctcctctcccctctcccatatctgtccgatgggagaagcccgccgctggggaggacgggcgcggggaggacggatccgccccggcggcggctcgaggagcacggatccgccccggcggtggcgcggggagcacgaccgcggggcctcgacctcgtcacgaccgacgccgtcgggccgcgggcggtggtgctcggatttctgtgaatttatgtagatttgtgtgcatttgtgtggatttctgttgatcgtgaatggaaaatatcggttgatttgtgtgcaatgtgaatggaaaattctgactgtttttattgtaaattgttgatgtaaatttatgtgaatttgtgaatcgaggagtggatttgggaataatttgaaacggtgttgacggaggcaaacggagcggtgttgctctgtcattttttttaacttgggccactattttcgctggcggttgttataacacaaccgccagcaaaaattgtttttcgctggcggccggtataacacaaccgctagtgaaaatcgattttcgctggcggccgataaccgctagcaaagattttgatcttcactagcattccgccagcaaatctaaattggccgccacgaaagatggtttttgtagtagtgtgttgaaaagcacattgcataggcgtttgaaggaagggaggtttaagcgccatacaaatgccataaagttcaccttaactgaagataatatgaaggcccgtgtccgattttgcatacaaatgcttaatagccaaagcataccggattagttattgctttgctaacataccacaaaataaagtattatgcaagaagacaggaacagattgttgataagctaacatctcaattaagttattttttaggattttacaacttgttactgacggaggaagtagttcttactttgcgggcacacactagaaaaccaaagtacaagcaaagcgattataatatatactctgtacagaggataatgaaattgtaatgcaaagattaaaactacaaagtatagcatctgggtgaattttttttttggagtagtttccagaagtctgaagtgaaattcaaacttttttttttggcaggaaattagcctgtcaccatcatcaccaaaagacgaccatagagtgagtgttgactagagcacaaacctttaagcgcgtaaccaatggtgagaaagagtcaactgaaatgcctaagttattgaggtgaattttccatagcaattgcattgaactcatcatcatccttcaaataattcatccaacaactccttcaactgctcgggcgtggacttgggcggttgattgtgcattccccttgctgctcgctcctctagatacatgctatagtgtgtgacgactttctggacgatggcttgacgcagtctctgccgaaggtcagggtttggaaccttccaaaacttgtgatttgtgtaggttctttggaattctgactcaaacctatcaagtgacaagtatcttcgaaagccgaaaggtttgccggctcttgtctttccaagactaatagaagggttttcaatgaacaggcaactcagcagaggggaccaggagacatggaggtaagtatctatgtacctctgtgtcatgcttgtttctatcagggccgaagatggcaggtccatggattcaacgcggcgcaagacaagctgccaattgttgagcaagaatatgcaccgcaatcccgggtccgagatgagaagggatgcttcctcgagcttgctcctgaggcaggagatcatatcggtgattaggttcaccaccgcgttgaagccctcggtgtcggagatgaacaagcggaagtggtgatcctgtaggatgaatttgagcacgtctccgttgcaccaaacaagtgcgatgtagttcatcatcagctgcgtccggtgagacttgccagaaggtgtccatcaggaaggatgcccgaaccttctccatcattccccagatagcatcactcagcttggacctcttccgcgagaagatgccattgatggcgtcgtcaaatgccggccccggccgcgcctcattcttcccggagccggagccggaggacatcggatgcctctttgaagaaggcgaggacggttggcgaggcgtcggagaagcagtcgtagaggtacagcatccccgggagcatctccggctcccggtggcggcggcggtggtcgtcgttgagagcggctagtgtgatggcgtcgacgaaggccagcatcctgaggatgctcgcctccgcgaactgcacaacctcctgcacgcacacgaagtccggcagctccggtgccggtgacctgttgcctgccgatccctttgtgcgaagcaggaaggcatcgtcgtcgtcggtgccggcgagtgatgacgacgaccttctgtctcggagctcgagcagcgtcatggagaggacctgcaccatgattaggagagctctcatccaccgctccatcaacgccatcaaatcttcgacggaggaggagtctagatctctttgtccggcgtggaggagcagaacccactcgacgtccagctgcgagaaccacttgtggaggagagcttcgtcatggcggcggcggccgaacgcccggatgagtccttgcgtgtagttgtcgcggaccatctggtggagcccggatgacgccgccggagccggagaagctgaccagcggccgctgccgccgccccaaggggatgacatgcaagaagacgacaacgtcgagggcgccgggctcgaagccgtggagctatcgctggaccagcctaatttttctccggcagcgctgctgatctgcgggaagaagaggccgccgcccctcctcatcgaccaccgatgctgatggggccgcccctccaaatccatgaacgacgccaaggcctccatgaacgcgtactgtatacaagaatgaaatctgtgatcgatcgccgcgagcacgtgcctccccgggccgatctcgtcagtactatatactatactactgaggattttcctcgacctcgcctactctacctagccaattaatactacttgcctattaattacttatcggctatcgcctatcgcgtcgcgtgccaccgtaaacacgtcagtagccgcggaaccctccatcgcgacgtacgcgttaagtatcccgcactccgttaggaacagttcatggtaattagcctctcggtttgggtactgctacacgtggtgacgtgcatgctgattttcctcttagacattcatgtctttttctttcttcttataaagttttctctcaaattatttatctaatctacaatccgattacaccattgtgttcgttataattaaatcttcacagcaagatcttacatgattatattacgatgaaaaaatatttatatttgtaaattacttttattatatacgtaagttacttttatcatatagtatataagttacttttagatttgactaagttacttcttagacatataaaagtaaattcaataaagtctaaaagtaatttacatatattataaaagtatcttaaaacaaaacggaagtaactttgtaatgacattagaagtaaattcgttgcagggataaaaatataactttatctagatattaaaattaatcagcacagatcaacacgcgtaagtttaacaatttttaaaagtaacttcaatgttaattagaagtaacttttgcatggttcagaagtaactctctataaatctgtttaatcactgattgtttttttcctttcatttttgtttttttttatgtagaatgagaaaagaagataaaaccgttgatggattgtaaataacattgatagaataaataataagaattaaccatgtataagatgtaatagtttctttataacatgtaataaattacttttaaattaataaaatgagaatattttcaatatgaatattgttttgtcacatattttgagtggagtaaaatgatgcaaatagatcttaaaaacaatatgtgatttaaaagatataagttattaaagagattaaaaaaagatacatactattatactattggagtacaaaccagcagtcacgtccaatgaaaaaaggcaggcattaaagttactttctttttgttataagttacttctataatatatgtaaaatacttttaagctttattgaatttacttttatatgtcgaagaagtaatttagtgaaatctaaaagtaatttagatatattataaaaataatttataatttttcatcaaaatataatcatgtgagatcttgttataaatatttaattgttatgaacacaacggtgtaatcggatcgtagatcggatgagtagtttaagataaaattttatttgaagtataggtggatagagtctctcatagatggagtgacaaaccagctacacgtccatatcaaagtatgaccgaattaactagcttctctttcacaactactcggcgcatcttaatttggctgtgtttagatccaaagtttggatctaaacttcagtccttttccatcacatcaacctatcatacacacacaacttttcagtcacatcatctctaattttaaccaaattcaaactttgcgctgaactaaacacagcctttgtaggtcggtatgcatacacatatgaattggataggaaaacaaacaacacagcaaaattacagcgaacacaaaaagacttgcgcgttaagtatgacggaaaacaacagttgaaattaatatacatattaattgacagcggtcgcaagagaggaggataacaaagctaacagctaattgaaagggacatcactcgcgtaatgccacaaagtctcccagttaaacaaccttggaaaaggctagcttgctgcaacgaactcagcagaaaattacaaccatatatacgaaataaagggaaggatctcaggaagctccctgtcatgtaccatcgaagctgagaaattatatcttactatcaagttacaacccattaaatcttaaaattcaatataactcttcgaaagaagagtgtggtggcaaggttacagatcgatattacagctcgattacatacaactaggtggtggcaaggtttgatgccgccagtggcggagcgacatgccgcgcactggcacaggtggttccatagcttcaccgtcaagaaaatgagataagcggtagctttaccacgacttggcttggccatacaaagcctaggttcaagcccgtggttagatgtttgtgtttttttcaaaacc

SEQ ID NO: 16364 - DNA, 3235 bp, Oryza sativa
tcacgggtgtgaaaaaaattaccccaaccccaaagtgaacccctgaccccccaagcggtggagaaggagagcgcctcctcctccatcatgggcgcgtatacctctggctcgtacgcgagccctccggccaccacctcccatcgcccccggctgccgccgtgatccggccgacgaggttcgcgaccccgtggggctgccgcatggggggaacccagaacgaccccccggcgacgaaggggagctagtcgggcgccacacggcgcaccatgacgccatgaatcgcctcctccaggcgcctgaccccgaccatctccaccgacgcaggggaggaggcggggcccaaggtggaggcgtccgcggcggcatcgtcctcggcgaggttgtggacccccgtttttataacaggaatcaatcgtgtaaacagtaccattttcctggatcaagtagtctggtacacacgaattcttagctgaaataccatgtgcacatacacgagtgtctagtacgaatcattacatcataagcccgcagacatagtcttaaatcatcggaccgaacggtccggaatacatcccaaaaaaagaagtaggtaaggcagcggagttaaggcagcggcacgccattgccacaggcaacgaccgtaactaagacctactgggcgccatcgtcttcatcaccctcctggtagtaagcgtagggatcctccgaagcttcatctccgacctctgattaagtttgtatattgcaagggtgagtaccaaccgtactcagcaagccaccacagcaataatacacatgacaggggtattcaaaggatggctatggttcttttgcgcaaagcaagttttgtaattcttttcacaagcctaagacctagcacagattgatcaaattttagtaccagtgttcatattaaacaatgacggttctgtccaccatccattgtgatcctaaggatagcttcccgccattgagtcgtcatggttttctgaggacgtccacattcccgcctctcaggaagtggctccatcagcatagaaatcatcatgcaatatcccatcccacacaaattaagaatttagagtctagccaagtgtaatacatgtcccggtgctcaataaccgcgagcacggctattcgaatagatttggtttactcacactgcagtggatgtacactttacccgcactccgcgactgtccaacacatgagcctcgtcccaacacatgagacgcgtcacggcaaagccttttgataacctcgcattggcagtacccactccatgaactttagtcctcatgcactctaggcgtcatacgtttctagcagtgagaggagttctggcgctcccgggaagggaaaaacacacactgctacgttgcttcttgtcgttgaacccagtccatcatgattgttctcttatgggtatcctcatgtagtattgccaagccagcctctgaccatctggaacgggcatccaccatccacctggccatccgaatcgggcatccgccagcagactgcttgccgcatcacacacctaaaagaagaccactacgcatggatattgcctccgctcagctatctactccgctaggtctatacccatacgagaagtgcggttgtacgggggtcgtttcatgcttaacttcatggctcggtccttaactgaccagggacggcactagcctttttcggacaccacccaaaacctccagccgccccagtcgaaaacagttgtttagtttttatttctcctttcacaaatcatgtcatcaacatcatggaaatgtggcgctcatgtctccacatgccacatctcaattaccttcccaaaggtaattgcccaagcatataacatttgataaatatgagtatgcatgattctaaaatagcatttctaagcaattgtcataattgactagggactcatacgtaaacatggttacaaggattttaagggtaaacaataatcaaggcatggcataatcacaagtaggatgtttatcattgcatgcaattttatttgtaaacaaaataatttcgcaattgggatcaacatgttcaaagaatagtgatgacttgccttgctcaaagtctttcgggtcttgaccttcgcttggatccgcaactctctcggactctatagttacgtgcgaaaattgatttgaattcggttagaattcaaataaaaatccaaatcaatccaaatgaaagtcgaatgcgaaagtcgattcctttatattaactttactattcgcgaactaaggcaaacccaattttgattcaaactattttgcgggtataaatattttgttgtcataagtttttaatttaatctacccgagcattatatccatataataggttagaaatttctatcgcgagctaaatatcggacgaaatcctagaaatattatacaatttaatttagtctatgactaaatgattaaatataatacacggctaaaatccctagtaattaaatccgaatttctaccgtgaatcgattacttatagggattacccaaaaataatctataataatatataagaattcatctatttgtttagttatgaattacatctaaattactaccgcgaattgatttcttatagaaattaccaagaataatccataatttatattaaattttgcaattctacgactataattaatctataattaaattctaattattttaaattttctaaacttccctaatctccccctaatttcttttttttttcttttctttttctctcctttcttttctttttccttttctttctctcttccctcttttctctctcccggctcctttctcccttcctctcttttctttttctctcctccctcccggcttctttctatctctctctctcggctctttgctcccccgggcggcgacggcggtgggcgcgaggtggagggggggaaagacggctcaccggcggcggcggtggcggcgacaacagcgacggcggcgcaggacacggcgcggcacccggtgcggtgcggcgtcaccgaggtcggcggcgcggcgtcaccgaggtcggcggcgcggcggcaacgatggtgacggcggcgcaagtcgcggcgtggcgcggcgactttgtggcgcggcgcggcggctcggaaacggccgcgcggcggcactacgacggcggcctgtggagaatgggggagagggagaggagaagggaatggagtggggaataatggagaggggtg

SEQ ID NO: 16365 - DNA, 6500 bp, Oryza sativa
agggagcacatcgaacacctacgccataatgaacagtgtattttcctatttatcccgattttagtttattttccatataaatttgattctataatttctaaatcttgcataaatgaagtttactcaatatttgtgttatctcaactaatgaattcaccctatattaatattactcatattttatttgtataatttatttgaatttttaattagggttaattcttgttccattgcatttaaatctaattaatacaaatatggtcgcgatgatattttatttatttctatccttacataatctttattttaaattataatttatttatttctttgaccaaatctaatttcagggttgattcctaattaattttcccctatttgtgatcgatgagttccgaaatcaaaatctaataaaatcatcgaataaaattggcatgatgcaatttgtttaaaaagtttttgaaggcccatatttttagagtttagatttttgtcggtcgaattttcagggtgttacagaggtcgatctcgatgacctcaaccttggtggcgaggccgctgagagagaggaggggcgtcgccgccaaacgggctagggttagggttagggtttgcgcgaggaggcaagccatcgaggaggggggaatggagggatgcggagattgggacgaacgacgacgacgacggcaatgaaagggcgaaggggatagggacggggggagagacgagagatgtcagatgccgcggagatgagaggataatggggttagctcacgtgataggtgcgtgcgtatgtgggcccccggtgtcggtgtgacaggggcgtcgatcggcacatcattgttagccaaaaggcctacggcccgacccatggcatggagatttggcctggtctaggcacgacatagcctgattgttgttgggcttgtgccggcccgacctgaccaacgggctgtgcccgggcctcttcctcggcacgacgggcccaacaacagggaggcaaaataggcttattccaaggcacggtccaaagaaatgaaggatgtaaaatgggcttatttctagccatataagtcacggtctaaagagatgagggaggtaaaatagatttattctaagatgagcatgatgggctggtcgtgctttcaggccgaactgcatggcccgcatcttataaggccgtgcctgggtcacaagtacaacctgtgggttggcccagcacggcacaaagagtatgacgggccgtgtcagcctgacatttgccttggatcgtgctctagctagtcgtgtccgggcgacgttgtgcttggtggcccatttgacttggtgcattaggaatcattgggatcaggtgcagtgcatgcccatttgcccgtttacatattgatctatcttgttcatatttttttaatttttttcataaccatttagatgatatgtaataaacgggtggacgttcactcgagctgttaaaatagtttcccggtgcaatttaggcagccgatcaatctataacgcctacaacgtatcaaacggatgagactaaaggaaatatgcttcttctcgagatcatctgcttctcctatctattcctttttcttttgcatacttcgtcacttgaagcaataacaacttggccaagagaaccccgcggttcaattatgaaaacgggccgaactcatcacattgttcaattccatcaagattcaaggttgattggggtttacttgtgctcctcattggtcaaagcattctcattctacgctactgagttccgaatcgttcgttagtttcatgcgtaagagcaagtacaatagagcatagtccgcaggctataaaaagtaacacatcatccaaatacacatgtggaggagtaagaaaattggagagggagggtagggggcgctagcgccaggctgcgcaagaaacaatgtaaatcacgggtaagtggtaacggtgcaaatcaatgaaataagtaaaccaaaggaaaattttctttcctacaagttatagagagaaaacataagaaattttacatccactcaaacctccattttttctattcccatgttgaaattctcaaaacaaataggccctaaactgaattagagctattacctatctcgaggacctgatccactataaaagttcatgtttcccgtcctcttccaatctcgcgtataccttggtatcaatgcaccttacgtccttgaaataccgttgttggttacattacttcgacaaaaacatatgttcaacggtcagctgctttgggcctatttggtacatcttctattctgagatccttgtctcctatagttcctatagttaaagttgtaccaaacacttctgagattatatataatatgaaccagggttaatggattgactcgacaaaaaatggacaatgagaatggagcgacattccctccgctcagcccttggagtaggaggtataccaaaaggtcccttcgtctatttaaacatagatgtaatattatattatatattttaaaaattacaatgtaggttttatgatttctattgtaaatttaatttagaataaattttacgaaactacaaatactttgaccaaagtatcacaaaactagatatttaagaatgtgtatctaaaactacaaatttagcatgaaatttatcatagaactacaaattttagagtttatatccattgcactattgagattataaaagtttaattttgtgattaaactgatgttaaatctgtagttttctgatatgaaaccttaaatatgtaattttgtgaaaaatacaatttcaaatctttagtacatgtagttttagttttgtgaaatttactctttaatttataatttaaaaaaatgtctgaaaatgtggcgctataatttaataaaaatgcttacaatcggccgtccgatgtgaggcgcaaacgtcggacggacgcgcgagccgttcgatccgctaggaacgacacgagactagcaggtagcgaaccttatctcttcatcgctcattgtcgtccactcatttccctcaccctttcctccctcctccccttcttatctctctcttctccaagaaaccagagctgcttgcaagtccaagctcctaggtgatgcaagctccaaggggagagggaggtctggtcggcatgcgacggtagcgtggtcgacactggagtgggaggtctggccagcgtgcgatggcagcgtggtcgccgatgtcgcctaggcagcagcaagctcctaggtgatgcatgcagcgaccctacgcgtcaagctgaccaaccaggcgatggcaccacttcttctctcgcgttcaatgtgtcgccgtggaggccggcaccgtcatggacgtcgacgcctcaccaccgggagcatgtaggggagaagtacaagaacgggtgtgttgagatttttttcaatgtttcagatagtttagtttgatgtttctttgggttggatcgaatgttgcaattggattttagatggtgttccataactttgctccttgatgcaaaccaccaatggaaatttgttgtttcacatgtgtgaatgaaatgtttcggtcatgacttgaatatgtttcagcattttaacaatgtgaaacatttttttctagtggtgaaacattttcgtagtagcgctgaaagagcgcccaattttttattttttgatgtttcaccccatgtaccataatatagttagatttaaaatgttccagtgaggttgtcagtagtgtttcattcttttttttcgtcgtagttggatgtgtttcatgtttcattttgtaccgtgtagtaaaatgttttattgcgtgatttgattgtgtttcactattttttttaatgaaacatatttaggagaaaaatcgagcgcctgatttataggtgcttccgccggcgacagagagaaccgctggtggcagagtcgtgccgcgcagcgccaatcgcgccaccgagaagatcacttcgagctagcggtcaacgggtttattttgttcgggacgttgcaaccgcaaggcagggtgtcctgtgcacacttttaatcgacggctaacagcgtgcgcgcagatcagacggttcatatatacgtctgaattgacgcgtagcgctctccatagtttggtccttgtaatattgtgctttactaaaatttacaccatttacaaatatcaaatataactacaggtgtgtagtgcacatgcacatgaacatgcattgtatattgacttttctataattgtgaaagttagccatcgaatagtactataccgaaaaaaaaagaaaaatccatctgtcagtctcacatccggtcccacatgtcagtctcacgttgctgctctcgtaacaaacacggattacacgagctcttatatatatatttgactcccgaaatctcgacgcttacggcggcgcgcgactactattacggcgatcggatctgctcgccgccgccaccgccaccgccgccgctgacgacgacgacgacgacgactgagcgagccatggactatttcacggggacggggactatcgtggtctccgacgacagcctctacgccgccttcggctacggcgaccccttcggcttcgccccgcgcgcgaggcccccgatccgttccctgcccttcgccgccggcggctaccagtggtgcctctggttccaccccaccaccttcgccggcttcttcggcttcggcgtcgagctcctcaccgccggcgccaaggccagggcgtccttcgagttcggccccgtcgacgccgcctcccacaacgtcatcgtgcggatgccgcccttcctcttcgaccacccccaccaccccatggtcatcatggtctggcccaaggccatgctcgccgaggaggcgacactgttcgtccgcgaccacgccgtcgtgttccgggtcgacgtcaccgtcgtcccggacgagccgctgcctccggacgccggcgtcggcgacgacgacgtgctgccgccctcggacatgctggcccagctcggcaacgtctacgacaccaaggagggcgcggacgtgacgttctccgtcgacggcgagctcttcgccgcgcaccgggtcatcctcgccatgcgctcgccggtgttcagggcggcggtgtacggcgagatgagggagagcggccgcggcggcggaccgatcgccatcgacgacatgcgccccgacgtgttcgacgcgctgctccgctacatctacaccgacgccctccccgccgccgccgacgacgacgacatggaggcaacgtggagcgacctcctggtcgccgccgaccggtacggcgtggagaggctgaagctgatctgcgagcgcgcgctgcgcgggaggctcgacgccggcaacgtcgccgacatgctggcgctggccgaccggcagcactgcgagacgctcaaggatgcttgcatcaagttcatggcgacgtcggggaagatggaggaggtgaaggcgagccaggggtacgtgcagctccgtacttcttgccctttgctcttggtcgaggttttagagaagtcaagcaaattttgcaaaccttaattactaggacaactggacaattgtacagattaataaaggtagtgataagtggatacaatatgttataatgttggtcttttggccattatttttctatgccttacggaatacgtactttaatgaaaactgaatactccgtatgtaaaaaaaaaaatccaacctacgtaggaatatgacaatgtgacactacctaggacaacggatatgaacaaactgatccgcagctaggttggttttccttggaacggagagagtacatcactttcaacctctgcatgttctattctttcctctctcatcctacctcctttccccaaatcccccattccgttcttcctctgctaggcaagatgacaagatgtagactacgcatgattaccaccggcatcgagtgacctccaggaatgcctgattctcatttatatacagatggtggccgatagagaaacgggagccaaagaccaaatcggcgtctaccttgagctcatcaccaagggaaccaaggcgagagcctcctacaagctcagactactcaaccatgtcaccgcctgtccttgcttgtggtacacctgcccactcaaaatctatgactctatcgatgataacaaatctttcacctggggaaccaagaaattcgctgacaggagcaagctagaagtcgcatcggagtatctacaagacgttcgcctcgtaatcgagtgcgatgtcatgccattagtaaggatcgaagcgatcgcggaaatcatccgatcaccttcttctccttggtcgcaactgtcagaagacattggcaagctgctagagatggagaccggacggagccgacgtgagcttcaaggtcaacggtgaggccatcgacgcgcatagcatggtgctggtggcacgatcaccggtgttcaaagcggagctcaacaggctgattagaggcgagagagggctcaagataa

SEQ ID NO: 16366 - DNA, 17074 bp, Oryza sativa
tctcgcgcctcattggcccatggagctccactttgaacaccattgatcgtgtcgctagcaccataagacgggccaatgagagggaagagaaatatctcggtgaagaagagaggaaggagttgatcaagcatttgctcattaccgtggatcgctatgctatcgaggggttgaagacgatgctcgaagacggactctgcaaggtccttagcttaggcaacgtcaaggagatgtttgccctaactgatcagcatgattgcagcatattgaaggatgtgtgttttgaatttatcacctcctcatcggtccatggattgggcgatgtggctttgagtgaagggtatgagagcctacgagaatcttgtcttgctgccatagtagatgccttacagcgagtacaatagcaggctatatgggcagtcctaatcctccacctaggatggtgtctatagcattaactacattgctatgtaggacttttagcttatgtggcactatattaattgagagagagagagtgaagagaggaagaaactgggtcttatgcaagacacagcttcaacacgagaacctatgcattagacactatcaagttttgcattgggagagaataatgtcttcctaatagatgaagaataaatatgattggtagagaagagagatgatgtatttattaatggcccactttaagaaaccatgggttgtagagtagagtgtagtttctattgtgatgtcttattgacatggcaccatagacactgcttatgggcactatgggttgggactgctctaagtcagctctaagcacacatggaggagagaagagaaaagagagaagaaaagcgggctacagatttgtagccagctgcagcacgaactccaatacattttgtgtgtatgagaggtgggactatatattagtgatgtagtatatacttataggtaactattatatgaatgagctattagattggctatagatgaattggagcctattaaacttgccaccatacgtaagagacaatctgtacacaaactctagaggaaaatgatagtattaaattaaggggggttgtgatgatatggattaaattagagttagcaaccactggcctctattttatataaaacttgctcttttagagtacttcatatttctatttgagaacggtagtatcagctcaagaatcaagacagtctgtgttccttccacaaggttcccaacctcactcctccattttccgcgcgcacgcttttcaaacagcttaatgatatgttttttgcaaaaagtttctatacgaaagttgctttaaaaaatcaaattaatctattttttttaaaaaaatctaatacttaattaatcatgtactaatggaccgctccatttttcatgcggtggagttgagttcccaaccccaaggatcaaacacacagtcgtgcctatatttctgaagagcgacttcaactgaataagttgagaggaaaggtattgggataatgtgctgggggtagggatgaaaacggagcggatacaaacggataatgctcataccatattcgttttcatattttttgccggatacggaaacgaatacggatagctcgaatacggaaacaaatacggactatcttgaatacgaataagaatagaatatgatcggacacgaatacggaaacaaatttttctcggaacatgaaaacaaattcaacttctaatagaaacaaatatcaacatatataattagctcattttatataaaatgtagtataatttataaatatttttaaaattttaaataatattaataatgtggactaatgttaagagatgaactactattaaaatctaaaaaggtatattgaaggtcatagagttataaagaaatgagatatgtcttgtggcttctgcggatatccgaataacactgtttaccggatatccgaattattatccgtatccgacggaaaacctgataccatattcgtattcgtatccgagagaaaatatccgtatccgtatccgtatccgaactatccgagaattatccgatccgaaaggtatccgtattcgtttttatccggagcggacggaaactatctactccgttttcatccctagctgggggaaccgatcctagtataggctcttcttacggcttttctatccagtggatcgacatggctgttgttgtatgtgatacagtaccaagagcgatacatatagggtacagggttcactatattggtttagtgttttctactggggtcaccgaaatcctaaaattttaaaaattttggaatttcggtctgaaatttctgaaattttaaacaaaatttagttgtatttaataaatattatccaaattcatgaaaaaaaattgaaaaattcaaaaatttcggccaaattaatatcgtatcgggggtcaccgaaatgaccgaaatttccgaaatttctaaccctgatagggtattgcctcttctttgagtgcgtttatgagctacagtacccaaagcttgaacaaccaaaaccggtcagcatgtagatatctacctgctactggcatatttttgtttaggtaatggaatttattttagcctttgcttcagaaaaactacaaccctttattatagagtttgcaattcgaacgtgttacatatgtcagttgatgcatatatagcaagaaaactaattgggtcactatcctaaagacatagcatactttctatagttggcgaaaaccctacaggttgcatatacttattagcggatctagaaatatttttgaacccgagcaaacttcaatttactaaagaaattctattttaatttttttaattgtatgaaattttaatggattccccgctgacgagcctgggcggttgctcaggatcaccgggcgatagatccatccatacatatacatgtagtccttgctctaatcaaactaaaaactagatcgactatccaaaatcagtgcccgaccgttctatcaatctaaaactcacatcaccgccggcaccatcgaaccgaagcggaatgtattcatcgaagtataactgcattacaaattaaccgctcgtccaagcgtagtcgctaaatgtagacggtgaccatcaactggttaggttcttgttgtgaaaccaacccaccttccaaacatagtcgcaaaacgtgaggaacaatagatggcgaccattaaccggtcctattggttaggttccttgtagtggaaccaattcacattggttcaagttctagacgtgatacatgtactcacatttatgattatttatttttcagtggtagacgacgtagcgtgctgcgttttttggtcgccgatggctgctgctctcgctattgtgcgatgcgaacttgcgaagctaaatgataggcgatcgaagaaaggcgaggcatcggcgttgggtgtgttgcctatatctgatctctctcgatctctcgttaatgggctgaaaaggcagaccattttttactaatgggcttaccagtgagagagaaattggggctgtcggcccaaatctaataggggtggggggtgtgtttgcccacctcgccccccctagcttcgccactcgaaggtgaaggggacgtggtgtctccatccacgggacgatcgcccctcgccgttattaattctagctgagctcgagctctaacgacctcgatctcggcggcactgggcagattacactagtggagaaaccatctttcatgagttggtcaaaaatcacaatagttctggttgctcaaaaaaccgagactaaataacatttttagtcccggttcataagtccaatggcactttatgatatttaatctggttggtaacactaaccgggactaaatatcgatcaatagctgttaggccatgtccgccccctaaccggaattaaaaatcatatctttagttccggttgatatcaacaatcgggactagatatctttctcccacgtcctacctcgagatgcaaatcccacgtctttatctctctcccacggcacgattgaccctagaaaaatgagagagactgagagacctagccacgtccttatctctcttgtctctttctcttctatcgctcgctctctatccgtcgatcccctcctctctcgccttcaaactaaaatatccttatttgaaaatacaaggaaaaaaaatccaaactaccaaactactaaactcttagactcctaaattactaaactacaactaatgaattccacaggcaaaacctcgagtgtatactagcctagaaaaactcgtcgttgccggtgacctcgctatcttcttgtcttcttgttagtaactgcttcaagtttgactaaatttgtagaaaaaaaataataacattttcaacccaagacaaatttattatgaaaatatattcaattatcgatttaatgaaactaatttggtattataaatattactatatttatctataaacttagtcaaacttgaagtagtttgactataaccaaagtcaaaacttcttataacctaaaacagagggagtagatgatagcgatggacggatgagattatatgagacggcagatgaacggatgagatgtgatgggatgatttgactcgtaggattgctaggggtgaactcctcctttttatattagtatagattgataggatcacaattctcaagttaacaacgctggataaatcacttgcaactcaccggcttgcgacattgaatttaaatatactggccaagagggcatgcgttgcaacggaaaacaaattgagtttatagcttattaactcaatcaatcgcatatttaattcaaatagtacttttatgattttccttattaaataagtaggtgattttaaaatttttgggagagccaacaatgaaaagagaaagaacttattggagggtggcgtaataatgtaatttgtgggacccaaatatgagctgtaggcgtagtgtggtagaacagataccactacctctaacattacatttatttaatgtaacataggttgttgttgactttatttaataagacttttaaaatttttaccatcaataattctcaaatatttagcttgcagaaataaaaataaaaagtagaatttttatagttacttttacaatatacctcttgaaatttttttcattcaattcatacattttccctatgttttatacaactgtatttctatgaaaatattttcttttacaattgcgtgtttcaaaagaaacctttatcattgtgttagattttgttgttatcatcacatttatcaatatcacaaattcaattgcaaactaaaaaaaaaatcacaccagtaatacatagcaaatcccttaaacatatggcgctattgaataattcatgcaaaattttgaaaccttgatcactaataattctcaaatatttagcttaaaaaaacatattgatagattttcataagaacttttgttaggctaccttttcttggtagaaaaaacatatgattcttggaggattttaaatcctttatggaaaatttctaggaaaagctctatggccccatcgtttggcttatttaggaaataagccaaacggcatatttacaaactaaaaataatttataaataacgtgttcttagcgattcaaaagtaaatgctgaaaaataaactttattgaaaaaaatcccaaaattaacatcaaatttaaggttgaaaatttaaattttcattgataagcataagcgtaataaaaaaaatgaggctactaatctcttggattatttttttcaaagtttacctcaatcatgtgcttcctatatttttccaacggtctatgatcttttctccttttgcatttttatgtgttatgcagttacatttctttcaaaatcttgtgtattttttttctcatttatgcttttttttcatccttcatttcaaagtaagtgttcatagggtgagcacgtgcgtttttgtactgattgaatccaacgctaatccccgcgcaaccaactccagcgagcgaggcaaaggaggcatgcggcggcgcgcattggactagcggagagataaagagagaagagaggggcttgggtaagagacggcgatggtggcagccgcagtctcggtgcaaatccagcgacggggtcgagctcaccacccggcggagaaaggtggagctaggggggagtgcgggttacaacctcaaaatccaacaggcgcgctactgcgggagctagaaggaagcgggggttgcaaccttcaaatccgaggaccacatcgcggccggagcttgaggggagggtgggtcccttgcagcctacgggggttgggacgggtgatgttttccaactgatcacctttgtggggcaagggcccaggggagggggtgtcgaaacatgatttggccaataataaacgggggtagcgcagagaccttaaaagtggaaggatgtgaagacaaaggatttagacaggttcaggccctctcaatgagaggtaataccctactcgtgtttagggatttgaatccgccgagtgtgtattgatctgacgatcaggttgtttcatatatgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccataccgtgtgggtatggggtacccataatctccacagtagcccctgagaccttcacagtcggaaagataaccttctctcgaactagattactccaaagccgagtgcttcaatcatcttcgccatggtctcccgagtacttttaccaaatctgaagactgtggagggctgaaaaatatagtcaggtgcatcgactagatgcacctaataggtgtaacccccgactatgtggttaatcgaacaaaccaaacatatagtcaaggaataaataatccaaccaaccgagtggtttttgataattatagtcaaccaagtgacttgataccaatatatagcatatgcggtgtgaatccccgaataatatgattcaagtgatataccgactgcttggcaaaatatgatgcgtacaacctaaagttgacaacatctttgaaagttcacatagcaaaacaattataaagaagcttgaatgctgtgaataaagaaatttccaaagtattgggcatacgccatgcgcacactgctttaacagatgtgcttaagtccctaaaagacacatggtttcaccacacctggaaatatatggcatatatggtataacatccgagtaagtaaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagccagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctagaccaaaaaatatgccttcgacaccctttaaaggatgacgcatgtaacatgctctcgagtaataaatcttccgggtgatatagaccaggtgtagctcatatgaatagcttctgatctgagtgattatcccttatgagatactccaaaatatatataataattgaatcccgactgacgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaggcgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaaggaaataatcggcggcgacaaacgcatccgacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaaatagcagcaatagagtttgccagtgccgaagataataaagatgaagtcgctccaccatgatgacaaagttgcatcgccgtgatgaagtgaacacgagtcggcggcaacagaagcaaactggtagcgaagacgcgcagttgtgaagataaaagcactagtcggcggcggcataaccagtcgacaacggaagacgatgatgtccatcagtagtggtagctgtataaaccagacgttgaggtgagggcactagtcagcagcagacgagacgaccggcggtgaagaagataaggccaatcaatactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgtaggcggaaacaccagtcggcggcggtcgaggcggccggtcggtgaagacgtagacgcccaacaacgacggcataataagtcagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataataagtcagccgtgcaggcggaagcaccagtcggcggcggacaaggcggccggtcggtgaagacgtagacgcccgacaacggcggcataaaggccagccgtgcaggcggaagcaccagtcggcggcggcgaaggcaagccggtcggtgaagacgtagacgcccaacaacgacggcataataggccagccgtgcaggcggaaacaccagtcggcggcggtcgaggcgagccggtggtggtgttctgactgatccattcctggagcgtaagagataagcttaaagccatgaatcccttttatgcacatctggatctggatcctgcggaacaaacatataggatgagtagtatctgatataaatataatactcgagaaaaaatcaagtatttaaaatatttataaatatgtatttctcctcttgtcaattttgatttccccgagcagatgactcattacgtttaaacactctgcccgactagtcatagccaccaagcactgggagtcggcctaggcatttcccaaacatgcatatgagtgacatgagttcgtcattaatggaacaaagtttcacggatcagaatttactacttaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaacggcggcataataggccagccgtgtaagcggaaacaccagtcgacggcaacgaaggtgagccaacggtgaagatgtagacatccaacaacggcggcaaaataggccagccgtgcaggcgaaaacaccagtcggcgaaggccagccggtcggtaaagacgtggacgcccatgaacggtggtgtgaccaaccgaccgtataggcagggacaccagtcggcggcgacggaggcaggccggcggtgtagatgacgatgcccatcaacggtggtgtgaccaaccgaccgtataggcgagggcaccagtcggcggcgacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccaatcggcggcgacggaggcaggccggcggtgaggacgtaaacgcccaacagcggcggcataataggccagccgtgtaggcggaggccccagtcggcggcgacggaggcaggccggcggtgaagtcgtagacgcccaacagcgggggcataataggccagccgtgtaggcggaggcaccagtcggcggcgacggaggcggccagccgtgtaggcggaggcaccactcggcggcgacggaggcaagccggcggtgaagtcgtagacgcccaacagcggcggcataataggccagccgtgtaggcggaggcaccagtcggcggcgacggaggcaggccggtggtgaagacgtagacgcccaacaacggtggtgtaccaaccaaccatataggcgaagacaccagtcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtagttatatgcgaacaacaacaaaaaatagcaagagattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgctcgttgataggaaactcggcgcaacccctacctggcgcgccaactgtcgaaacatgatttcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatatatgccccctagagggcctcctgcccaccttatataggatggggggcaggattacaagatagaaaccttaaccaatacggtatcggttttctaaatcaggactttaggccgttccgtaatatacaaggaaacgtaacacccaagtcatgatctgttacatattacatagatataagttatcccctataactagtcggataaccatgccgtgtgggtatggggtacccataatctccacagcgggggctgggtcgttccagcccgaaccgtcccattgtcattcctacttgggatctcgagtacaccggttttgtaagttgagaaacgtgttatatctagtattacgggaataacgtaatttgaagtttgcattaagatgagggaccttaagtgaacttattcctcatcgtttggagcgcaggctgggcctggcccacatagaacgagacccgagcctgagtcggattccgactccgactactaggatagggtttgcatcctctataaatcggagcccgccgctgcttcctcttcttcccacaattccccaagcatccgtacgcctcgacgtctccaagcaagggcggcaaggcgaatcgcggcggccggtcaggcggagcagcagcgcatcgagcacatggagaccaaggagggtgcgacgacgaccctgatgcccgcggctaaagctttcgccggggccggaggaggtggagacaacgtcgagaagaagcctcctgtagtgagcaagaaggtgccgatgccgcaggtcttgctcgactacatcctctcatggacgaggatgggaccatggccgagctccgacgaccactcggagttcctcctctcgccggagcatcgcaaccaggacgacgacgatggcttcgccgcgttcgaggccaaggtccgtgcgcagcgcgaggagctgtccgccttcctcgacaagaaggacgatgagttcgccgtgttccaggccaaggtccgtgacgaggtcgacgagaacggctgctacatggtcgatggcacctacttcgccgatctggaagcagcccaggctctctccaatgaactatttgccaagctgaacatgagtggcatcctgttcgaggaggactgactgagatgcatgccatcctgattgacaacagtcaacaggcttcttaactgtcatggtagtagtgggcacgactaattgacaacaggcttaatcgtaattgtttaatcaattatctcttgtttatattaactagaaaaaatacccgtgcattgcgacaaattagtttgatagcgcatgtcgatggtactttcttcctgtgcccattcaatatttattaagcttgcatgtacaaatgttcagtttcatatatcgaatgcaatgtattagggcacattaattatatctttgagcatgattctgttttgccattacctttatctcaagtcgtaagcatggcgcgacgtctcctcccctcccggtgtgcaaccacatctccttctgttaatttttcatatatatatatatatatatatatatatatatatatatatatatatatatatatatatatatatatatatatatattttctactggtttgctgaaatgcaaattagtatttttgttttaggattgttatacttaccctcgcaatatggtagataattggataggcaatatggtagacaagcagttttgtgcaacttatccttattgattgtggttattgttccaaatctgcagtgatgtaagaggaaacaatctcacagggaccattacagtgagcatatatagggagctgcactagctttgagattttgtatgttcgatcttgctaatatttcagtgatatttcattgttcatgagtttcagacaccatgacgcgaacttcttatatgcattgtagggacatttcatataaccaaaagtccaaaactctggagaaataccttacaaaagtctttcttcgagtagccacactataagaattccttagttattgcaaatcttctagcttgttatgtgatttttcgttcgtatcttctcaatgttatagatgcttacttacagcctctatgttgtgcgctttctattcgtgttacataggtcacttcaagaaatagaatgaccggaaaaattccagatgtgattggccttatgcgggttcttgctgttctatgagtagaccacaacattttaatccataggttcagtagtttctgtatgattagataatgaattcttatattcaaattttgattctcagagacctgagtgagaacgagctggtaggttctactccctccttccctaaatatctgatgccgttgacttttttaaacatgtttgaccgttcgtcttattcaaaaacttttgtaaaatgtgtaaaactatatgtatacttaaaagtatatttaacaataaatcaaataatagaaaaagaattaataattacttaaaattttttgaataaaacgaacggtcaaacatttttaaaaaagtcaccgacgtcaaatattttgagatggagggagtatttcttcaatactgggcgatctatcctagattgccaaaactgttagtatcatcggatagacttgctttttccctgagattgttttcttatcttgagcaaacttactggagtcataccgccggagcttggaacatgagtaaatttaaaattatgctgttaccatttgtgagcaaaatgagccgcaacatgttctgttaatttattatacaaccattttgctgcgccgtacaccccaatataccttcgttatatgattcttacttctagtaacaacaatctccatcgaaacaaccattgcccatatttacactacacatcaccaaattcagcaggtgttatgagccccggcgtaagatcgaataggatatggtaatttagcgacgagcagaggatgagaaacagagaaaggagatctgaactgacttaattgatttctcccaaagttggcctctaaataggcttacaaatcttaactgaaatgtctaacaaattatgagtgaaaagaggaaataacaaatctaatccaaactgaatatatccccggactgtagctgtccggcaaaacgacttgcgccggcttccgcgctccgctgtccacgccggctttcgtagacgataccgaccatgacagctagggatggcaattgtgcccgtttgcccgtttacccgcgggtaaaaaccctattagggttgggtttgttctccattttatacccatgggtatcttattggttcaaaaactatgcccgatgggtaaatgggcatgggtatgggtaatcactacccatgcccgctttacccgtttacccgcgaaatctaacttacatgtaggctaggagtaaaatccactagaatacataagccacgttctttgttttctacggtttcccttttatttcccttattatttctctcctcttactctatcgccgccagaggagagacacgacaccgaggcggagaatatttgatgttttaagttcgattcgaagttagtagcttgtagactttttgttccactgcttttgttgtggcgggtaaacgggcacgcccgtgggcataaggcgcccgcgggcaatgggcatgggcaaccatccttacccgtcatgtagtaatgggtatacccacgggcacaaataatctcacgggcatgggtatgggtaggcactacccgtgcccgtcacgcccgattgccatccctaatgacagcatgcaaaaaatatcagacacccaaatgatgaagaactcccttcttccttcctttttggcaaagacaagaggcacaatttgctgttcttcacatagaagggtaatgtatcaaccctgattgattgcatacacacacggtgtgctgaaacttcttcaatgtgccatcacacctgatatatatattcagataaaatcatgatgatggtgactacggtggctttatttcatcattgccttgccgatggcctttacccatagcttcttcctccaagtgctctttcagaccttctttgtaggactcgacatagttcttcagtgcatctgtgtagtttgaggcgcgagccatgtacatccgttgtaacgcattcttggctttctctgctccgccctttaatgcgccgacaaggtcttcaaccgtagtaggctcgcttcttccctcctcggtgttgatgtcaggttactctttggccttcttgtagttgtagtcatttggtctgatatcagggccaatgtctctgacccaagaagccccatacagcctggttgcctccttcagaatgcaccacttgtctttccaggagagctttggccgcttcatgcccatcggtactgcagtgttctctcctttgtgtggtccgacaatagattaacctgcaccacaatgaaatgttgtcaagcattaaattttttttagctcccgggctgca

SEQ ID NO: 16367 - DNA, 9971 bp, Oryza sativa
ctgcaccccatacttatgtccttgaccaacatcgtatctcccataaatacgaatctctacattatcctcggtccattcaagaactttcacttaggaccttagttcatctagagtcgggcgggtggaaaacaaaatggtcttcaatgacatatcctcaaactcaacatgtgcaccaacataaggttccaccactctaccaccatagcaaacacgaacaagtctatccatctacacaaaaaaataaaacatgactttacaacaaaaattacatcatccttgctaaacgtagtccaaaccgataaattataacaaaatcataatttaaattgtcccaaagctactacttcacaaaaaatatttaatccacatccaaaggtaccaactagattactagtgtattaaacatctaagtattacaaatactccgtcatacaacatatcctaattctaattaactttaataaatttctataatgctaccaaattcgtctcctccctcatataattcatacctaaaaaaaatctttcatgtctcaagtcaatttttccatccatcaatccaaccaaacaacctaaaaatccaaattaccacatatatagttcaaaaaagagtggcaccaatgagtacattgcacacatgtagcactataatcagcaaatccccaaattgaatgctgaaaatcacaaatttgggcaaaagagggttgtagggttaccctccgatttacaaatttcaccatttaaaacggaaaaaaagaggggggaatggaggagtataccttgctcttcgatttccacaaaaaatcccgtgaaaaaagcctccaatttgagtggctttgaggaggagaggtgaggggggagagagatggagagcgcactgctctggcttgggctgggaagagttgcaaatggctggggggaggagaaaggggtggggcccgcgtgggttaagggcacggcccacccagtgggagcgcgccaggacgactggagcccccctcctgccacgtcagccggctcgcctacagggtgtcaccgcggcacgggcacgacgccagtgtacctggcacgccatgttggagggcagcgccagcctctctagcgcaccaaaaaggaccattcctgaaatatgtttttctagaggtctatttctacaataagttttccataaggagcaaaatataaaaaattcagtccatctcttatccatagctgatatttgcaatgaaatttcacatgtcacctaaattactctgtgttttagtggtgctttctgcatgccaagtaaaagtactcactattgtgctcatgagaaaaggattttatatatatatatatatatatatatatatatatatatatatatatatatatatataggacactcatatggggcaccatggtgcccgggcaccatggtttcaaatgcacaaaattactcaaatttttcaaaatttttaaattgtgagtatatacctagttataagaattcgattcatacatatatctatcaacaaaacaactcaaatttaactttatttcacaattcatgattacatacctaactaattatatgtatagatgctatatacctagaatcaaaatctaacaaaaacaagttcaaattcagtttaaacttgctttgaactagttagtaaagtagttaatgttaatacctaaataattgaaaaagtttcatactcatttgaattggttatatactcaatttcaacaatggtgcccgggccccatggagcaccaaacaaatttactatatatatatatgtatatatatatatatatatatatatatatatatatatatattgcacaggacaaatataacacgaggatataacatttcagcctttaagcatagtactcatgacaagctcgagggtactaaccgtggtacgatgtattgttcgagacctcctgctgggtagatgctcagcaacgtacaccttagatgatagacagctaggtcgattgcagtagaatcgatagtggaccactaaactgtaccaaaagccacatagttcatatttagaaatagattataatgctgacttaaaattaaatacttgctttaataatttcagagatttcccaagatatcgatctaggtacaaagtgctagaacatttcagtggttgcacagcaggagacaaaaaacccctcctcatgcacatttccagctcagcttaacattttaaccaaatccttatgtaggaataaaacaggtaaccattctcacatgactgactttcttgaaacaaatcaacatcctataaagaactatattcatccatgagcataccttatatgcaaacaaaattgatccatgaagacaaccaaattaccaacacattatatatatgccgggcagacatataacaaatactgtagatagggatgaaactatgataagttgtatatcatacactatatgtatataggaataaatatatctataagacagcagcagtagcagcacatgacctttgtatagtactagtataagtgtataactaactgacagtatatatgaggcaagacatgaatgtcaatatagaggcccctcttgcttgtttcccttcttctgtgatctcttctctatctctggtccccatgaatttgacattctactactagtacctactagtaagcttcactactctgtgcctgctctgatccatcttgttgctttgcattgccattgcccctgtttcttgctagctagccatggagacagagagctaatctatagtactacaccctaattaagtacatgttgaattttccgatgcacaatacagcaaatgcaatttggcaatacataggccaaccagtgcagtgtacttatatgtagacaaattgagtaaatcacagggcagacatacatgagccaaaaaaaaaaaaaacaagtcacagtcacagatcttgtataactgggagaattttacctgaacaaggggattttctcggtgcttcctggatctcgataccgagggcagtgctgaagaagaagaagaggcggtacaagaagaggtgcactaaactgcaccataaagccaaatagttcacattcagaaatatattataatgctgacttaaaattaaatacttgattaataatttcaaggatttcccaagatatgaatctatctacagagtgctagaacatttcagtggatgcacagcaggagaccaaaaaaaaaaaaaatcctcacgcgcatttctagctcaacataacatctaaccaaatccttatgtaggagtacaataagttaacatgcttacatgactgactttcttgaaaaaaaaatcaacttcctataaagaattatattcgtccatgagcatagcttatatacaagcgaaattgatccatgaagacaaccaaattaccaacgcattatatgcagggcagacatataacaaatcaatatatagcttgcatataaggtgcactgtacttatttgcagacacacaagatagaagtttcctcatgtgtataactttggctaacacaagtagttagcactaatgcttcagaataattgctgccatgatgcacatattcaaggagtgtagatgaaatctccaaattgtaaaggtctcataattgaggcaataaaatacagctgtccttacaagacagtaaacattgcgaaaactacatgaatatatatgtagacaggtgtaaaaaaaaatcaggttaaatttttgtagcattgtatctctgaatcatgttcacctactccttctatcctaaaaaaaaacaaaaaaaaccaacgaaatttctaggtttgaatattagaatagttggttctatcaggacagagggagtatgtagctacatattcagaacaaaaagcatcctatgtagtgtactgacatgccaactactgcagtggtacttataggcagacatatagtagcttataggcaggattgtaaaaaattaaaataaagtcacactcacagatctggcataaccaggatattttgacctgaacaagggggtgtccttggtggtcttgatgggtgctgaagaaagagaggatgagaagaggagggggaggcggcggaggaggcaggggtgaggagtcggcggcggcgtgcgggcggagttgacggcggcggccggcggaaggagttgatggcggtgcgggtggaatgggttttggcccatgaaattttcctgtgttgacgccgcggcccacgaaaactctcatgccaaaatttttgcgaattccagcaatttgatttattttctggcataaacaatctagagcagatcaaatgactagttaattattattactccctccgttccgtttcgtattataagtaatttaattttttcaaagcttttttagtttgatcaaatttacagaaaaaattagcaacatctacgataccaaattgatttttaaaatttaatattgaatatatttgataatatgtttgttttgtattgtgttagtatatttttctacaaatttagttcaatttaaagaattttgacaagaaaaaagctaaacgacttataatatgaaacgggggagtagtaatcattgcccgtagtgaatttccggcagatataatgacatttgtatccatccctggctcttgttatatttccagcaaataattcaacaacaaatcaatttttttttgttcgcgccaattaattgctaggtatactgagctatggtgtagtgatatcggttgcttacataagttctgtatgtaattattgctagagcatgatgaggtggcatgtttacatattgagctttagaattagtgggttataaatttatactaagataggataggattcttgatgctagaggggtagatatagctgttgtcagacattacacagagagttgtacatcaattaagtcaacctttcacaacaatgaagccatgcatgctattgtttgcggttttatcatagaggagccatgatttttgcaaatgctcatgataccctcttttagctagtagtagacctatttttagtttaatttgcgatactctagttactaattgaaataagaaattagtgcgacatgctggcggtatatggcattatttgtagagaaattttatagtttttaggaagtaccaaagaggtatatttagaaagctccgtacatgaggtatgggaacatactcaattttctggataatgcttctcgtcgaacgtccgaagcaaggagaaaaatcggacaacatcctctgacacacatacacatctccaaccatataacatgcacctttaacgatatttaaaacgaattttctcttaaattatttatctaatgtacaatccgatcataccgttgtattcattataattaaatctttacaacaagatgtcgcatgattatatttcgataaaatataatcatatgtttcaatccattaacactttttgtttcatacgtgatagggacatgtttcaatatgtgtctttagcgtgtttcacaaaattcacaaaataactgttagctagtttcaaaacgatttttctcttaaactaattattcaatctacgatccgatcacaccgttgtattctttgtaattaaattttataacaagatatcacatgattatattttgatgaaagaaaaacatatgtttcaatccattaacattggttgtttcatttgtgatagcgatatgtttcaacgtgtatcttcatcatgtttcataatttttttaaatgtttcagttactgatttttggtttcaccctatataacttgatgtttcactcgttagttaactggaacatttaactgaccgattcttttttgcatgctgcatacgtaggtggtgtaatgacgtgtaaacagttgggcgtccgatatttgatgaaatatcggacgtccgacgcagagtcgtctcccaattttccactgtaaaatatggtgctcccaaatacttgttgttgtcctaattaagatactcgattctacgattctctatagatggaacctacgattttcatgtatacgattttgtaataccgattccaattcaacatcgcgagttaacaaccttgtttttggcacaacagaaaaaaaaagaaataactatataactttcgacaaaaaaaatccctttgaaatctttcgaatgtaactgtagtgtaactatagtacagttacactgtaatactatagtataactcatatgtgacttgtatataactctgtcaagaaactagctagtatgacttggttggctagcaccgagagggccttcaggtgcaaggtcaagggttccagcgttgtatatcattgcgtcactcgcgtcagtcatgggtgcagtgcttgccggtgccggcttaggcttaattagtttggtaccctatgttcccaacacaactccctcgtgttctgtgcgcacgttttttcaaactcctaaacgatacgttttttgcaaaaagtttctagataaaagtttcttaaaaaaaatcatatttatctattttttaaaaaataaactaatattaattaatcacacgctaatacaatgctccgttttctatgcataggatatgtgttcccaacacaggctaccgaacacagccttagagtgagccggcgcatgagcagagcaggcaaccaggatagctgcccattgcaagtttgatttttgaacaccaaagaagctaaggaatacatggccggtcctaaacttgtgtggtggtgtcacttaggtctgtgaatttgaaaattgcacatttagatccgtgaacttggtttaatgtaccaccctggtccaaacgttctttgactgcgttcgactgctaacatggcatgccacatagacaatacttttgctttcaacaccctccatatcataacacatcgcatatatctccttgtagctatacagtgacactagaatccccaaaaaaaatcctcaagtcgttcttccctctcattcttctccttgcatgtatagaaaatacggcccctgttagcaattgccattgctctgcgctccaaaatgactttatccttgcacaacgggcacttgatcaacaacaccttttcccaacgacttcaaaacgaggacgagcttggagaatctatggggatgcctagcatgcaagacgcattacgctgcctcccgccgctaatccggtcgcactatgccaccgctaaccccgttgcattccgttgtatcctgctgctaatctcaccgccgaggacgccacagccgctacctcttagcctccttccgctaatctcaccgtcgaaaccctagccgattttagtgatattgaaatgcactggttagggcaagttatgtgcgaaggtatatatggagggggctgatcacaaaagtgttgcctagtggtatgccactttggcggtcaaacgtggtcaaagaatggttggaccgagctagggtggtacattaaaccaagttcacggatctaaagatgcaatttttaagttcatggacctaagtgacaccaccccacaagtttaagtaccggccatgtatttcactctttattttattttattttattttgtgttctctgtaagctttggcgtgtctgtgtttcgctagtcaaattgcatcaagagtaaccttaaaaccatagtaccacattactttttatcataggcacggctcttgtcaatgcctatttagtgatatagtcacatgatgtaccgaaaacttagtattgtgtttactatcgactctgttgattagccatacctcttttttttccgtcctccgccggccactggttcagcattgcattcagaatgatttcagagtacatctgaaggtgtgtgtgcagtgttctgagaaggaaactgtgcaatgctccgatgatgaaactgactttatgttgagatatggtggatttttttaatgtgggtagcgggattgcccatttacatcctaatgttgtccttgatgaggttatttcttctcggggttttctggacaagatacttttttcaattaatattgagcgattatttcttaatttgaatatataaacagattttgtcatgcactacctttgtgttaattagtggtgtaggagtatccggagggctttcagtatagaacagcagaatctattgtcagttatattgctacagcacatggacgtcttcagaacataagttgaagagttaatgcaaatgacactacagtagaatcgttagtctgcacacatgcatgcgggttaacatcaattcttgaaaagttgtaatgcctatttaacactcttaataatttgaaaaagaaaaggttatcaagaaaaaatatagatctcgtcgagttatacaattttgttatacagaaaatttaatttctccatccaagatattttggaaaattcaaaaattcgttttcaaaatatatttgaaaacttgtaatgcatattcagacatttaaatgatataataaaaaaatgaactataaagttagagatcaggttgagctcacaactttaatatcatatcactatccgagatcatttgaaaaattaaaaagtcgtttttcaaaatagatctaaaaacttgaacacatattcatacatgaaaacaattataaataaaaacattatcaactataaaaagttatagatcttgatgaactctacaattttaataaagtttatcttcatctaactgtcacaccccaatctgataccgccgtacgacggcacctgacaggagcgtgtcgtagggaaaacggcgcgaaccgcttcctacgaaaccgcgatctcggtaccagtcccaggacatagtgctcgtacccacggtgacaaatatgaatcatagcaatccttaaaataaatagaggacttatttaccttaacttaggttgcaactcaaacagcccgagaatacaaccgacgacacggacgaggcgaacaccaacaacaacagcagcagcggaaccaacggtctaacacccaataccacaggcgacggctgggaaccaggacgaaaccctaatcttcacttcacctcatcttcaacttcagggcggaggaacaatatatatttatatagagcaagggtgagtactttcgtactcagcaagtcacgggaatttaggtgtttaatgcaagcttggaagagaggcaaggttgttttgcaaatcctttgtttgaaatcatttttgaaatcactaagtgatttacttcttgttaggtttgggtcgaaaagagacttgcgtctcaaatcgacttaagaggtgcttttctacaactcaataggtaatgtaccgacctcccgggtcagatcattacttctcggcttcctagagccattccacttgattaatcggctcccagagcctttttcattttcagcagcacaacaatccgcttccactcgggaagcctagactatgatgcccatagacatcccgaatcacacagattcgtttcttgaccactcaggtcatccatctgccacataggctgattctggttacgattcccacaccacaacaacttttcacaaagcacaggcaaacaaatctacgcaacgggaaccacctcacatccgcccatgaccgtgggcacggcttttcgaacagttagttaacctctgcagaggggtacactttacccacaagacacgaacttactccagacactggccggtgtcagaggttcgcgacaaagcctttcccaagccgacctagggatacctcatgccacatagaaggatcaaatcctcacataaatataggccattttaggcgttcacaaatcaaactccaaccacctcgatcggtaattcagcaagcttctcgttcttgcattaccaggaacccggtttgtccgaccctgcccgggcgttcccaactattggcatgcaaggtttccttgaatggattagttactaagccagggtgtcccattccaccttgtggttgcactttgatatgttc

SEQ ID NO: 16368 - DNA, 6870 bp, Oryza sativa
aattaggtggagggctcaccgatggcgacggacggcgtcggggcaagaggaggaggagtggatcctttccaccggcgcggattagggcgccggggtcggaggagggccggcgggaacggcgtccggcggtggctgtgagagcggcacggcgcaggcgcggagggcgaagctagcggctgcggcggcgctgggaatcaaggaggggagggaggccgatggccggggaggcacggtggaagtggccggtcgcggcgcacggccgagcgcggcaaaacggaggaatggaacgcggcgggctatgtcgagcagcggcgggcgcgatgcggcgagagggggggagaagaagggtggcgtcttcagtactatttcgggtaaggacggggaagaagcagacggcaagctcaccgacgagagaggagcagcgttggcgacgcggagggagccgtggagaggtggtcgcgacggcggggcgggggcgagcagctggcggccggcatcaatgtcgcgggtgtttcgagcgaggcgaagacgaaacaagaggggagggcacgggctttataggcgaggaggagaggtcggtttggaggagggaaaccgacattggttgtcaagggagctcggctggtgttcacgggcggcagcggtggtttcctgggcagtgcaaaagcggcgacggcggtggatcggacggcgaagattgaaacgcgagcgcgggctggcagcgtggagcggtcaaggtgggggcggcgagctggcgtggtcaaggtggtggcaggcggtgacgccgatggtggtcgggcaaaaggaaaaaggtggagaagaaagggagctctgctccttgctatttcgggataaaggaaagggagagggagcgaggccgagggctctgcctccctcccttggacgcatgcgcacaggcggggctgggcgacgcgcggtcacgggtggcgtcagggctgacgcggcggcgaccgagcggttggcctcgagcgagcgcgcgcgcgcgggaacgagcggcacggccgaaaatcaaatggcgacagcgggaaaaatcggcgatggcggcagcgctggcgtgggagagagagagatcgaacgagagagagagagaaacatagagagagaggaagaagacgagagagcgagagaaacagagagagcgagcgacggctctctcttggctcgcatgcgtgcaacgcacgtgtgggggggggaagatgatgggctgggaggggagatgggccgggggaggaaaatcggtccatccaaaaatacagggaggtaaagtagacttttacagagaaaaccgatttggatagaattgtagagatttagggtttggattcgaattcaaatttgatattcgaactcgagggtttagggatgtatcaagggaaactcaaggagaagccatggaaaagattcaaaaggaatacttgggtatttgttctcgggaacatagggtggagtcaaggaaatgatttggatgagaatcgattctctcgaaatcgggagaaagatttggcaacgagttcaaggaagggagagattgacttccggaattgggatttggatgagagggaggagtcgccaacgggattaaaaaaaggggatttgaatctaaattttgatacttgtacacaagggttcaaggagacgagtaaggaaacaaagtgggagtttgatactttcgggatgagagggaacaacaggattaaattgggatccttggcacaacttagactctcacacaaagaacgaaaattttcgcaattaggattttgccgagttagtttttaacgactcgcgaaaagcggagcgttacagatcgaccccgagattcgaaggtggaccacgcacacgaaaccaaaaagggatcttcagactccttcacagcttcagactctgctagtctttcttcaacttattgttgcatacttgccacaaaacggtctggtaacttgattcacttagcatttttcatcttactgtggctctgctcttgcctgtgaaacctgttcttctcctgctccttcaacttgctcgagattcacaacttttccatttgtttctacttgcacatggttcagacgaccttgtccaacgggcggtgaggttagcaggacagatccactgtttggtgacttcgaaccttttgatccaggtatgttgggaaggattgtcgttggttgaactggctttgtcttgactttgtgaaggcactttatcttggctttctgagggcaatcccacgaatagtgtcccatctcatggcagatgaaacattcgactcctgccttatgaccacgtctttttgaaggtgtagggcatggtacggagttgcttccttcatggctattactattgatcattgtggcttgctgaccaggttctgacatagtcgaacgagacgtagaaccggaaccatttgaatgctgagatgctttctgatagtattgtgctggcgagtttgtttttcgacacaaaccttcttttgcttgaatctctagggacattactttgcgtctcttgtattcttgcatctcttgttctgcatcttctagtaacaaggacttatcgaccatttgctgaaacgtcggaaagtcgtgagccaaaagtttcactcgcagtttcgcatccattccttttaaaaatcttctgatcttctttttatcagtgtctacatcttctggggcatatcgggccaatctattgaagcgactcaaatactcgttgatgcaagaggatccttgcttgatatttgcaaattcttccttcttcaaatcaattatgctttcagggatgtgtgctgagcgaaaggctcctgcaaactctgtccagacgatggtactagcatctgtatgggtagcacagtagttatcccaccaatctgcggcaggtcctctcaactgatgtgcggcgtaaagggtcttctcatacggagtacactataccagatttaatctcctttccacatctttgatccaatcgtcagcttcaataggctcagttgtttgagagaactccggtgggcgagatctcaagaaatcattcaattttgagcggccattatcttgaaccatatggggttgacactcttgagtgtgttgttgttgcatagcaattatattctgaatcactccttgtaatatatgggtctgcatggccatgagttggtgaaggtccactggtgggggtcggttacctcttgagacatcattaactgatccggaagcagccatatgatcactctcagcttcttgctcatctgtctggttaactggttgatcgggaatttctgactgaactagctcttcttcaacaccaaagcgattgggagcaagggtctgacgggtagaacgacgagccatctgcttcaaagcggctgagatctgactgaaccagaaatgggacaagaaaaggagaaaaacaaaaacactacatcaaaatggttttcgaaatcacagaagacataggtggtgtgttccagccggtaacccaactggtctaacacctaaacacggactaccaaacaaaactcacacacgcactagttcaccacaactcctaccgtgcgggtgacggtactaaggttagcctaccaacaagggcttaactaagactcctagaggcttgagcacacctttcttcaactgggcgtgaagacaggtttactctaggataaaagtcaaaacactcgactaacttctacctttttggacacaaagggatttttcgcaaaactagagcaaaaggggacaacgacaccttagctttcacaaatagttttttttttctttgtactcaaataatgccttcctattaaggggtttcgatcctagggccaacctatgctctgatacaatctcggtcacaccccaatctgataccgccgtacgacggcacctgacaggagcgtgtcatagggaaaatggcgcgaaccgcttcctacgaaaccgcgatctcggtaccagtcccaggacatagtgctggtacccacggtgacaaatatgaatcatagcaatccttaaaataaatagaggacttatttaccttaacttaggttgcaactcagacagcccgagaatacaaccgacgacacggacgaggcgaacaccaacaacaacagcagcagcggaaccaacggtctaacacccaacaccacaggcgacgactgggaaccaggacgaaaccctaatcttcacttcacctcatcttcaacttcagggcggaggaactatatatatttatatagagcaagggtgagtactttcgtactcagcaagtcacgggaatttaggtgtttaatgcaagcttggaagagaggcaaggttgttttgcaaatcctttgtttgaaatcatttttgaaatcactaagtgatttacttcttgttaggtttgggtcgaaaagagacttgcgtctcaaatcgacttaagaggtgcttttctacaactcaataggtaatgtaccgacctcccgggtcagatcattacttctcggcttcccagagccattccacttgattaatcggctcccagagcctttttcattttctcggactcccagagtccagctgcccagcagcacaacaatccgcttccactcgggaagcctagactatgatgcccatagacatcccgaatcacacagattcgtttcttgaccactcaggtcatccatctgcacataggctgattctggttacgattcccacaccacaacaacttttcacaaagcacaggcaaacaaatctacgcaacgggaaccacctcacatccgcccatgaccgtgggcacggctgttcgaacaattagttaacctctgcagaggggtacactttacccacaagacacgaacttactccaaacactggccggtgtcagaggttcgcgacaaagcctttcccaagccgacccagggatacctcatgccacatagaaggatcaaatcctcacataaatataggccattttaggcgttcacaaatcaaactccaaccacctcgatcggtaattcagcaagcttctcgttcttgcattaccaggaacccggtttgtccgaccccgccccggcgttcccaactattggcatgcgaggtttccctgaatcgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgattaccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaagggtgacttgccttgctcaaggtcttcacgaagcttcacgaatcttcgagaaaacccgcgatcgacgaaaattcgataaccgcaactatacgcaaacaatcgaaaacctaaacaaaggaccaaaagaaagatcctatttagactaattagtagtgccattaaatagatctcaattttacggaattactggaagtggaacggaggcgatcggagctacggatcgagggatatgaattttggaggtctaaatggattttctggacaaggaaatgttttgtcagaatttatggaaataatattctcaagaatattattgacagtcactgaccaaggaaaatgattcatggaattttggaataaggaattgatttctgaaagagggaaaaatgatttattgaatttatagaaaagagaaatatttgtggaatattggaaaagacattctcaagaatatctttgactcattgacaagtggggtcaacaagaaggtaatagagaataaaattgagagggagcaaatttggacttttagtttatgagtgatggatactgggcttgggcgaagggagtatatgtggacttttgtttgctttaaggggccgaggggaaggtgcgctgatgggccaagcccacaagcacgggagagagggggaggagtggggcgactgactgggcgccggcttgacccggtcaagtggggccgatggctgaggtggcgcgaacgtggacgtcacgtcggatggggaagggagaggaggccgggcagctcatcggacggcccacggcgcgcggcgggatccggcgaacggcggcgagccggaaggggcggctagcactggcggcaggagaaggagaaggggaactcattccacggctcggatcaggaagaggacgcgcgacgacggccggcggcggtggccaatctcgccggcacgccgacgtggccgcgcgcgagaagagcgaagggtgcgcgggctcgggcttagccgaaccggtatggtgttgcgacgcgcacgcggtgacgcgggacccgatggtcaccggcggcgcactcacggcgacgttatgcggcggcggaagcggcgacacggcgtggagacaaaggagaaggccgatggccttggggcagcaagggggaggtcaaggggatccccgggagcgtggcggcgagaggaatcgacgctagaggagccgacgacggtggattgcggcggcggcaatcaccggagagcaaaaggggaaaacacgacgagacgacgagggttcgattcaaagggatgggagcatctccgggg

SEQ ID NO: 16369 - DNA, 5628 bp, Oryza sativa
ggggggggaaaataatgggttggaaggacattggccgggggaggaaaatcggtccatccaaaatacaggaaggtaaagtagactttaacagagaaacccgatttggatagaattgtagaaatttagggtttggatttgaattcaaatttgatattcgaactcgagggtttagggatgtatcaagggaaactcaaggagaagtcatggaaaagattcaaaaggaatacttgggtatttgttctcgggaacatagggtggagtcaaggaaatgatttggatgagaatcgattctctcgaaatcgggagaaagatttggcaacgagttcaaggaagggagtgattgacttcaggaattgggatttggatgagagggaggagtcgccaacgggattaaaaaaaggggatttgaatctaaattttgatacttgtacacaagggttcaaggagacgagtaaggaaacaaagtgggagtttgatactttcgggaatgggaacaattatttggggaggattcaagggaagggattgactttcggaatttgattccagagactcgaatcggaagaggaatttttgaggtggaggattttgatttcgatgagagggaacaacgggattaaattgggatccttggcacaacttagactctcacacaaagaacgaaaattttcgcaattaggattttgccgagttagtttttaacgactcgcgaaaagcggagcgttacactaactctataaaaaatcaatttaaaaaaccaaaatgtatgccttgcaatgcgctgatttaggccatatttgttaatgctattactaatatgtaggtatgtcatttcacctaaaaatatatgcaggtatgtcacgcatttgtgatagacattagggacacttttatggaaacccatgtgtggtaatggatttcattcatatccctgtagctctgatgccaccgccaccgccacgccgcccaacactagctttcatgtaaacccacactatctacccccctcctcactagcagcggagctagctcctgggcaggttgggcggccgcccaggctccgccaccagcatctccaatgtaaatagcttttgatgcctgaaagaattagtcgattactgaaaaaggctagtactcgtcgggcttcatgacatctctggctctgccactgcctctcaccagcacctaatcttgaaaatctctggtggttcttgcaagagtttcaaagacgccagctttgagaggaactcgttgctgccgagtgcgcttcgtggaagttgcctctaacgtctcatgctgccatgtccctgtctttctcatgcctccccataggctggaggtagagggcttgtgctggccctcagatctgtgaccgatggcttggatcaatcaactgaatgatagcaaatatgaattaaataatagcctcaagaagtcaacaactaacttaatttgatccaagttagcatacaatagaaactttaactctcacctgcaaagtatgatttgttagtttcaagagattcagtactcctaaaaagaatgaattaatttttaagatggattcaaagggaaacaatattgagcacaatatttaaggtgtagtatgatcactaatacaggggatgactcactaaggaaaactccataggttgagttaggaaccaaggcacacaattagcaagacatgcaattttagctagtaattctcacaatttaaactatcactaattaatacatcctagctaggatacgccactaattaattttgcgagacttagttgccatctcgattacatccagtaggatagaagggcaagatgttttgaggcgaccatacccttcagtctccacaacatcatccaatctatttgatgaggcgataaatttaacacacgcttcttttaatcttccgcaattgtgctgatcagctagggcaacaattgttgccacattatcaacactaagactcatgcagagtgccttttcacaaatggttttcaatccttccacagcataacgatctgcagctacaagcagatgcttagccaactcctgcctttcatctctactgagatcatcattaatagcaggagagaaggagtccgtgtacataaaatgaagtagagccttgaacacaacaggttgcatatcctggatggctatccgctctcctctcttggccctcatcggcccgtaaagctccgccatgaacaccggtgatcgcgccgctagcaccacgctatgagcggggaaaacatctcctccaacctcgaagctcaagtcggctccgacattgtcctccagcaacttgcccaggtccctggacaagtttgtcggaggcacttggaagtggatgatatcacctggcatggcggctctctcctccgtcttcaccagtggtgtcttgatgacggtgagattgcactcaatcataagtcggtcgtcgcgcagataaaccgatccctccagctcactcctcctgatgaaattcttactaccccacacgagacatttgcttttgaaattagtcgtgccgaacactctccgtgtgttgttcgtagtcgagaccagaacgcaagacgagtcgtcggtatattgatccaacatcctgatgtcaaagatggttctcacctcggcgtccttggtcataagctcgaggaagacggagatgtagtcgtcgtcggactcgatgttgccgttgtggtagtagcggagacaccagtcgaatccaccgacgtcgaaagccgcggagcggatgaagctggctttgttgctgccggcaccatcgactgcttgcaggctgtatccgtgtatggtgaaaacgtgagttccccgtgctgtctctggcttgcaactcgatgccgtcctcgtcgtgctcgacggtctcagccgtgacgccgacgccaccatggttggagttggagaagaaagaggatcaccggacgaggcgacgtacacggcgacggcaatgagctataggctcgtttgtagttatcggatgcagctgcagggaagaaaaagttgcgttttgtacagctcgatctaatttaagcaactctctgctgtcagggagcatcgatcgggacgtaaactaggttaattttatgtcttggggctcccatcctcctattatactactactagtagtaaattaaattaccatgtagattaaagttcctctctccttattcggtccaagcttgccatacgctgcatatctctcgaatctctcgactcctcttcttcaccgatcggattctaagacgtcacaggaagtaattaagcgtcagcaatatggcatccatacattcatccatcctgcaattacacgacgagtaataatcctggttgatagacagaggtctctaattcgatggtcataatctatcactcgatcgtcagctaactgagctgtctgatctccatggttttgcagtgtccggagtgatttcagtacaaacatcaacagggtatgttctttgtcgggcattgggcatgaggttgatcagtggttgaaccccaattattttttctgaattttttctaggaacaaactgttgttctcaccggcgaggatgcggcggaagcagcagcatgcatggtctccggactccggtcggcgcgcgccggcgagatatggagatcggcgaaggtggcagacgaactcgatcgcgatcaaggacgtaacggggagatcgacgaaggaatacgggctagttacgcttaggatatttggcggtttcggtttgggctttctattgccgccgtccaaattaatcaaatacgttgggctagctgaaacaaattaaacccaaggattgctcatatctgttaaaccgattatgaccggcttaagtagccaagtcgaatcgcttctcaatggaaaaaggtccaatttgattacaagttggatttgattcgtatcactaattaaccgtaaaatcgggtatactactggcccctccagtgcaaaatgacccctcgtcttctttaagagcgtggttttccctggtgtggcatccacgtggcacgttaactgcctttttctaacgtggtgtctacatggtattacaatccgttaaaatataataaaatagtgggacccacatgtaagtccccaatcccttctctccatcatctccaggggacttaaaagaagttgagggaagtcgaatatcttgtgaggaggccttcaaaggaggagaaggcaagaaatgagaggaggtcattcacactatgcgtccgaccataattacctgccacaagcgcaagatagaaaattccttgcaatacctgtatgctacttccatttattacatgatttattagtatcattaaaattacataaaaatttaatgccaactccttttttgctataggttaataaatatgagataccccacagacatgtgtttacacccaaatttggcacctaggattaaaataggaaagattgccaaaatttggaagtctgccggtttcctccgagtgggccggtctgaccgtcgtgtgttgagcggtcaaaccgccggttgagggccggtcataccggcggtgtgtggccggtctgaccggcaggtccgagtccgactgtgtttcgtcgggtctcgaggtttccttgctcgagaaggcatgtttcaggtttcctttggtttctaccccgagctggacgtggaggagggcctgtagagggcaagaccaacccctatataagggacatggccggttcattgtaaaaaaccaatctacaatcaatcaatcgaatcgtttttcatattgcttttagttttctcttagtttgtccatctttgtcggtttgcgccgtaaaccatccgccgccgctgcgagagtgcgacatcactttataggtttgtcctgaaaaccttccgttttgcccacgagacgggtagttatctagaaatcggctccgctagccggttatttatcaaaacccatctaggtttagctctttgctagatcgaggtggttgacgactctagaatcaccgcaaggcttaaggtgctatgatcgtgcttgtcaatttgtcacaaaaagttgccaacacgatttttggcgactctgctggggaggagatccgttcatcgtcaactcaactttgacttcgccatgacgaagccgctatctaagacggaggtggagccatctaatgtgataccggtcgcattggaagacttcgaaggagaagatcgtaaagctatggaggagtacatcaacgagctcacacgggaggcgttgatgagagcaagtactaggactcgtcaaggcgtgaccatcaagcccggaccacgtcccaagctcgctcccgacgtggtaagcaatgatgaagtatcacaatctatccaacaacaaattacatctacaatagattcatttatagttgtttttaaagatcagttagatgtaatttttaagggtaaatttgatgagtttttaaggaataaattcggttctcttatggacgattagacattaaaagataaagcctctaccactgctaaccaacctcctatagatcaaacgggtggtaaaaccgacgggacggcgttcacgaccggtccgaccgggcctgacggccggtcagaccgcgacacagccgtcggtccg

SEQ ID NO: 16370 - DNA, 3061 bp, Oryza sativa
gatataattagtgaaattatgaggaatagattcgggattgaaactaggaatcgtgctagaacttacaaaaagccatatcctgattattatgataatgtgccgtttcctcgaaattatagagttcccgaatttgccaagtttagtagtgaggatggtaagaccacatgggagcatgtaggtcaatttttggcgcaatgtggtgaggctaatagtgatacttttaaattgcgcttgttttctttatctttatccggtaatgcttttacatggtttatttctttaccggcaaattctattcatacttgggctcaattagaagaaaaatttcatgattatctctatactggagaaactgagcttaggttatgtgatttgacatcggttaagcaaaagtataatgaatctgtcatagattatattaaaagatttagagatgttagaaaccgatgttatactttgaatataaatgatagagatttggctggtcttgcttttaatggtttagttgctcctcttagagaaagactagatggccaacaatttcttgatgttagtcaactcatgcaaaaggctctggctcaagaaagccgggttaaggataatagaaaacttgctagaccatttgacaaaaagcctaatgttaatgtggtcgattaccctgaggctagtgatagtgaggaagagggtgatcatgatatttatgttgccgaatggtcatggactaacaaaaataagccttttgtttgctctaacctaatgccgactcctcgcaaagatcggcaaagtaaggttaagtatagttttgacgtggccaagtgtgagaagatttttgattatcttttgcaagagaaacaaattagattacctaaaggccatgtcataccttctcaagaagagttgaaatgtcgagcatattgtaagtggcatgattctcattctcactctactaatgattgcaatgtgtttcgacgacaggttcaatcggccatagatgaaggacgattgaagttcaccgatggctccaagatgaagcttgatcatgatcctttttcggtgaatacaattaatttcaatgataagaaggtgttgattcagccggagcaagccaaatctgctaagggaaaggaagtgatcattggtgaaccaaggtccaagatgatagtgccaaagaagccggaggttggcgtttggaaggagaataggagtggagcttcaacttctaaggcccctaggaagaccaaggtgacttttgatatgcttttggagaaatatgagaagcaaggtggtgagaaaattcgcaacaaagggaagagaccaagatcacctcctagggagcgatttggtcattcaccaagatggtcgcattcaccttcgtatcattatccacaagacatgtcatggggttcttatccaatgccgccgccgggttatccttatccttgctttatgccatggggggcaacaccgccaatattcaatcatatgcctccaatgtgattcaaccaacggtggggaggaccacggaggccaattcatgagcgtttgtcttcaccaagcaatagctgatttatggtaagaatcgggctaatgaagaaaagagggaaggaaagcgcgtcaaggtggaggagaggacttcggaagtgattactattaaagtggggtctcatgatgtgccaatacctactggagatggaattggaatgtccccgaacagaaaatccgaagccggtaccagttcctcgcagtcggccggtctgactaggccttctggccggtctgaccgcggtcgtgcggccggtctgaccgggccattaggccggtctgaccgccgactcgatagcggtccgaccggcacctcaggctggtctaaccgtgcgcccagtgtcggtctgaccggcgcatctggccggtctgaccggtggtctacgaccggtctgaccgggctccagcgccggtttgacaggaggattgcaaagggcgatgtggagacttcatcatcttcaaacaaagttaatagagggcattatttacctcctggaatagagctgaatcctaggtggatgcctagggatttgacggctactcaaaagagaaggttgcaacgtctttggacccaagagttaagagagaaagaggccgaagagcaaagagataaaaggttcaatgagttgcgacccccactggtttgaaggcctaaatccatagagaaggcaaaactgattgatgtagaggaaaaggaagaacaatcggttgataaaagtgaaccatctccaaaagaagacatagatatcaacatggtatgtatgttgcctatggagttttgtgctatggatgaagccgaggttgctcaattctcattaggtcctaaagacgcggtttttgagaagcccgatgagtcaaaccgtcacatgaagcctctctatctcaaaggccatgttgatgggaagccggtctctaggatgctagtagatggaggtgccgccgtgaacttgatgccgtattcgttattcaagaagttgaggtgtgaggatgatgagttgaagaagaccaacatgattctcaatggctttaatggtgaaccaacggaggtgaagggtatcttttcggcggaactcaccgtgggaaacaagacgctaccaaccgctttcttcatcgtcgatgtgcaaggtaactacaatgttattttgggtcgttgttggattcatgccaattgttgtgtgccttctaccttgcatcaatgtttaattcaatgggacggcgatgatgttgaaattgttcaagcggatacatcggccgaggttgcaatggccgatgctacttttgagtggcatcatgggaatatccaatgcttatcggggagggatctttctagttatgattttattagtatctctgatggcaaatttgtacctatctctgtaaagtcggctagtgtagcacgggtaagccatataaatttgtataatgagtaaagaggctaatttagagtggttaaaaaaagtgtgcaagaatatcggtttacaaagaacgatattggtgaaaccgttgaagattttgatga

SEQ ID NO: 16371 - DNA, 549 bp, Oryza sativa
cggaggcaggccggcggtaaattcttaaacgcccaacagcggcggcttattaggccagccgtgtaggcggaggcaccagtcggcggcgacggaggcaggccggcggtgaagtcgtaaacgcccaacagcggcggcataataggccagccgtgtaggcggaggcaccagtcggcggcgacggaggcaggccggcggtgaagacgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccagtcggcggcgacggaggcaggccggcggtgaagacgtagacacccaacagcggcggcataataggccagccgtgtaggcggaggcaccagtcggcggcgacggaggcaggccggcggtgaagtcgtagacgcccaacagcggcggcataataggccagccgtgtaggcggaggcaccagtcggcggccaccgaagcaagccggc

SEQ ID NO: 16372 - DNA, 14085 bp, Oryza sativa
cctgacgaaagcgctcacgtgagtgtgccccccctcttcccgctcgccaattctcccaattctggtggggatttccggtgccgcctcgccggcgccatggcccatgtgctatggagattattgattcatctgcttgattgttgggtgggtgcagggcgctgttcgggtatgctatgccggcgttggagtgcttcaaggcgatcgagcagcggcctggtcggacggaccatctccggttttggtgccaatattggtactgactactgactcagaaaccccttagcttggagtaattagttcatttggtgtgttcaatttgatctctgggtgataggctgatgcttagaattcgtcgtaattgagtgaattgggtaaaccatacggggattaatttctgctatctgggtacagttagctggattagagcattagaattggtgctaatatgttactgcattgctgtggaattcagtaccaaatcctcactttcacctttctgaagtgctttgaatattggggatctgaaacaccgtatctactgtttggagatctgaaacaccttgcaagagttgaccaatttcagcaaatcttgcaggatcatactagtaatcctcgtcatattcgatgatatcgctggtgtcctcacctccaagtaagtaataatcacacaaccacaactcatcagctgttcctgtaatctgctccctgtaacctggcaatccccttcattgaatgacaggataccaatgtactctgaactcagactcgccttcctcgtctacctgtggtacccccagacaagggtatgtaatgctatgtctgcaacgcttggtccagcaacaaagctgcagctaactgcatgtcctgatcattgtctgaactaaacaagatttgccacaaaactgcagctgcacataactgcatctcctaatcatatctgaaattctgaactaaaaacgagatttaatctaatttgcaacactgagtccagcaacaaatctgcagctgcacaaaaagtgcatctcctgaccacgtctgaattaaataagattttgctttgtcactctgaaccagggaactgacatcgtgtacgacaccttcctgcggccgctggtgatgcagtaccagcccaacatcgaggagcggctgcgctacctgcgtgccaatgccggcgacattctcatcttctacctcaagaacttcaccgataggggctacgatctcttcctccgggggatggagtacatccggtcccagacgtcacgaggctcaagaacgagggtatgttaccagttactctctgtcccatatcgtaaggtgttttagttttgttctaagttaaaattctctaactttgatcaaatctataagaaaatatattaacatctactctaccaaagaacactatcaagacatatttcatagtgtattttaatgaaactaatatgatattgtagatgttagcactttttcttttacaatcttggtaaagttagaaaagtttacctagcacaaaagtaaaacaccttacaatatgaaaacagaggaagtagtagtacacatgttgggaaccatggtcatcacaggattccggaaatgtaacagtgcagtcaaagaattcaggatatgtaacagtgcaggtgtgtaactatgttggcaatggtttgtttctgctgtgcagcggtggttctcgttcggaggcgaccgggcagagaggtcgagctacgttgatgattatgtcgccggcggtggcgatcggaggagcacggcgaggcaccggcgaccccgcgacgattactaacgggctggaccggcgccatagggattcagtagagagaggtgcacaggattggaaactagttgattaggagtgacaaaatttaaaaggcccaaagcaaaacttctcaaaaacatgatgtgtatatatatatagacaggtgatcactgatccatactctggtatatatagctcctcacaatttggcgttgcaggttggctagtttgttggttttcctgttgtgatttgtgcacccgtcttcgatagactacatgattcattttttgaaacctaaggcgaaactttgttccacttttatatttagaagaagagaattaacccagtttataaggaaaaccgggcccaaaaaccacacaattgcacggttaattataggaaaaccggctgaaacccaccgctacacaactgacaacgacggcggagcccaaaagcaggatgtcaccgccaagctaaacacaaaagcgatataacagctcccacatcgcagaagaggtgttatcgttgccgagctagccgcccaagcgacccaacagcgccgacttcacaactgcagcgacactgaagacacgaaagtcgccaaagcgaaaagcagctccgacatccaacaatagacatcagccaagccatcgagaagccacttccttcacgcggccagcaccccaccagaaggaacgaagtggacccaagaagacaaaggcctcaccgagcacaaggtatgaaagcttttgaaccgaaaaagaccatcaacggtcgtcgatgcattggaacttctccgaagcgacgcccccaaggaggacacgacgtgtaacgccgccgtcgctcgtctgaaagccggaacaaggttttcatctggagattgtgggggatatgaaagaatgccatgacaatgcctccaagaagggaaatgacgcccacgagcgccgccgtcgtcgaaccggccaaaggcacggcaaggctttcgccagcatcttcacatcacccacacaagcacccccacattgacggccacagaatagtccatgacgtctcacaagcacccatacctcaaccgtaaccaacggcaaagacggacccttggccaccaactcctacagcaagccgaagcctccgccctccccctagcgttccccacgaccagaacaaggtccggccaaagaagggagggaaacccaaatgagggagaagactcggtcggcaacgaggaagtcgccaccgcggacgtcaagcccaattcctgcttcacgccagcataagccatcgtcccgccaactccacatccgcacatcgccgcccatccgacgcggaggggacggatccagccgcggacggccagatccagctaggacagcgcaagccggctcgacgtaagcgccgccgcagcaccgttgtcgttgcgaccaccacgccgccacagcctctgcctgcgcagcgctagcgccgtggccccgcgcggacgacgccgaggccaacgccgcgacaggcgcgagcgagccgccgctgcccgcccaccgcgacgccgcccctgcctgtcgccatctcgagccccgtcgccgacttctccctgccgccagccgccacctcaccagtgttgtcctccgctgctcctcgttgcgctgcaccgctctccgccgtcgccggctgcccctcgcgcgcgagccagcctccgccgtcgccggccacacctccgggaacgcggcctcccccgctgccagccgtgcctccgcgagcgctggcctccaccgccgcggccgcgcctttgcgagcgccggcgtccacagccgccggccgcccctccgcgctccttgcgcgcgccgcatccgctcctctcccctccgactgccgtctccggccggatccggcgggggcagcgccggatccgccgcctccacgccgggatgagtcgccgccgccgcgtcctagccgaagacgacgcgccgccccatcgccaccgtcgccaccacctccctcccgcggccatcctccaccgccgcttatgcatcgccgcgtcccctcgccggatccgcttccaggggcgtcggatccgccgcgcccttgccgtcgccggccgccggagccccccaccgtcgcgcgccgctccgtcctcccgcgctgaggaagagctttgccagttctcttggccccgccgccgccttcccgactggccgcacggctttccggcggcgagctccggtggcggcgaggtggttagggtgggcgggggtggcggcgcgggcggctagggttttgcccccgagccgcacgcgcgagagcgacgcggaggaccccactaacaaactagactacatgattcatgcgatgcaacccccactaacaaaccttttgatcattgtgatgaatacataatggaaacaaaccaaagaatattatactgttgatgatggataaaaaaatcaataccatacttgacgatggataaaaaaaggggatttttttttcatgagactccacacaagtggcaagccatccaataagactctccacgagtgacaggtcatacaactagttggagcaaccagctgctatttatagatttcgcatgcaaatctattcatcaagaatacgcatgcaaatctatttgaaagaattatgggaataatagatttcgcatgcaaatctattcaagaattatgagaatcagtaactaactagtgctatttatagatttcgcatgcgaatctatgcaagaactcataggaatatttgactaactaattaataagttaacgctggatattcctcctcgacctgatcaacctgtttcacgccgatgatgccggccacgaaccctaggcaagggcagacgtacctcttgacgaagcggtataccgcgccgccgcgccgggtcccgagcggccccggcgatcgccggcggtggagcgcggggtggggcctcgcgtacagccgcgacgtcgcgcgcaggagcgggtcgctgatgccggccttcggcggccggcgggagctctcctcgaactcctgcgagccgatcacgtcctcgaagctcacgtagccgggcgtcgtgtggcaccgcttgaagtaggcgtcgtgcgcggcggcggcggcggcgtgcaccaggtcgtcgtaggagtgcagccgccgcgagatgggcggcaaccgcgcctccgcccccgccggcgcggccccggaggaggagaagttgtcgctgccattgctgtcgctggtggcggcggcgctggtggagtggtgggagaggaggggctgcgagtaggatgcgcgcatggagaaaactggggcgacgtacgagacttacgagtagccgatcgagggagagattataagaaagaaagtggttaaaagatggagggcggtattagggtttgattatgagagagcatcacacccaactcgtattcggtgaagggggcgtagaaacgtattcggtaaaggggccgtagaaatagtgtatacagttatacgcacccggtttgccgcgcgccgtccagagaagattgaaactcaaaatcgattgaactcactcaactcaacccaaaagatgattgtaaatagatgtcaaatcgaaatagctaggtttcaccaatcatccgcggacggtttgaggaagcatcgatctccatcgaggactcgtgcggagctcgccgccgtcgagccgtccaggtgctcagtttgctgctgccgcggttgacgaggtcgcgctaggattgggagtttgagaggctggctggagagcccggatggccggatctaactaatgaattgttatgggctttggggctgagagatacatgggctgcaggccgaaccaacctgtgggctgagcagctagcggaggcgcttccgcttcggttcgtttgcggcctggaaaccgcgccgaacaggctactgggcgaagtggccaacacctaaaactggatttaaaagaaaaataaagccaagcataacaatactagtatttagattcggtgtaatggatcaatttacggtgaattttggatttttactctgttcggtagaaactggtagtaatataccttaggatttaatttgtcaaatacttttacttatgttatggtgggtttacactcgtcccttgctaatatcttccatagttggcttggtggtttacaacgtagaataaatgttaactttttataggtgccgtagctttgtgttggacggtaagactttgtagtaatgatataatcttcaatggcttaagtactaactcccctctttgtaggtaattttcaggtgaacccactgcgctagtggtcattgttgcttaacgaggagaatagcgatgtggttaaacacatgcacaagttaccggaggctagagtttgggatttcttttccagatttgcgtggaacttgagtaagcggttggagacctagtatccacttttgtcatcttttgttagttggcttctattcacgagacgacttcgttgtgaggtgttgtagtctaagtacccttgttttatttggtcggtggtgttgttcttatgcaaggtgtgatgctaagtactattgacaatgtatgtttggctatgtacgtatagtttggatgtagaggataggtttttaatcatttttttaaaaataaattgacattttctccctctacatgtttatctatgttttgttagtattgttgtattgctctcactaagcctagatgctcgctagatataatgtatttttgcttacttgtactcccctccgtacgttcaaattttttttatgagatagaacacaacctatatacaataggatgtgttccatccaatcgaacaattatattttgaaacggagaaattgtaagaattacaagttgtcctagcatatctgcactcttccatccatcccaaaataaataaaagaaaacttttgcaaaaccataaacagagtaaaacggaccgagacgagaataagccagcggagcacacgcgcaacaagacaatttttttgtttggcattcctatcaaaatattcccaacatagcatagcttctagtggaaactgtgaaccactgaaccaccaccatagacgatagcgtttgtagcttgcttgcaacggacaaaccaattaaataccccctccgtaaccgcgagattctaagttttcaacgaaggctgtatttagttccatgtcaaaattaaaagtttgaaaaaattagaacgatgtgacagaaaagttggaagtttgtgtgtagaaaagttcgatgtgacgaaaaagttaaaaattcgaagaaaaaagttagaatctaaatagggccaaagcgagaaagcttccttgcaaatcctggctgtgtgcatatgtatcagtacttccttcgtctcagtaagttaatttttttttattttttttatttattccaaaataaatttattttaaaagtaataattgtatcaaaattgatgaaagtagaaaataattatattgaaaatagataaatgagaaatagttgcattgacattgataaaacaaaggtattttagttttttattgatgatatgtgaaagaagatactttctccgttaaaaaaataaatctaaaacgggatgtgacacattctgtacaataaatatgaacaaagatatatatttagatttatactagcacactgcacacgacacacacaccagcaacgggggcacacgacacacacacaccagcaacggggattagaagttgacacgactgtctatctggaatcctagctgtgctgcggtagcaactgtcctcagatgctgatactccctgatagccatagccacgacgcgatggggtccccatccatcctcccctcctgctcggttgttttcgcttcaggttcagtgcagtcacgagcgcggacgcccccaaaaaactcgccacgctgtgtgcgcgcgcgcccaccgcgatccccctgatcccattaacgtttcacccgcgcgcgcccacctgccgctgcaatatatttcgccgcgccccgcgccacgccacgccacgccaccttgcgcgcgcgcgcgcacacacaccccagcagcagagatgagggggatgggcgacgacgggatggggccgatggcgatggcgccgccgcgttccggccacgccacggcggcggcaccgccgccgccgcagcacaagatggcgatgatgatgcacatgaccttcttctggagcgaccgcgcggtggtcctgatccggggctggcccggggagcgcggcgccgggatgtacgccctctgcctcctcttcgtgctcgcgctcgccgcgctcaccgaggggctctccgtgctctcgcgccgcctcgcccgccgcggcggcggcgccgcctcctcggatggcggccgcccggcgccggcgccggcgtcgtccgcggcgctgctgaccgcggtgcacgcggccaggatggggatggcgtacctggtgatgctggccgtcatgtcgttcaacgtcggggtgctcctcgccgctgtcgccggccacgccctcgggttcctcctcgcgcggagcagggtgcggccggccgcccgtgacggcggcggcggcgtggcctgtgagcacggtggcctccctcccgcggatggatccaagacttagtccccatcgattccgttaaacgagtatgtccaagcgccttagccagtagacactatgcactgtatcggatccaatgtgaaaatttaccttggatatctcgctaaaataattgtattttgtcgacttgcttgatatctgttcccgtgcagtcttctctagtcgtttttcgtttgtactcctatgtttcaagatggaatgatactactactagctagtattgatgtgagttctctactatgctaactttagatgaaccaatgatttgttagtactctccttccaaaaatatcctttttttaaatggaatccttccaaaaatattagatttatttcatattttgaattagctacatttgtagttttcatgtatttaaaacttaaatgaatagataaattaaatgattaatcggaacccgatgagtcatcttaatattcattggctgcgtacatgcatacactaattgatctttgttacaccttatctccacttaaattattattatttaaatccttcacccttaagatttctaattgtattgggtgcatatattgtatttattagagtgataaagatgataataattgtttttgttctttcgattaaatgtagctgtgtcttatattcgtttcatatgttgatgaaaccaaccctctagtatatgtttcatgctcatggtaacatatactagggtattctttttaaattcctattttgtgatagtgttgtcatcaatcaccaaaaagggggagattgaaagatctatgcactagaattgccttgtaaggggagattggaatatctatgatcctaagagcgcggtgattgttttggtgattaatgacaacccattgttggaactaactatttccatgagttggtgagattaggttaagtttcagcatcaagttaaaagattgaagctagaagatggacattataccttgatgaggagcaagtgaaggcattgatgatgcggggtatgaaatggctatctatggcaaaccggtgaagagaaagcaaggctcggctagaagatggacattataccttgatgaggagcaagtgaagacattgatgatgcggggtatgaagtggctatttatggcaaaacggtgaagggcaagcaaggctcggctacaatggaccatgtggggggtgaagggcaagcaagaggcttggcgccgatggactgaatccggtggtgaagggcgagtgaaggctttgtcatgatggtcatgatggaccgtatgaggccatttgaagctatgagtaatccgtatcaattataagaagaccgcaagatggaatgccgaggatcaagaggatgtggttcttcgatgaacatcaagtcaaaatccaaagtgggcattgatcaaggcaaaggtataattgatttgggactaatatgcttaatgagtgtaggtgagaatagtcccaatagtgaaatggtgttgacatagacaaccctcaaggtgaagcaagaagatgttcctagtggtgtattagtcccaggttgcttaggagtgggctaggatgcttggagatcccccaaaacatcaaaatcaaagtggcgagaagactcggagccgagttagactagtttactttttcgctttgagtttaggaaaaaccgtactattaaaaggggttccaagtatggttctaagataacacaagtgttcttagtggtgtccaagtgttgaaatatttttaggagctgtttttgaaaatgactctactcgggacagagagtcccacccggaggttctgtccggaacttcctggcgccgaggtgaggttgaaaattttcttaagtgttgcccggaagttcctggcacccaggtccggaacctcctggcaaccctccagttcaaatatgtgagtaacggctagatgacgtcacctaaccgttatatatagccaactcgaccccagctcattctttggccattccactttagttcttgtgttccctagcttgttctagcctctcccaatgtgattttgcttcctccacccaaatcttgtgcacttattgagtgagagagtgaatttgagggtggtggtgaggattggaaaaggttttgaaggctaggatgacttgagcacttggtgtatctcgttgggctatcacttgaagcttgttactcttggagggtgacctcctagacggttaggtgtcgcccgcaagtttccaacaaggttgtggattgacccgggcaagtttgtgagagcgttattccacctccgaaagaaaacagaggtgaggtttaggaggtcgtcttggtagagcaagcctcacttgtggtgttcttttggtgtttaagttggggatcttagtggtcacttgaaaccaaagagaagtacctaggggtgttggcttgaagaccggagacctcttcctaggccttttcttggcgaggcaaggtgttaatcaagacccggctctttggagctcctcaacggagacataggattctcggtggagaatccgaacttcgggaaacaaatcatttgtctcctctcactctctttatctttgtgattgtgatgcttatctccttatttgcctagttgtgctatcatgtctcccattgtatgatcacttgtgatatcttgtgtattttcatgtgtattactcttgtttgagacatgttgtacctctctatagtttaggcttccttgtgatttaatttacttgttgtgaggtgtttgaaatagcaatttacaactgcccggaagttccttggaagaaccccggaagttccgggcagctttctctgcttgtgagaaaaagctgccaggaagttccggaccttttgccaagaagttctgggccctgattttaaccgctacgatttgaagtaaattttaggtgcgcctattcacctcccctctaggcgacatcaaggccctttcggtaagcaactattgtatgattggctattagagcaaggttaatagtatagccaactactagctcaaattcatctatagccaatctaatagctaatttatacaatagttgcttactatactattagtatatggtcctacttgtcatacacacattgcgtcttggagtccgtgctgcagctggctacatctctctcatcttttatctcattaaaatatgtttgtagctggctaatagtttgttattgtacctgctcttatattgactatatatgatttggagttagtagtgtgctatactattaaacttgctcaaattgtttttcgggtcagaaaagaagcttcggatcattaatctttcatgtaaaaatcatgtaaagaaataccgctaaggtctattcaaccgggcatcaaccatgtggaggtctgaaaatatgaaaacgaccttgcagggtggcaccgtggcatgtgtggaggtagcactgtggcagcggcaactacctgtgctgtgcatctctctgactctgtgtggtggcgaagatttggaaaggcagcaggaagaatcttgcaagatcattgggtcccgttcttttctctaagcaaaagttgaaaagattttcgtggcacgctttttatatgaaagttaaaccgtatacttcgtacaaaaattttatatatgaaagttgttttaaaatatcatataaatctagttttcaagtttgtaataattaaaactcaatcatacgttaataccaccttattttgcatataaaacttaatttttatttttatttttatcttcagaagaaaaaaaacaccatctaaaaatcgagcgtccagaacctcttattaaaaaaaggggacgaaacagagggttaaaaaaaaaagcttatcaggcctattagcagtggcagcagggatgaaaaagggatgcttacaagaaacagtagcatctttcatctcttctgaaacgacggattgtcaggaccatatttatcaatttagctatttagtaaaaatagcaatatgatgttaaatagaaaattaaaaatttataaataggtagaaccagaaacggtaaaaaataataccactcatatggaaatggtgctcggtcgacccggaatttccgtgactgttttcatccccagtggcaaaaagggaacaagaaaaaaaattaatttgatttttttcatatagtttgtagattagcaattgaaaaaaaaaatactacagttttagttgaactgagcagattattggctatgtattggtcgcaaacttgcttctcatttaccattcttaagagccccaccgaccgctcccttctccatctctgatgagtatgtcgctattgatgcatcttctccaattgtctccaagtacgacacaatcccccttctccttcgtctccgatggttcatgccattgccgcctgcttcctaacaacatgaccttctttgtttccgcggttgatcctatgcactactctcgttcatccctaagcctctggtgctaacgcttctgtctttccctcaccggcccaccgtctctgccactcattgctattcctccatccctctaaacctgctctcatcgaagtcctcgccatctccctcattgacgcctccacctcttggcaggccatggattttgatccaatgacatccattagtggattcagaatagcaaagcataaaattaaaaccgtttatcatgttgtctattcgtaaacttatgcgtgaagattgatgaactgaaccaaatgtgaaaaccccatatacaagactacaaattacagcactattttttttttttgaaaatccctgatatgactatgcctatagaaaatcctatgacgtaaatatgagggggctttgcagtattgagactctgaacagaacctctctcaaagaaagaactaaaatacgtacttcaagaaaactcgattgaatcatggcccaaggcccaaagcccagtcgacgcacataaaatccaatctctcccggttgacggaccgatccccagtggaaaaagtctttgactgtttccactatcgcccgagtatgatttatttcctccaaccacaaaaccggtatatcgacttctctaactattaaaaccggtgcaaacaatatccctcggtagttttggaggtgggtttggctgatgtggtggtattgactaagtctttctcctacgtggcgcttacgtggcattaaaattaaaaccaaaataaaaaatatgtgggatccatatgtcattaaaaaacaattataggacccactgatatgtgggacccacctgtcatcctccctcttcttccctcttcctgcccctctctcccttgtctctctctcctccccggcctttctctcctcgggaagacgacggtgtggagaggcggtggggagcggcggcgaacgagggcggcgcgggagaggaggtggacgaggaggtagtaggcgcggagggagtgggggatcgacgacgacggcgacgaggaggcggcccagtagaagaaggtgagcgcattcctagcaacgagctccggggaggaggaggagtggcggtgcttggcaagggagaggaggacgacgtcaacttggtcggcagtggggaaggcggtggagagcgcctcccatgtcgctctcggatggtgcgcgaggtaatgggagatgcgctgaggcgtcttggcggcggcaacaaccatagcgcacgggggaggaactcaccagccgtccacgcgcgggggagtggctcaccggccggtcgcgcgca

SEQ ID NO: 16373 - DNA, 9235 bp, Oryza sativa
ggagagagggaaggagggaggaggaagaagggaagccgggaaggagctagagggaggatgacatgtgggtctcacatatcaatggatcccacaatataattttttgtgtgagtgacatgtaggtcctaccttttttttatttttattctaatgccacataagcgccacgtagaacaaagacttggtcaataccgccacgtaggcgccacgtcagctaaaatcaccgagggatataatttgcaccggttttgatagttggaggagtcaatttacctggttttgtggttaaaggatatgaatcatactcggagctatagttgagggagtcaaagtatatttttccatcccaattgtcccacccacctgatactaccatcacgcgacgcgacgccccacggccggcggcggcgcgaatcgcctaccgcccgctgcacaggggcactagacacacatgggctgatgggcacatgacttagcccagcattctcgcttacatatcttatgttgttttttttattaagacgtggattttaccaaggattttattagtatgttttctaaaccgctaaacaatatgtttttcaaaaaattatataaaaataattttaaaatatcaaataaatttatttttaagtttgtaacaattaaaacttaattaatcatgtgactttttcattttacgtatgctaacttaatctatatccaactctattttaattatatgttaatggcttttttattttaggtagactatcttaatcttcgtccaactctattttttaatttttaagtttgtaataatactgcccaacacggccaggatgaagcgtcgatctgaatttctttttcaattttgagggcactctccttctagagacactcccttatgaacggagcatcgaatttgggattgtggcaaatggcaatgcaccgttgctgtgcacaggtgccggccgggcgcgcttacacggctacacctaacacgcctacactcttttttctcatcagtcatcagaatacttacacgtttacatttgtgcttttgacaatcctagtaggttataattagtactaagtgcttagccgatgaacgaaatgatgaccaacaccaccgacacaccaccaaaactcttgtatggatgtttttctgttgtttgcatatcatttaaatagttacaaataaattaataaaaactagaagatatattaatatgtgatatatcacttcataaacacgtaacttaacatttaatttctacttgtaagtttaatttattttttgttgtcatatacagaagttaaattttaagttgtatgtttgtagagtgatatatcacatgttaatatattttttaaaagctttttataactatttgagtagtatgcaagtaaggagtggaagtaaggagtggacgttcaaaactagtactcgctaaactagtcgagatctctttttctctaccgctgcgcaacaacatttgattgaaccatcttacgatgctttttctcaggctcatgcagccatgcttggatgcttgcgttgttgagacttgagagcacggcacgtatgcgaacttgatcaggtaggtcgtcacaaacgcggcgcgcgtcgacgagaggccgagacaaccacccacccactagcgcgcgcaccgagcgagctatctctccgctcggtctcggtcgatcgccgcgcgcgcgcgtggccgagcttgcacggcgccattggccgacgcgagccggtgaggcgatagtgctcgctccaccactctccccgaccatcatgggggtgtcacctcacctgctacgcctgtatatatataaagcaccagcagccatgaagcccatcaacgaaaaactacgtgacagcgtgacacagggggtagttaattactagttattcgcagtgcgtgcgtgtgtgtgtgtgagcgatcgattgatcgagatcgacatggcggtgatcaggggtgtcgtggtggtggtgctcgcgctggtggtggtggcggcggcggcggcggacggtgcaggggagtgcggggcgacgccgccggacaagatggcgctgaagctggcgccgtgcgcgtcggcggccaaggaccccaagtcgacgccgtcgagcgggtgctgcacggcggtgcacaccatcgggaagcagagccccaagtgcctctgcgccgtcatgctgtccagcacgaccaggaacgccgggatcaagcccgaggtcgccatcaccatccccaagcgctgcaacatcgccgaccgccccgtcggctacaagtgcggaggtaagctgagatcgggagcagcaaagaaaacggtgttagtcattaacgcatggtaattaagtattaattaaaaaaacttaaaaaatagtaacagtttttataaaaaatcacatcatttaataatttgaaaaggaggaatagagttgaaaaaaaaaagggaagaagacagcctaatcaacatgtcaaactgtcaactcttgccacgaacaatctatgattatttcatcattttcagttggttggcgctaacaatctaacatgatcgattccttctcaattctctttcacagattacactctgccatgagcaacaaagagtactgcatgcagtgccggtgccgtgtctgtcatccgcttaatttatcgagtttatgtcgtgttacttactaaagctgtatgctgttgtgcgttcgtgcagtttagtgtcagtgtcaaacaccaaataaaagggttccatcttccgtgggacttcgtgatttcagtccgtagagttgtttctccaagtccaggatagtgtgtacttgatcatattatctcggagggatgcagagacgctcccctgaattctctgaataatagtacaacttggtttgttcatcgattcacacttttagttcaaaaaacttgctatacatttttacatcttgtatgctcgcttatgccttatgcccgcagaggagaaacagaggaaacatgcaactagtaacagtgaagaaattcagaggttgtgtgctctgcttaaacgaaaccaaatcctctcacattagtgtacagcgcgcacatggtcactgatatatgagactcatcatttatggacccatatatcagccaccatgcctctctgatttaacgtcagaagatctctccatagacccacatgtaagaggcgcactctcacatgtaagaggcgcacttctctctctgactatattagaggagcatcatcgacggttgtgcatgctgctcgcctgcaggctgatactagtgcttgcaagcttagcaaggggcgcagccacggtactagcctactaggtacgttcacacgtgtgatccttgttatgagccaacgatcgctccaattgacaacgtcggatgtgcgccacatgcacaatgagccaatgattttacccgaatcacaatattgaacatacacaacatcggatgtgcgttagacgcatccatgtgagccaacgattttcactctattagagcacgagaaattgagtgtttcttatcaaaaatcgtttttttttcaaaggtttttatcggagccgagagtgcctacctccgagccgagagtgcccgccctttctgtcaagtaggctactttttccggaacgcacacttttttttaggtttcataaaagcatatttaggtccacacgtgaaagaacctcatgaatatcgaagactgctactgagttgacaccattccaagaattgaattcattccgcaaaccaggacctatatcattaccaactccagacagtcttgcagaaactattaggggatttcaactaatcctcacaatatcggttgtgccccacgcgcccatatgatatcgatataggagatcgttttaaatctaatcggagccacaacttaataagattgactagtcttttaggtaagttatattctactttctccgtttttaatagatgacaccgttaaattttgaacatgaccactcgttttattcaaaaatttatacaaatatataagatatatatcatacttaaaatactttgagtgataaaacaactcacaacaaaataaagtataattacgtaatttttttaataagatgaacgatcaaacgtgtgataaaaaattaacaatgttatctattaaaaaaacagatataatatttttaagttgtgctctccataataagacatcttttgcttgatgtattacaatgacgatgttgctacacgtggacactggtgcaccatcttctagtagatgtatcgttcatcgcagagggcacaaatttctctatcacatataggaggtgcagagcaaaatgatggatccaccaggccccgcgtttgctgcttccgctgaaaaacaccgtgaaaacaaactaaaatggggcgcattgttcacaaaatttcgctgctttggcttcaaacgaaatatagggcgatactcctacaaaatcgcaaacttgttgtgtggtgtacgtataccactcttagaccttgttcggtttagagaggtttaaagaggattggagggggaataatttcaaatcccctcaaattctttcctcatagggattaaccgaataggccttatgattattcttttccccaattccggaggccattttgtactaacattgctaactaatatctccgtaccttatatgtggttaaattatgagaacgttcgactcgcatgcaacaaagtatcatgtgcattagccatttggcctgcaggtcatcacataaggcatacttgttagggtgcacagtacacacgctactaattaagcgaaggtgtgtcacaccctcacacgttccttgtgttaaacatagcacacgccacgacctgccacacttattttgtgcacataaatggcttgtcctaattttaagtcaaattaatgttgtgtttactgttaaactctcgagtattagggactgaactaaaaaacgtgtgattagacgaattgtgaaagctaaaacacaaaatataataaagtttgatttttgaagttcacaaatcctagtgacaaaaaaatagacagtagataatatgtgggaggataaatgacacaatcactaacaagtcggataggagtgctatgactttagagaatatggagactagagtagggagcccctaaatttagggatcttagataggagtttcttgaaacagtgttttagtaactttacatagtgggatagcgagacaattcgtgtaaccattctatccactaaaccaaacatgttataatcgtaagcacatctgacactatgcagagagtatcatctattgtcaggttgagtttgcagaatgacttctgagataatatatttacacatcgttttaagaatcatctctatacatgtatcgtcctgatatttctgcacgtacgtagtgctactttgctagcctattccattaattgaccgggattgccaagtgtccccggtatccatatatgttcatctcgtttttgtgtcataaccgtcataacgtttccgctcctgatcgatcggcttcacgcacgcccagcactatataaccagctcccaagcgagccgggagtagtagccaacgagcttatagaacacaagtacaagaagctatcagaaatcagaaacgctagctagcagtaggaacaaacaatgaggtcgtccccgatcatcttcctgctcctggccgccgccgccgccatcgccgctccgtggcaggttgcgcacgccgcgggcaagtgcggcaagacgccggcggagaaggtggcgctgaagctggcgccgtgcgcgaaggcggcgcaggaccccggggcccggccgccggccgcgtgctgcgcggccgtgcgcgacatcggcacgcaccagagccacgcgtgcctgtgcgccgtgctgctgtccagcaccgtgaggcgctccggcgtcaagccggaggtggccatcaccatccccaagcgctgcaaactcgccaaccgccccgtcggctacaagtgcggcggtacgtacgtattgcgtgcgaagagctttggttagcttcatattataccgtttcatattacaagtcagactttttaaaagtttgattaaatttatagaaagattacaattatatcattaaattagttttattaaatctaatattgaactattgtttgataatttattcattttatattaaaaatattactatattttttataaactcgatcgaagctaaataaatttgatttttaaaaaaatcaaagtgataacagatgtagtatataatatctctgtcgtagaatataaacatttttgcgtatttttcgaaacatatttggacatctatatatccggatacagttcaagaaacacatagaaatgattatattttaaaaccaagtatatgacaagtgtgatggttctctgccttttgtagcttacacgctgcccagcctgcagggctgatgacgacgtacgacggccttgtttaggctctggcgccactaaaagctacctacagatcgcttacagcatactactcctataatactgttgcttaagtgtgctagctataccctgcactgctgatgaataagtatgatcgagctagcaaagcaactctacatggttgggacgtcaacactggttaatctcgtgcgctgcaaatggtctgctagtgtaatcctgtccgcatatgctgcttgaggttgtaatgagaatggacaaagtttactatccgcccgactgatacgtataccgaacatttacgtagcaatgagcgtatgcagatacgccacacaaaactatagactggcatggcatggcatgttgtctgtgttgttgtcacactgttgcgtgtgtcagatgcaggaaaatacatagtgaaaacctaaaaattactaattgaaaactaaaagtccaagatttattacgtcaccatagagtgaaattttctctcaataaaagttttactcatgagtaaatctacgagtgaaattcttactcgtgatgatgtgtacgaatctcaaacattcatttttcaattcaacggtagttctctagtttctgccgtatattttcccatcagacgccggtgctccctgctccgtggcgccgcaacgggctacttgtcacgtgctcccgcctcacgtttgccacctcatgggctgggcttcctcccgcaaccaagcccagaaactcaccaacgccgtggcaaacgctcaatctcagccgtccatcacgagcatatcgcccgtgaataccaccaccaccagcaaaccaggcggctcgatctccctatcccctgattcccctccagcctctgcgtccccattcacctctcctcctcctctttttctacctcgcgctcgctcgcttccttcgtaaaccatccgcgcgcgtggtccttccatggcggccggggctttcttcttcgccaaccccgccgcgcccacggcgaggcaccagcaccggttgctgcagcagcggaggcagccgcggctcctcgcctcctctcggcctccccggtggcggctctccgccgtgcaggagaccaaggagggggaggcccagacggccgaggagatcaccgagaagtacggcctcgagttcggcctctggaaagtaagcacgcggcgcaggcagctatatttgtcgagttggagagcaaatcgatcgtgagcgcaatcgaatttgccgcaggtgttcagctccaaggaaggggaggaggaggaggggaagacgaggaagtcgaggacggagcaggcgaaggagctcctggccaagtacggcggcgcgtacctggcgacctcgatcacgctctcgctcatctccttcacgctctgctacctcctcgtcagcgccggcgtcgacgtgcaggacctcctcggcaaggtgagctgtcttcctgctctgctcgcacgggctgcggcggctcaccggccggcggcggtggctcacgtggctcccctgctttttgccgcaggttgggatcgcgacgggggagacgggaggaaaggtggggacgttcgcgctggcctacgcggcgcacaaggcggcgtcgccgatcaggttcccgccgacggtggcgctgacgccggtggtggccagctggattgggaggatcaagaaggggggcgactgatccatcaagtatactttgatctttgaatgcgtgaattcgttttgatcttggctcgttcgtactgaatcatgacaagtatatatactagtggtatgtgaatcatgtatgtaagcttagatgttcaagtagagggctacccagtaaatctgctgctacttttgtacaaacacatgctaaaacagtataatgatctagtgtatcccgaattaaactactactagcagaaatgggtgttgtgcagattcaaacactcattaagttattaatcataggtacacagccagaacattcagaagcctttttttaaaacattttctgcatgaaacttgcatagaacaatggttgctcatatgctgtacaccctagtcgaactatttacagactgaccctaccaagtagcttaagctgggagaaagaacctgagtgagctataaaaataacacaacgaagcaacgcctctatgtacaatcatatcgatcaccattggaacaggagggtaatcaaatcataagtggagtgataagcaaatatgttttcagatccataccgccaatccagaaaaaaatggctatctgactatctcagtatgtacatcttcacgctgcgcctgcacttcctgttctctgggaaaggatgcagactcccatggaaaccaccggaggaattaagtcataccgaataacctcaatcgacaccagtagatctggtctagcagtaaaccttactggttatccatggttgaagcccacgcctgtaggttcactggctgcagcagacggctggttgagtgcacatggggtgtcacttatttcttcagctaagaagtcgttggtgtcaatctgatcccactgcatttctgctggttatcatgttaaagtacttcaaagttcaatgcacagtgcaacttgtaagctcttatagtatatgagaaaaaaaaaacccaatgactatatttcatcaaggatacatgctgttgtccacatatgagtaatgctgatatcatcatcggtgagaagccagtaatcagcatcagtttgcaaaggtgtagaaggatatcatgggttagagtttaccacataagtaatttgtttattattgagtggtaaaacagtgt

SEQ ID NO: 16374 - DNA, 1567 bp, Oryza sativa
taatactccctccatttcatattataagtcactttgagtttatcctaacttacgcaaacttgaaaatgtttgacttaggacaaacccaaagtgacttacaatatgaaatggagggagtagcagttgatcatcaagtattgtttatatggagaagtcatttagtgtttattacctcgtcaggatctggaacttcaactgtagtaccacgaggtccttttattgcgattaatgcttcattctgcagaatgagaaaagccaaataagttacatcaaaattttaattcagcacagcccccataattttatgttaaacaaaattagatcaataacaatattgccttccttaataacatagacaaacctgaaagcagggcagtcccttgatgtcatcttcagtaacaaatagccacctaaaaacaggaacaaaaaatatagctcagtacatgattgcacagtataagcatattacaatttgcaacaggtaaattgtcacgagtttaactttccaccaggctttgccaatacttccattttgcaccggttctagagaagatatgttgcagaaaacaccagctttgacgctgcagtcttgacgaatggtggaaatttgtgcatgataagtctatgatgtcagatggttgactggtggttgatctagatcaagtagaagcaagcagggaggatgatggttgtaaggtgtaatgggatatggtgaaaggattcacaaaacccagtgcaaagtgaaacttgggtcaattcactcggtgcaaagtgaaaattattaaaaaaaaatggcatgctagcatgcccaacaaacaggaacatcactacctatggttgctttcgtcttcagttaactcctccatcttttcccgtatttcactgcaacaaataatcaggaacataagaaattactgtcgataattttcagattttggaacctccaaaagctaccaaccttatacttctatctaaagcttgctcctggatgtaaaggttttcaacttcggtctgcaagaacactgaaggcagcttagactcagaacttcttttacaaacattcagataaatttgccatgagtatatagattttaacatgattgcgtaaatgagaaaagtagaccggcaggtaccttgagacatgaaatatcactatcaaggttagttcctgagtcatccgaacccctgtgatgccatgaggttagcatctcacaccataaatacaagcatacaagggaaacagaagataaagattacctccaacggattctgttcttaagcttcttttctatcaaacctgttccttccagtacatttgttatgtcatatatgcgccgtttccgaacctgtttttgttggaaaccatatataaacctgtagcaaaactaacgaaaagaaatgactgttaaaatgagagagagggggggggtttacccatacatctaatatctttgcagcatcattcaaatctagaatgccatcttgagtctgcttgagcaaaataatgaattttctggtcaatagtcctgaacaaacatcacatgaatagctgtcagttaaaaagaga

SEQ ID NO: 16375 - DNA, 5625 bp, Oryza sativa
ggggaaaccagaaggaaaaaagaataaccttccacgggattctgttctttaaccttttttctattcaaccctgttctttccattccatttggtattgtcatatatgcgccgtttccaaacctgtttttgttggaaaccatatataaacctgtagcaaaactaacgaaaagaaatgactgttaaaatgagagagagggggggggtttacccatacatctaatatctttgcagcatcattcaaatctagaatgccatcttgagtctgcttgagcaaattaatgaattttctggtcaatagtcctgaacaaacatcacatgaatagctgtcagttaaaaagagagtaaactgtatcaaatgagatgatgtgactacatttataaagcaccaaaaattcataatggtacatttaacatttagatttccacaattgaaagttctaggtgagggactgctatgatcacctaatgaattgtcatagcgagaactggcaggagtggatggatttccaggtgaacctgcagatacaaatgtgtgtgcattgcattagtcacaggaaacaagtataaagaaaacagaacaaagctgtgataaacaaatactgttaacttaattaatgtcactgatgaggaagtttctacttgccagcattggatataggcgtctgaggtccagctttattgaatttagccattgatttggttgtcctagaagtttttccagaaactggggtcataagtgggctgccaactccttcagtaaacccagggctagtcatcatacgttcacttgactcagcagcctcactttctccacatggagtttttcttttcagctatgcacataaagggggatcatgcattcgtaaaatgggcaatagtattatgtagtggtcaactcaagcgaattgaaaacttaacaagttaacacatgaatcataataagctagataaaaataaatagcaacacctacattacaatctcatgatccaagaaaacacttgcaagggtacaagcaatggcaggcataggtgtataactgctttggtgaaatgattggtggtcattgaatttggaagataactatcagcaatatccatttcataatcctgtgaaatgatatgtgtttctgcaccagcacacctgtttgccgctacaaccgccttgtgcatttccacatggaggagagtatttccccaatgtgatccatgaggacccccaataactaacatactctcaatcacgagtaaataaaactgcttcctagcaaatgcactgaagatgactagatgaacacaacttctagcagaatacgcatttcagacgtcattcagatacattgtcctccaatttagaatcatgacagaagcatctttccgaattgctgacattatcttccaagctgctagcgactaaggtaaaacagcagtggacacatctacatgtcctagaaagtaccaaatcctattatagtaccatcatactatccaagccgacggaatgcaattttcaagtttcaagtgggtggcttggataagtgaagagctattacccagtaacccaaaacaaaaatataccagaagacagacatttcacaaagccttccactttggcgtcaataccacatgactgaatagatagattcatagacagtagtaattctaatcttcccccaaagtatttggcgactgtaacaagccgcccacgaattcacccaaatccacatgttaatctacaccaacacccccaaataaaataactggaaatgccgtttaattgaaccgccatgtcaccttgtaccgccaaatagctgccgcacaaaacctcagaaacccgcacagaaaccatccccgagaaggaaaaaaaacaaaaactagccaatcaattggtgcacacagtaaaaaaacctcttcggtaataagctcaaaaacggcaactcacgggtgtcctcctgatgacaatcccctcctcgatctcgccgccccgggacgccgccgcgaagcggtggtaatcgccgggggccgccgcgaagggcgcccgcgccagcggcggcggcagcggcacgaaccgctgccgcaccgaccgcacgatgtgctgcgccgccggcggacggcctcctcccgacgacatgcctccgatccgcgagaagcgcccaatcgggcgggcgcgccgcgatcaccacccccggacgcgtccgacggagctagggtcccggcaaggcgggcggcgacgaggcggggaggtggggggagtggggcggcggggttaaggcgaaaagcgcgaggttgtgcgagcgagaatgcgaggaggaaacgagggtggggggaagggagggaaatttttagccgcgttcgcgagtcgagtcgcggacgtgtaggggggaagatgtggatggatgtggatgtggactggaagaccggaactggaagggaaggcagcggggaggggcgcgggtttgagacacggcttcttcatggaggggctgcgtgcaaaatatcgcgggcgtggtagttggtgttatcctacgcccgcggctttgttgttggcggtctaggctgcgttaggaggaaatttcaccatcccccatgtaaaataaaacgattccgtataaacatacacacgcacatctaagtgctgttttgggagcttaaacatgtactccatctgtttcactaagtcattctagtattcccataaaaaaattcattaacatcaatataaatatgaaaaatactaaaatgacttgcattatgaaacggaggaaatatttggttctagaattagatgtatttggttctaaaactagatgggatgggatgatttttcacacgtatgtttggttcataggataggatcattctttgtttggttgaaaagatgagggagtgatgggatggacgctatttgtggctaccgtcaacccacgtccgatcccaataggcgcggcctagcaactcggcgagcgagcaagcggagtagggacggcgcggccgacgactcgacaagcgaacgagcgagcaggcagaaggaggagcagcggcgaccaacaggcggacagacgagcgagaaggcggcggaggcgaggcggcagccgcttctcgcggagcagaggtggtggcggatcgcggaggacgccagccgctcgtggaggagaggcggtgggtcgcagaggggtggtcgccgcacgtggaggagaccgatgaggcacagctgcggccgctgctcgcgaaggagatggagaagccgaggctgcggtcgccgctcacggaggagaggcagctgctgctcacagaggagaggcgacggaggcgaggttgcggctgtcgctcgcagaggagaggcggtagccgctcgcgtaggagacggaggagcggcaacgggtcgtggaggtggcggcgtctggtcatggcggagtgccggcggtcgcggaggtggcagcaggtgtgaacaacgatggcggatgcagaggcaagttgacgccgtgtgctacatccaagtgggatgagttcgtccggccgattttgccggatggcttggtcccaaatttgagaggaatattcatctatatggatcaacccaacccactcgaacctcaaccaaacactcctaaaaagtgggttcatcacatcccgtccttgcaaccaaacaccatcgattataagaagcggctggtatgtagtcagcttttgagaatctgaaaaagtcaggcttcccagcttctggcctctagtttattttggattctacaactacatcttctcagaatttgtaccaaaagttgtattgtttagggggcttctgattttgggagaaactgcaacagctagaagcttccccaaataggtccttagtatctttggaaaaattggccaggtatattttgagattagtgaagtcattagaaaactagaccgacatatcttgaaattgatgaagtcatcacaagcatctcgctatcgacggatacgtatatacctatcatataagcactcgtataaaatctataatttgaacccgtgtgaattatttcaaccacaagaaacctaactaattgagctacgttcacttcgccacaaaaataattattttgtgtatatattagtgtcacagcaaattattgtacaatttcaataattataaaaaaggtgactgcaaatatcaaatttatgtgcaattctgcataatagtgcaaacaaaagatgatctctataggttcatcattttatcatgcatgatgccgatcacgcatccacagttccacactacacaccactgttcactaagctgtaagtgggttccaacgtctcgtagatggcaccttgaattcctaaattagattcatccaggattgatttctgtttagacttgtagtattaggccatttccaacccaatgactaggatgatgtccatagcattaaataagctgtcacataggatgaaaaatgatgtggtaagtaaataaatgaggaaagagaaggaaactatgtcttgcatgagacatggtttttacacaaacatccaagacattatgtgagataagtagcattaaatttaagtatgaaatagtggtgtttgcattggaagagtagtgtctagtactaatttcttaatgatgtggagtttatgaaaactacgtctagtattttgggttgagaatagccttaatatatatcatataccgttgtagatttgtttttttacgtgacaatgagtaccggacagacatgcgacaattagttgatacaatcgatctggtcaaacaacagaatcgagcatcccgtagagtccccaacagaggttggggggggggggggggtttaaacaccgcctccggtttataggacaccagtgcgccaccgcccgtaggtgacgtgcataggacgctccgaccgctgcctccaattaaacttgtttcaccgactcatcgctgcccccgctaggttcagcattcagagaacacccatcttcgtcttcgtcgagggcacctaggagtctaggaccaggcgaagcaaagatatcgatggcgccgccaccggcgttagagagagcaatccggattccggccgacggcgagcgtcaagtcctgcccgaaccaattcaccgactccatcggccgtacatgcaaggaggacttgaatgggccgcatttacgccgcagcacagctccggctgacatcaatcaaatgaggaataagttcactatcgtccctcaactttacattgagtgtgtatgatgtctctaatctccaataccagaaatgtctaacccctcatctgttcaaaatcatactaagtaagtctctcgacagtatggatgtctggttttgttgacgcggcatcctagtcagaaaaaaagtttaaaaataagtgggggccacatgtcagccctatcatccttattctcttttttttctagcctgggagagaggggaaggcagcccgacgccggtgggggaagaggcggccggcgtgggaatgggagggggcggcgggagcggccgacgggagaggggggagaggcggccggccttgtcagtgggagcagccaccgtcccaccggccatggccatcaccggcggcgggagggtttgctgctcggcttgcggtgctcgttagaggagtcgg

SEQ ID NO: 16376 - DNA, 1344 bp, Oryza sativa
ggtcaatcagtccttgtaggtggggcgccgtggcggcttttggtcgcctatttcactttctttagcctctcccccctctccccccagtcatgttggccacctctttcccgccggcgttgggctacctccccctatctcctaggttggggaaaaaaagagaaaaaagatgatggggctgacatgtaggcctaacgtatttcttttaatttttgttgctaaataggatgccacgtcaactaaatcaggcattcgtactgtcgagggatttactttgcatggtattgaacagttgaggggttaacatatctagtattggggattggggatgtagcctcgatgtaaagttgagggatgacaagtgaacttattcctatcatttatcctcacgtcctataaaatgcaacctaggttgagcttctgttggggccaagaagtagtaggatccaaacctctcgaatccatggatcgtcaaagcatcagaatccccaacaaaaaaaagccgagctggaccgaaccacccaatccacgtggcactggctgtggccactgagagggcggcacgtcacccgtttaaacatcttcctccatttcgcaaacgttaccagatcctctgacgtagaatggttctacgtcagaggaaagtctgagactagattcccgttcgtcttgcatcctaaggcagcatctgttccagccttcgttgtttgatctggaggtgatgtctaacccgctccattcggcccattagtataccaaggagaaaaacaacaccgcaatagctaatcgactctgtcgtcggcgatgcgagaatgaacaaaaagagcagaggtcagaaaaaagcatgaggaactgcagtggaggaggggacggaatcaataacgttcagatggatatccaacctacgctacggttccacccgctcccgccatcccgcgcctggggagatgacgagagcggcgtgcggtcaggtcgatggccatggccgacgagcgacagcgtttctcttccaccttcactcgagtagctagttcccaactccctccaccctgatttccacacgcacgcttcctaaactgttaaacggtgtgtttttttcacaaggtttatatacaaaagctacttaaattagtaaatattaaattaatcataagaaaatgtttcactctatttttcgtgcggagggaacataatgcctcgctctattttccgtgcggagaaaatatgttccgtactcaagagaacaaacgcagtcttctgcaaatgggctgaaaggagcagtctggacctcgtctctaggccgaacgacgagggctgaaacagattgcggcaccaaatcagcgcccg

SEQ ID NO: 16377 - DNA, 4331 bp, Oryza sativa
ggttcggcgcgatttgatgtttgatttttttggggtggtattggtgcctctgtgagagttgggattgacgcgcggccgcgtgtgtgcgtgcgcagggggacctgccgttggtcgggaacaaggcgccggacttcgaggcggaggccatgttcgaccaggggttcatcaaggtatggcggtaatccggtaaccacatgcacagctacattgcgccacgcacgcacgcgcggcagtgttattcgacataggggattaattggcccaggaaaaaatggggcctatttgattggcagtgtaattcaccgtgagatttgataatttaacactcttttcaatgggtttcgataaattgacatcctagcccactttcattcactcatatggtcccacatgtcatcctcacaaatgtcaattaaagtaattgggcaacgaaaaaagtgtgaaattatcaaattttttttacattcatcataggggattaattggcttgggccaggccaaaagaaaaaaaaagtggtctattcgattggtagtctagattagatgttaagtccatatccacggctgtttaatgtagaagctgtatggttgatcgtgcttccaattgatatcttcgttggtcgtgtccttcactccttctgtatatgcaggtcaggtcaagctgtctgagtatattggggaaaaaatatgtggttctgttcttctaccccctggacttcacgttcgtctgtccaacagatgcgttgaccttgtcgtgctctgtcatggaaatgccttttttttcagttttttttcattcctaaagtctaaatgcatgtttgtaagctctgcagagatcactgctttcagcgacagatatgaggagtttgagaagataaatactgaagttctcggtgtttcgattgacagtgtggtatgctaacttttacccgcatgactttagatgttgttacggtgtcgttacctggtctgttgctctattgagaatttcgtatttccattccatctggacatgtagcttttctcttgacaatatttgtggtttcttgaatgccttaaggttgtgatcaatattttagctttcctctttatgtgatcaatattctatttgttcttaacgtctgaatatagagcattagatgaacccttgcattaggccataagttttaacataagattgccacgtgttgaactttcattctgtattataatgaaatgtgtggtgtttgttatgccttatggaaatattgaatggaagtaaaaaccgatgctctctaatatttagacaatagcgttataaacattcaattcagttattttgaaacaactttgagaaatgagactgatgtaacgtcttaatactctggtttggttctgccaaggagattcattgcatactcaaataattatcccaaattatatccagtaaaagtattgattttgctactattacagtgagtagtttgtaggcagtagtggtactgtaatttattttttactatcctctctttctgcttcagcattaagcatttcattttttttatcttataggtatcattcactgttactctgtcgactataaatatttaataagtggccacaacctatgcttcataagtgtcgcatactaattgggctttgaaatatcttttgtttgcagttttcccatcttgcatggattcagacagataggaaatccggtggtcttggtgatctaaataccaactgatttccgatgtcaccaaatcaactagcatagtggcccgcgcagattgcgcggctagcatcattatatttttttctcttataatagcatatatgttttctcaatgtattattaaaatatattaaaatacccacataattttgtgtgtgttcatgagagcgaactcccaatattcctttgaattttagttatttgtaaattgtatttctatatgtactctaaattctactttaattttattagttttattctgaattttaaattcttatatggattctatactcttcttctaatattccttattttaattcctaatttatattatttgtaaattttatttctatatatggattctaaacttatctttcaatattttttaattcttaattttaattatttttaaattatatttctatatggactctatattcttcatccaatatatttttttaatttcgaattttttatttctaaattgtatttctagatggactctaacctctatatttaatttttcttattttttaattccgaattttcattagttctattgcccctaatttctattatttctaaattgtatttctatatatggattctaaacttatctttcaatattttttaattctgaattttaattatttttaaattatatttctatatggactctatattcttcatccaatatatatttttttatttcgaatttttttatttctaaattgtatttctagatggactctaacctctatatttaatttttcttattttttaattccgaatttccattagttctattgtataccgacatggactctagtcttaccttcctatattccttatttttaattccgaatttcagctattattaaaattgtatttctatatggactctgttttttctttttcttagattaatgtgagaatttctagaccatgagagcgaacgtggaggcttctttttctattcctttaataatataatagatttcaaagtcttttggtgtactaatccctgatcaggtatacttcagttatgactgcctgttggctatatatacaatatatgtctttcttctggatatttacttgtttgtattcaaagtcttttgtcatgtattccttgttcttaatctcataagagctcatactttctgctgtcaggggattgctctgagaggattattcatcattgccaaggagggtgtgattcagcattctaccattaccaaccttgctattggccgtagcgtggataagacgcttaggacccttcaggtagaatagcaagataataaaatggcatctgcaaacatgcatttcttttcaatatacatggcatcttggcagttttttcgtcttgaatttaccatagtctagtgtctataacatcaaaaattgctcaactagttataactgtgagtgacaaagtcagataggaaaattttttgcaaatatgcaagttcgtaatttgttttcctatggtgacaggccctacagtatgtccaagaaaacccggataaggtttgcccagctggatggaaacctggggagaagtcaatgaagcctgaccccaaggacagcaaggagtactttgcttctatttagacattttatttacattcatggtcaagttttgccatagcctttgttgggtcacacattgctcttatgatcgaaattgcagttatgtggacacattgactttctgcaaataaagttttgttgtgtttcattttggatttgttctgctcccatttaaaaaggaaaattcaaccattgaaaaataatcttatttgattctagtcaccttttttaagaaatgctagttaaggttttatgcaagaagttacttgaagctgtgtaatgtttaataaaatgttattggctcttttgtacctggaagcgtttcaatctaaatggcaagcacattgcttataaagtggaacaagaagtcctccattttgcccctttgaagaacggccaattttcccaccttagaaaggcttaaccaccttgcccattttgtgtctaacctttaactgtaattttaacctacttttttttcctttccaactgtaatggaatctttggcatgtggaatacatatgtctaatctatgttctaacttttcaaaataaacttttggctcaatgcgcaattgcttctttttacaggaagtcatgagaaaacaaagttaggtaaattaacaaaatggaaccccagcacagagtggacagcacagggctggaagcaatcatcttcaccggatttctgccgctccaaaccatctgaatatggtttaagagtactcctttcccctaactttatgaatgacttctttttttttcttaataataaacatgatattcctcctgttcttatctcaataagctgatcaatggcactgtggcacatatttaatctcatataaaaagaataaatcaagataatagtagcactagtactgcatatcctaagccacgcttataattacactggcagaaccacaagcactttttcttcaccttggaggcccctggagtggtagtgtagtgctcctgccgcagcttctgtgctgcacccattaccagtgcgccaggga

SEQ ID NO: 16378 - DNA, 3496 bp, Oryza sativa
  unsure (1)..(3496): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgtttcgatcgaccactagtgcatttcttgcttctcctaggccagctaggctaggctactaggcttgcatgggtgaggagtcgtcgccggcggcggcgccggcggtggaggtgctgtcctacttcgtgtgcccgatctcgctggagatcatgcgggacccggtgacgctgtcgacggggatcacctacgaccgggagagcatcgagcggtgggtgttcaccgacggccacggcgagtgcccggtgaccaagcagcggctggcgccggcggaccgggagcccacgcccaaccacacgctccgccgcctcatacaggggtggtgcgccgtccacgccgtcgagcgcttccccaccccgcgcccccccgtagacgccgcccgcgtcgccgccatcgtggacgccgcgcggccgctgctgcgccggcgtcgtcagcgggaggagctgatggcttcgctgagggagctcgccgacatcgttgccgagagcgaccgcaaccggcggtgcgtccagggcgcctccggcgcgtggagttcctcctgtccgtcgtcaaggagcgcgcctccgtggcgggcgtggacgacgcgacgtcggccaagccggaagagacgacgtgcggcggcgtgcatgatccggcgaaggcgagctcgccggaggaggcggccctgagcatcctgcattcgctcaagctctccgaggagagcttcaagagggtcttggagggcagcggcggtgaggatttcttggaaaccatggcgtgcgtgctgcggcgaccgagctacctctcgcggatgcagggaatccacctgctgaaatcggcgctcccggcgatggcccccgcgcggctgacgtcggcgagagccgcgctggtcgacggcgtggtgggggtggtggcggacaggccgtcggcgaaggcggtcaaggtggcgctccacgtgctctgccggctctgcccgtggggccggaaccgcgtcaaggcggtcgacgccggcgccgtgtcggcgctcgtgcgcctcctcctcgacgagggctgcggcggcggcggcggcgaccggcgcgcgtgcgagctcgccgccgtggcgatcgaccacatctgcggctgcgcggaggggcgcctggctctggtggcgcacccggcggggctcgcggcggtggcgtgcgcggcgacgcggctgcccgccgcggcgggcgccgagagcgccgtgcgcgcgctgcacgccgtggcgaggcactcggcgacgtcggcggtgctgcaggagatgctggccgtcggcgtggtggcgaggctgctcttcctggtgcaggtcggcgcctccggcgagcggacgagggcgagggcgagggagatgctcaagatgcacgccagggtgtggagggactcgccatgcttggcctcgcacttgaatgcttcctaccctcgctgagatcttcatcacatgcaagagattaatttctcttcgatcttggcttcttcatgatttgatatacagtgagtttaaggttcaattaaccttttattccttaggtcttctcctacgatttttggatgtaaattaagactattatttgttacaatcggccgaagggttttgacgtgtataacgactagtagctcgttctctgaaattattggagagaacaaaatcaatagaggcttgcaaaagcaagtgtacaatttggaaaacaacattagtttggatgatgattctgaaaagaaataagatcatttgccctcactgaaagatttgatacctgaaaggatcccaactcctaaaagtgagtagtatgatcttcaacttgtcaacagtttgtatgatgatccattttttatccattgctaaattttaccattttttcagtataatcaattttctaaccttagtttggccatggagattccctttgcttcaattcggaggaactaatcgtctacaatgaaatggctagagtaggataagcgtgaggtggaagggggaacaaggggatctttaggtttagagcaggtacaatagcaggctataagctagctataaatatattttaaagagataaaggaaaagagaagagcagcgggctacagatctgtagccagctgtagcacggactccaagacataacgagtgtatgacatgtgggatcgggtattaatagtatagtaagcaactattgtatagattagctatttacattggctctatatggtttagagctaatagttgactatactattaaacttgctcttagaagaaggccaaaagcgatataccgattgggccatggagctagactgtgcatggtatgtgtatatccacttgtatatatagaggtcgaattttatacattatctaagcaaaatgaaaggcggtatgtgttatatgggagaagggaattagaataggaaaggctgggggaaatggtcgaccgtggaagcaccagagatggcaatggagaggaggaacatgaagaggcatccattaatttctgtccaatggctgcaaaatctgatcttcaacgttgatctgttaaaaattatcagctgagtgccaataatctcataatcaattgcatactttagaatgatgaatccgcttcaaaatttcgatcgatagttctgcgaagaaaaaagttagatggtaggagatcatcaattggcaagtatgaccatctttaaagatcgcgagtgttcaagtcttttcaatttgcagtggaggtccccacatgaataaacatatcttgcccatggtttaattagggaagattccaaccggaaaatattcgagcgcttgcaaagcatttatattgcaattcacatgtgtccaatatgaagccacatattacatatactactaggtcaatagtataatccgaagccgaagaaacttggcgcataaaatagtacggaagcaggttgattggttggaaggcgatgagacttgtcacttgttgcatgtgtgcgccgctggtcgagggtgaccaggtctcgatcgtgcccctgcaggcccatgcatgtgtgaaattcagtatgttcagattagttggccggtagactgggagcttttggcatggatgcaggccaatgtgggcttcatgatcgtatccaagattccaagtactccctccgtcccataattatataatggattttgactttttcttactgtttgatcattcgtcttattaaaaaaacttttgaaattattctttattttatttatgacttacttcattatccaaagcactttaagcataactttttgttttttatatttgcacaatttttttaaataagatgagtggtcaaacaatacaagtaaaaaaaattagtagctagcatacgaagtatccaaggcagctggtgaaagtgaaacc

SEQ ID NO: 16379 - DNA, 6317 bp, Oryza sativa
atttttttcataactatttgggtgatatgcaaacaacgaggggatatcccctcgggggatgaaaatagtttcccaactcagcagctgcaaaatccaaaatatgaaagctccaagttcgatatataacttctagcgtcttcatattaattctcactagttgaatattcacaagccttttcagtgggatatgcttctcaaaacctttgtcgcctcaaacagtgaattcagcacacatgttcaaaatatagttatacccattatccaaaccgctgtgtagatgaaaatatatttgatcaccaccaccacaaatatataacagagctccatcttaacgaagctcataatatgccattgtccaaccgcaccaatgccatgatcctctaaagccaaagttaatactagaaacaaaaaaacccatcaaaacaaatgaaaggaaaatctaattagacgagcaatgagctagctaccctagctgataaacatggatccttcatgtacactagtgttacatttcatcctgccttctgaagagcagcacccggtcgaccgccgtgagcagacagacatcaccggagctgagctcatctgctgcttgatcgctctccatgtcaaggttcaaatcgaagcaagaagagggggcgcctgattcgatttctaatttgtgatcatgatcacttgtgttggcttcctctttctccaccttcatcttcttgttcatcagcggcgagccagctctagacctcgcctcgaagctctcgcagctcaggatgatgatggcgtcgcccacgccgacctcgtcgccggcctggctccggagaacccctctgtcgatggcctccttgacgcccacctgccagcgatggtcgccctgctcgacgtcctcgatgaggatgacgcggtgcgggttctccgagacggcgtcgtagagccgctcgaggtaggcctcgctcgccgacgacgtcgtcgtcgtccgcggccgcttgctccggtggtgatcctcggtggagcccgacgcggacggcgaggaggaggaggcgccgagcttgacggagaggaagctcttgcgtgacccgaagacgaggccggcgagctccctcgccaccctctccttgccgtgcccgtcgcctccgaggaagaagagccacgtctcctccttcgcctccgtcgacctcgacctgtcccgccgcttggcgatcccggacctgcactggaggacggcgctcgccacctccgggacgatctccttctgccacggcacctccttctccagcgcggcgcacaggagcttcaggttctcggcgttgagctccttgaacctggaacggcactccacctccaccgagccattggaggcgccggagcagtcgtcgtgcgacttggccttctcgtcgtcgtcgtcctcgcgcttgggcttccatgggtgcttggcgtcgaggtcggcgagaagccacgagtggtgaggctggtgctgctgctgctggtggccgtggccgtgctcgtaggaggagatggaggacgccggcgacaccggcgccgagaaatgcagcgtcatccgctgagacggcttgccgcagatggatccccatgtcttgccaagatccgcgaaatgtgtcgactcctatcacgagaagacaaaaaaaaaatcagcaatgattgaccgattaattaagataaaaagattagcattcgatcgagtggcacctgcagctgctggtcgcggcaatgctggagccaagaagggaggctcgacgacgacacgaaggagcggggcaacgacgccttggtgtcgtgctcgtgcgtcgtcgtcgcggcggagcagtcgccgccgcagcatctggagaggaggtggctgccgcccaaaagcggcccgcaagacggcgccgggcggttcccatcggtggtgtgagggctcgctttcatggactgattgactgcgcccagcgcgctgcagaaagaataacaaaacggaaattagattcctgcacacactgtcacctcaccgatcgacatgtctccacaagatcagctaaactgatcatctttgtcagccgctgtacctctgaaattgtattgtcgatatatcatgctctcgtgaatgttcaaataatgcgatattagaaaaagagaatgtgaagctgatgaggagctatagattgacctaaagcttttgcccagaaagcacgcaaaagatgcaaaagctttcacccgcatggtactgaactactgatgcttactgattgctcagtaacgaaggggtcagatcacagagaccagaggcatttcgtttctgcaaggccggcgcgggtgcatgattcgttcacctgacgtgacacgctgcgccgcgagaacttaacaaactttttttagatcgatcggatgattttttacctgtcgtcgaaggcgcaggtgaggctcagcgcgaggctgccggcggggacggcgagcgtctggagcccccacatgctctccagcgacggatgccccgccctgcacttcatgtacgtctggtacgtcccgaacccgacgagccagatgccgccgtcgcacgacgccagggcgcgcacctcggtgacgacgtgctcgacagagcagtagtagccgccgccgccgccgctgccgaccctcctggcgccggcgtgcgcggcggcccagaagtcggccgcccacttgaggtcctcgacgacgaggagcacccgcgcgccgcggctcttcacgaggcaccggagctcggcgagccgccgctccgcctcctccctcggcatgtcgcggaacgacgacacgcggaggctgaccacctgcgcgccacgcagcgcgtcgtgctgcttcgcctcccctctcctgaccctgtccacggcggcgcgcgccgtggcctccgcggcggccgtgctctcggcgacgacgacgaccctcctcctgctgccgccgccgccccggccgccagccgctgccggggcaaggcagtcgagcaccgcggcgatgtcctcgtcgcgcgccagcatgtcgagcagtggcagtttggctttgatctccggaggatgagccgggctggtggtggcggtggcggtggctgcggcgccggtgcagctagggttagggttttggttcggtggcgcgctggtggccgtggtggtgctgcacgcctgctccacgttggccttgacctgggtgctggagaagccggcctcccgcatgacgcggctgacgctggggtcgtcgaggatggagacgacgagctgctccagctcgatcttcacggcgagcaccggctgctgctgggtctccacggacccgcgccgctggtgcgcctgcgcccgcttgaacgccgcgacgagcgcgttggagagcgacggcgggtagtagtggccgtggtggccgtgcccgtggccgccgagcagcggcgacgaggcgacggcggcggaggccgggaggcggttgagcgccacgttgaagcagagctccagggccttgcactgcagcgggtgggagtgcgaccggaggcacgccgcgcggaggagcccccccggcggcgccagcatcgcgctcgccacgtgcagcggcgtcacctgcgcgttgcccctccgccgcgcaagggtcaccgcctgcttcaccacggcggccgcctccgccgtcagcgcctgctgcaccgtgcaccccccggccctcatttttcacacgtacaccacaccacctagctagctacgtatactacaagaacctagctaatctagtaatctatcgatttgatgtggcaacggtagtgtgtgaggagaagaaaaaggagaaggaatgagatgtgcagatatagaagggggacggaggtcactgctgcttcagctgcaacctgcaagtggtgggaggatgcagtgctgctttatatgttggtgaatgttcatcttttgagtagctagagggggggtgagaaggtacagaggttgaaggaaggaggagattatggtgtgtggatttgtgcttttcttgttagggagggctgcatagttgttttttctttctctttgggctataatttttagggtccaaagtggattttgtggtgggaaagaaaaagttggctaggtagaatgcatgtgctgacaaagcagatacaaaggccccccagctttcccctctatctctctcaagtctcaagtttcaagcaaggcgttctcacattctcatgcagagggtagctagctaggagatcatatggattgtgcacagtatctttgtgactagtcttctgtatatgatcagctgcctctaaagaatgacctgagctaaattctatgcgttcctgcatcaaagtgcgcaaagccgggcgaccataaaatttagaacctgatctagaaggatttggtgaaatgacaagtgtgcattggtcattggagcagacaaggtgccttagtaatgatatttttcaagaataattgttccatgtaacaaagtaagcgcagtaaagtgtgaatataaggtaaacataatgtcataacccctgaaatttttttcattatttcagagggtctccattttctcagggaaaaatatcatgacatgcagcacaattaactcacaaccatgtttggtgagttgtcactataatatatagttgtggaatcttcctttctaatctttatgcaactagatagtaaaatggcaaattgaagaatccatatatactttgggatactatatttagtaataagagacaaacctttgctgcaactcttacctgatagaatttatgccttccctacctctccatggctccatgcatgtcaccatatgtaaacaccaatacatctcccaccaaacctattagtgcaaaaataaaacaaaacgaaaggaacgatccatagcaaaactacaagtaacagcttttgccacttatcttttgcaggttatttctccttttctcatacattgttcaggtgggacaggttacctatctcagtgtattctcttcccttacccatcagtataatatctaaatttatacttcataccacaacttcattattccccgattggacatatgtgacaagtggtattcatgataaaatgataaggatacatgcacaagaaattcatgagaaaatgatgagaatgaaagaaacaatggtatgggataattgttggtaaaccgaattattggcgtaggtatctagatgagaactaaatttaccccaagcaacataatgaattgagtacatatgtacagttttgttctatcacacatgtacatatatagaagcacgtctgtctaggacccatgcatctaactaaacagccactagctgaaaatacatcaaattgaaaagatgcatataatgtagcacaggtatagtacgtccgcatagcctttgttttaagagagggcaatcaatatattcatcatgaagggagtacatacatacttttatacctgttcactgctcgtcgtatactgatacgattgatcacattactaacagggaaatggggctgatgttgcaatgatgacgatacaacatatgatgctttatgtgatcgatacgatctgatgtggcctgcagtgacctctcatcttttaagagggcccatttaaattggttttcttttctgagagagagagatctttgtgccctaaaagaatcgggaactgtgtacggcccctttctctctagactcaaagtatatggaataaagcgtccccttattgcccatatgctctctgtagactgtatgtgtgtatgcatggaaagattagaatcgctcacaattactaggagcagtaatgcataaaacagccacatgctgttcagcaaagccggggcttttcagcattcttgttccctaaaaagcagactacattactagacacaaaaattgaaacattcactaattaagtttaggcaactgctgaaggttcagtgccaatgtgccgaatctacgagtgaacagaacaaatgtttactactaatatatggcaaagatagcactgatcaagatcaacatgaatatatttgcatcattattaattgcatgattattgacatatataagcgccgctcaaatattctgttgtactgcagtgttactacaagcagaattaactgtcaggcaaaagccaaagtatgtagttaaaagcacgtttacagcatcattgaccggtcattactgcgtgcatttgcatcaaaagtcgtgcaagaacatagttctttatggggatacgaacagggaaaaggggtcgattaaacagccagcaaaaacaaagtatcaaaaatgacttccccctcaagccttcccaacagatccccattcatttctcaatcatcttgtac

SEQ ID NO: 16380 - DNA, 10376 bp, Oryza sativa
ttcttaatcccatgttagttctacttttagatgttgccatctattattctttttcgtagtgtcataattaagcttttcttttatgtccttggtgctcatccagtatgaagtatataaatatgagaaaccattgacattaaaactattaaaaggaaccaagtctacatgtctttgagaaactaatgacatttttgttatctataatctgagacatttagggattaaaaaccatattaagacaatttgtaagctgggtgcgacttcttaccacaaaatgaaattgcctgttcaattttttttatcacagataggataggcaaaaacaaaaggcacacaaaaagaatttaaactccaggacttaactttcattaaattcgtttatgtcagaaaaaaggaaacatcatacacgcatactgccattaatacacctaacctatttgggtaacaaaaatggatgtagtatttacaagcaaagagtctaaacaaaattaattccatacagaccctaaaaggacactgcagaagtacaggatctagtcagtgtgtgaactgcataacacttaataggcacatacctaatgagaacatccttcaactatatatatattagtttaataaaagcgtcttgacatcaccagccatatacagggtgttgaacttggggaggcaataaattcaaatccatgcattgctgtttatcatagtcacgtgtaccgggaattgctcctgtcgccaatctgaggatctcattgccagttaagcagtgatgagcaaaggccagtcccccatccacaacttctgaaagtctaggaagtaaaggtatctttctcactttacttctcttcccatcttgtccagaataaccaattttgttattcagaactttgtcaagctctgagtactccatgaatctttcagttgctgcctcccatgacaaactgtacctttgctcaggggtcaaaggtgaaggttcactagccatggcctctttcactcgggcaacaaattcttcggaagttttgtatgttaagcagttggggaatgacttgaaaaattcgtttgatggatgatctgcacagataacaaatttccccattgcaagagcctcagctgtcgctgtgcatagaacatcactgacacttggattaatgaaaaccttatacctaaaattaagaaaagaaaaaaggccattgtcaataaatagtaaatgataagccagagaatgagggttcattttagcagcttgctaaaatgatactcacccatgaagcgaagaatctgcatggtcccttcctttgaaaaaattgaggctcaaattcaatttcctagcagccatctgcactgcttgtgagtcctcaccattcccatatacatctacattaaagccctccaagtcacttttgtgtttggataacaaatctataagttctctatatcctttagcccaaaccatcttcccaaggaaatatgctccctttgtaaagctctgctgcccatgctccttatcagctgctattttttcaccaaccttgaggaactttggatttacaccatgaacgttgcagacaacagacctaggtagatcttgagttgctgcaaaaagacgtaaaacctgcatgcacccattataagtttcaccctagcaatcagggcttttacacgagacaagcaaacacaataccttatgacagtatgctctagtcacccagttgttgatatgcttaacaaggaaagcttgaagagctccattcttctctctcttgatatactctaggtaatttgtgtgaactacaccaatgacatgtttaaacttgtcggtccaacgctttccatgatgataccagttgagatgctctggttcttccaaaattgctatatcagcttcactcgaggaaatgaattgtgaagtatctccagcaggaataatactacgtcgctccttcgaaaactgtatagcatgaaattttaaataaagaaattaaatcattggggaagaataatgtatggttgaatacatcaaaatcagatgataattggatttttaccttgccaggataaaatgatatcttaaaatttgcttcaaagccaagtctttcctgtagccagttccttatgtaattttcttgttcttctggtgaactgaaggtgatattattggggtaaactagctcttgatctgacttacagagccaaggaaccaccagtgtcaccttctgttttgtacttcttgctagatacccagcacggaataatggattgattgctgtcccagtcatccatggaagacttgctgttgtgacaattgcaacatgccgccggttgtccgaaagcttgtactttgcatgatccttccaaaaactttcctctgtgtgatgcccagtactttctagcacccttgctattctcagatcaagctcatcagtcatgttctcatttccaattaaagatctatcagctgaaagagaatgataaatgagccggccattgtgtttactgtacaatgtctccacaattttgtcacataaatctgcataatatagaaagatttaacgatggtcagcaccaaagtgacaagagttgggaaagtgcaggcaaataaaacacgccgtacctcttctaataccaagttggtccagaaatggtccagattgccgcacaagatatgccagaatttcagtaagatccagtgggagaacctcctggattgtatgcaaatattcagtttagaaaacacgcactctgtgaaattaataagatgacataacaatgaagattgcattatcattataatcaactgctttcggaaaaatgctttattaaaagatatgatttagttatactcaataatgcagtgtctaagaatcttaaaacttggacttaaagaaattcaaccgccatataactcaagtagtcattgttacaatttcagtatttcactatgccattacaaagcgataagcatctaattctgacctacaactggctataacgaaaaatgttctgaaacaactgaaagtttaaaggttaatctaatatgttgcattttgcaaaatagtagagcataaatgttctgagaatctagctggactgaactaggcagcgaaaaaataaaatcaagtaaaccaaattcaagttaattaggaaagtgatccagaagcatttcttcatctgaagttactaactatttgccctaaatagcagaagatttccaacagttatgcttagtttgttctgacattaccttggattcttgtgactctttgttcagagatttctgcaacaaaatgagaaacatgaatcagtgctccacttaacacacaaaaattgatgatcatataatacacttagtgttctcaaaagcataattctgcaaaaaatgcatcaggccgtcagttgtcacctgatgtaaatgatatggctttatgagcaactggaattgctactttttggcagtccttaaaagtactttatttcagggaagcatttcaatatttttaaatgatggattagtcatatagagttagacaaaatattaaacaatatatgaacaaaaatggagcaatgccatgttacttattttttgcaaatacacaatccttctatttgatgaagcattggaacatgtatcaatcaatatgtaactcccttagattccttttcatggatgccaaagttctactaatgtgtaagactcaattgctccattcatttatcagtaacttacagaaaatgtacctaagcaagtggaaaggtttatcgtcctaaccaagtaggagcatatcatgatttaagatggaactttcgaattaccaagctcaacttgaatttctccacgaactcgccgcggccacgaaatccaccaaacacctcactcgacaagctccggcgctcgaactccttcagcccgctgcgtatcatcctcaccacctcccactccttcctcccctcgtcgtccgcgtggcccttccaccgcacgagcccccacctcccgccgccgccgccgccgccgcccccctcggccacaatggcgttgcggatcgccgtaatccccgagaggtcgacgcggaggctggccccggcggccttgggggcccaccccgcgtcgcgcaccgtcgacgagtactgcctccgcagctccatgatcttgggctggatccgcttccgcacgaactccacctccgcgatgggcgcccccgccgcgaccggcggcagcggcgggcccgcgagcgccgacgccgacgcgaggaggtgctccagctcccggtcggcgcgcgcccgcatctgcctcaggtcggcactcgccgagtcccgcacctcgcgccaccccttggagatgaacgcgaaggcgccgccgccgctgatcggcggcggcctctctccgcccatgacctggttggctagggtttgaattctagagacgcgtagaggaggcgagtggaggcgggagatggtggtggggaagaggaagacgaggacgacgacgacgacgacggtgtgagaggcttggggggaaagagaaggtgggaagcgtgtgatactgacaggtgggaccgaggtgtcagaggagtgggatgctgccacgtgggatgtggtccctgtcaatcttgacctgtggtgggggtggtgacttggcacggggcggtttgaactttgaaatgatgtggggcccgcgtatccgagtgggaatatgcttgcgtggatgcccagtggacgtacggcctagcttcgcggttcgccgcttgtgcttttgcagtttgcgtctgcagatggttctggatttaacgagtacgagtacccttcttcttcacacatttgacaggaagtgaccttttttttctttttcccattacacgcgcgtacacgtatatgcaacactatactcacacatccacaaatgtttttacaaaatacaatggcacgcttatacaccactatacgcgtgacactaaacttacatactaatggttgtatcttctaacacacgattaaagagacataagccaacgacgtatctatctcggtgggccccacttccttcagttcagtactcaccctctttgctttcaattgcttctgattctcgtccagtcggtaactagcgggagaggagttgcgcggcggtcggccgccagtagaaaaggatttgggtggtggcggcatcacgagcttgagcggtcacctacccgcacgatgccataggtcatgcaacatccagtcttaggcaagtatgtttttttcgagaataatacaagaccgggtgggagggccgaccttcactgagaaaggggtgaaaaaggaatacgtgtcgatgtcttagtgaaggcgaggacggcttcgtgcaaccctggttggcgacaataagagggagaaggcgttcaagaatggcgtgtaagagcgtgttcctgcagaacgaggaggaagaagatggtcgccgagaatgaagaggcgttcatgaccaagtaaggaggtttagcagcaaatggcaccaaatgtggttcgggaggttggaagagaaccaggtggaagtagcgtggtaggctaatgaagcgcttgtggcacccccccgccgccataggtttgaacgacctgtgtcgggctgagaaggaatgaaatggagcggccaaagttggggagagtccttcttcccacaccatgcatccgacctcgtcttcgttgatgacggcaatggccacctcccccacctccgtgagcttcgctcgtctctctcctctaccggcggtggcgcctcatccctagccgtcgtcgtgccagtgtaccagttcatggcgtcggcgatgtaactccagcaagcgatatggtggacaggcaacaaaagaggtgtggagatgagagaggagaaggacttttcacatatttggtgacttggcggtgggatccatgcggccgtggaggaggaggcgacggggagattcgaggggaagaaaggggacccatcccccacgctccttagcgacgacgccgtgctcgaaccataagagagatagaggaggaagggagagaagatgagaaacatatgggtgatgacgtgggtccaactataattttttatttttaaccggtcagttactgacatgtgagtcctatggtttcttttaacttgaagtgtcacgtcaacaccactcgtagatgccacgcagccgaaaccaccatccaaactactttagaaccttctttgcactgattttggaagtcgagggatacatcatattagtattgttatacagtaatgaatttaaaacttggcgacaaattaagggacataagtgaacttattacaatcccagaagctcggctgtgaacgggctgcgggccggccaaaccggccgctagtccagcgtgagtcggcccaataacacatgggcttcgctcgggtatctgagttacggcccaatagcacctcaacgccaaggttacggcccaattaagttgcgtaggactcctgtacaggaaccatgggctttcttaaactgtccctttattcataactgtcactaaaaatctaaaaaaaaaagacccccacttttactattttttccatcgaatgatccgcgcagattgcgcagttagtatcattatatttttctcatataatagcatatatatatacatatatatatatatacatatatatatatatattcccaatttattattaaaaatattaaaatgacaacataatttcaaattttgtactaaatttaccaaactaccaatgtgatagtcattaattatttttaatatcaaattttagttatttctaaattgtattcctatatggactctagacttgtttttcaatattcattattttttaatttcaaatcttcgttatttgtaaaatttatttctatatagactctaggcacttcttctaatattatttatttttaattttgaatttttattatttctaattgtatttctatgtggactctaaactcatctttcaatgttttttatttttttatttcgaattttagttccttctagattgtattcgtatatagactctaggctattcttcccatatttttttaattttgaattttagttatttgtaaattatatttttatatggaatctaaactctacttttaatttttattatttttattcctgattttagttaattctaaattcctatagggactctatatcttcttataatattcctttttttaattctaaatttctattatttattaattatatttctatatggactctacacttttcttctaatattatttatttttaattctgaatttcagttatttttcttaattgtgtttctatatggaccttatactttttgtcgacgtttgatgtcgcgattccggtatttgcatagtatggggatcgttggtactagtatatgcgcgagactgaggtaaaagagatagagacgaggatttttatacaggttcgggcccctgaattgttaggtaataaccctatatcctgttggccgaagccggtattgctcttattcaccataatcacaccagtacaatatttggggtagtctatctaactgttgtcgacttggcggtatgaaagtctactcgtagtcaacaacagggtagtcttcctcctcgaatccgtgcccggcgagatcagagatagcgctttcgtctctcctgacagtatccggagacaccgtaggggactagccgtgcttatccatgaagtcgatatccagcattttttcttggcgtatgttgtcttgtggcttctgttgttccgtctatgttgagtgtgtcccctctcctcctagggggccttgtatttatacccataggtgtctccttgtccaagtagaactagggaaaccattatggatacaatccgagtagtccttgtcgtttccatgtagaactctggttgtatttccttatccgaaactcctcctatatccacatgttgtttccgtataagacatggtatgtggtgggtcctgccgagatttagtcgactactattaggtatgtggtatccataacgctgacacttttctgctaatattatttattttttaactcaaaatttcagttatttctaaattgtatttctatatgaactctgtactctatattattttaattccgaattttagttattccaaattttatttctatattaattctaaacaaattttagttttcttatttaattctgaatttccattagttctaaattgtataacaacatgggctctggtctcctcttccaatatctcttattttttaattctgaatttcaactattcatagattatatttctatatagactctgttttttttctctgattaatatgagaatttctaggccgtgagagcgaacgtgaaggctattttttctatttctttaataagttataatagaatttgaaactttctaggacatgtttcgaccaaaatagagtaaccgatcatctcacgtcacagaagtccaccgcgacagacgctcctcacttatatactaatacagcatttctcacttcagttactagcactacttggaacgattagttatagcacatatgggacccaaccctaccttttcccgagcaaaatagcggagaaaaacagggacacgtcaataattctccttaggtatatagtactactactactttacacaccaaccgtgaatgcatgcgtgcttcacttgcctccaatttgctactgctaccggatgcaccaaacggaacaaagaagatcggatggtaggtgacatgtccaagaacgggcaggatggtgcacttgcctccattttttctgatataagcacagcagggtattaggtcgaccgtcttctagctaagctctgtacttcgaagtcccaatggtccctggccgtatgtactacttacatcctgtatgcttgtatttttgcatggtgcctgcatctgtggatctgttctgcaatgtgtgcgtgtgaattattgtgtgccgaacccgttgcaaaattgctaatagaaacaaagtttttttatatgacctggcaattgctatatctgaagtgtctgattgattactctagagtgatttgggtgcatgtgtgcatcactagttccaaaccttagtaggttcgacgtgtctgcgtagaacagtcatatttttcattttacttccaggctaagtttgtgtgaataaccatcctttttgcagcccccttttagagtctctttccccatcctttatggaagagatgaaagtaaattaccctcacttcttttgcaatgcgcatgtttaactattgagattgattacatgctaaattccccccttttttgtcaaaagagacgacctcgatcgcactatgctagccatcctgactcagaacactacatggaaatggatcaaatgacacaaaagctcttcaagcccttccacaacttttctcgtcggcgctttttatccgaaagcctgatttgaatatactgtaagacagcgatcctgctactctgctacataaaagcaaatattccacaaatttatccaacagcaacagaaagaaaaatgtctacagttttttttccggtctagtagtattcattttttttagaataatggatagaaatggtatatagtagtatgcatatccggtgtatgatgattgatgaccagatcaagccactgtatgtattggaaaaaaaagcttcttttttgggcgaggcagtggcgtgtgcaagatcgttctggacgctgataattcacgggaggaggcaaatgatcgttgatgattagttaaaaaacagggtcgtagcaggtagcatggtgcttctggaacagatgctgccatagggcacagggcaccgcagtcggtggaggagggggataaggaatgaagggcaccggcacgatgccggatggacgcacacgcctctgcacgcggcgggcgcgtcatgcgcgcgtccgcttgtgcagctgatctgctgatgatggctgccatattttctttattttgggtggggttttctttggccctgttcgcctgaggcgacgccggaacggccggcctgcctctcgcgtgctacgctccaccaaccggcgtactatctcgcgtgcgtgaggcgatcgatcgatggacggcgcggcgcacgggcgatgtgatgtagtggccgtgcaccgatcgacgctctcctcggccctcgggtgatggtcgcggaggccgccgttcgaagccgctcagatcgacatgggtgagatcgcgcgcgtaatccctagccagattggcagtttggcccgtctccggcgccagccacgcgcgcgcgcgccaccgaccacgccatgtgtatggagtgccattgatgattgatcgcccgcacacgtacacgtaacgctgctga

SEQ ID NO: 16381 - DNA, 3220 bp, Oryza sativa
ctatatatgtgggtggtggagtatttcatggggtctcacttgggtaaaaagaactttgatatataaaatgataagatagagttggagaatgcttctaatcaaccgtccgggcggaaggaaaaaatcgaacgcttcttaggctaagagaacagtagggatatgggtgtaggtgcatgcaatcagatttaggaaagatgtccatattgattgaaaattcaaatgttttttctctctgactatttatccaaactacgaataaattttatcatttgattcgctacaactaaatcttcgtaacacgatctcacatcactctgtgctgatgactttttttaacgtctttttttgtgttgcactcagtgttattgtgatgtttcaacaaatattggttcatatttcacatagttatttgcaatgttgtacgtggtgtttttctatgttctagcaagatctcatatgattatattttagataaaaaaaagtttttatatacacgcgcgcgcgcacacacactgtgtgtgtgcagtgtgtgtgcgcgtgcgtgcgtgtatttaagcaggtgcaattggatgtttcacgtgtaagaaaaaaacatttcaaatgaaatttcactttgtaactaattttaagttttttcttgcaacattttactcatagtatcaatgttttttgaaagaggctcatagcattatttagatgtttcaatagatattttctggtgtttcactaattctttataactgttgcacacaatatacttgttgaaacattcaaatacaacatgggaaacattcgcaaattaagtaatgaaatttcattacctatttattggtttcgcggggaaccataaaaccacctctattttaataaaaaccataattaccccaccatagtcaaatcttaccggaaatatttacttcttacacgtgaaacattaaattttaatgattgaaacatatatcatttttcaattatgatataatcgtgcgagattttgttgtaaaaatttaattatagcgaatacaacgatataatcagaatgacaaatggataaatggtttggaaaataaatcatctcaaaggttactagtatcgtattaatcaatgcaagcacatcatatagtatcatcacgtagcaattatgtgattagcttgttgatgtagtacactggtagcgtccaatattttgcattatgtgattagcttgctgatgtagtacattggtagcatcccatattttacattgcatgggatgtctgggcggtagtctcctctaaagttaggtggtatattggtttcacgccttctcaaattttggtactccctccgtttcaaaatatttgacactgttgacttttcagtacgtgtttgaccattcgtcttatttaaattttaagtaattatttattcttttcatatcatttgattcattgttaaatatactttcatgtacacatatagttttacatatttcacaaacttttttgaataagacgaccggtcaaccatgtgttaaaaagtcaacggtgtcaaacattttgaaatggagggagtataattttacgatgagtcaaaagttttatagcaacaaaactaaatactctctccttcctaaattgagcatcatatatgtttatgcaccaagactaagaataatttcaatcacatcaatcatgacaccatgcacatattctcccacaattaatacatcgattaaaacgccatgccaattactccctctgtcccaaaaaactaacttctagagtttgaattttgtcccataaaaaaacaacttctaccatactacctaccctcagcacgtaaaatgagaagttttatcccttcaataccctttaactacatatcactcttactacttttttcaataatgaagggcattttagttattctccatatccactaatttcacctcgggatgctaggaatgtatttttttttgggacggagggagtataccttagcatgcgtacattctcccatactgtattaattatattctgatgaaatctatgtccacgcggttatatgatgataaatttgagaaattttaaatttcattatatgatgatcaatttgggaagagggagtaataagattggatcgggaccagtgtgtttggtttgtcagtggatccaccaaatttaataaagtggtgggctgtattggctctaccgtctaccacgaggccactggtaccacatccatggaccatcatgcatgggccatgaaaatctatggcccattttcccccgcgcttctccgttcttcggcccacataaacacactggcggcccgcgcgcacggcgcaccgcgagccctcgcaaagcaaagcatggcctcgctcgctcgctcgcccgcgcctccagcgattgtcgtcgagacgtctcgccgtctcgcgatgaagcgaaaggctttttgtccgctgcgcggctgcgcgcgggcgtcggtttcagccgcggtgtcgccgcgcgcgccgcggccggccggtgtgtcggtgcgcggccggatttttccggctcataaaaccccggggttggctatcagctacgtcgtcgtcgccgaggcgatgattgatgtcgggtgtcacgattgatcagcctcagctatagttctcccatcgactctgcagtgtcatcactcgtcagctctcctctcctcctgcccgtttgatgtaagtgtaagtacgtactcggggacgaccgtgacgcgctgccgaatgccactcccaactcccgctagctaggtacgttggtgggtcactctccatccgccctagcgcacttcatttcatttcatttcctctgccttctcttcgctttcgttggatcatctcgtctgtactatactgtacggcgtgagaaaattgcccacgtacgtacctgtatctcatgaagactcttgctctcgtaatttatggtactcgcacaaagtttgaatgaacggcatgtgtctccgttgaaacgcgaacaggtacgctagtgtcgttgtggggatggaaggcaggcagggcaaatactctgtttttttatacattgttgattcttcaaaaggcatgcaaaaacgatcgatcgactgtattgtaaagctttgatgcataaatgttgtttcgacaatgacaaatgatactaagcggatgtatacatataaaagtggccttttattctgcacagattcagaattggggggggggggggagggg

SEQ ID NO: 16382 - DNA, 1014 bp, Oryza sativa
tcgtcacctacacgcacacacagaagcaaacgatttttcagtccccccaagaacaagaacaaactgtacaatttttagccagaatttgattaacctggaggttgagggagatggcagggtcggagaggtcgatgttgcgaagctggacgtcctggaggtagaaaaaaggcttggaggggtgaatcgcgaggtagatgacgagcacgatgaagccgacgaggacggcgagcgtgaggatgcaggcggcgatggagccgcagcaccgccggaggatccagtcgcggtggtgcttgtccttgcccatctcgccggcggccgggccagaaacccaactagctaataatcaactgtgtacagtgcgttgtagtggagcgtgagcgtgagtgtgtgtgtgatactgaggactgtgtgcgtgtgagtagaaggaaagtgtgctgcgaggagtgggggtggccttttattaaaaggtcctaactcctaagcttgataggaggacaggtaagtgtggtggtgcgtgtttcaaaggggattttaatttcttttgggtgtagggaggtgacgaaagctacagctcaactcaccgagattcttctgcttcttctttcccctggacccccttgcactgttgcacaggaggctgccctgtgtattagtgtaccactagtaattaagtacataactccatcaacttagcttaaattgagattggtttgtcgagcacacatgagccaggcagactggtgtccctctggagctctgctgcttgaggatcactccatctccagatggtcaacaggagatgattaccattgcggttggtgttttgcatgtgcacgttgaggctgagttgacctgcggctatggtacccacaacccagtagtagtgcccaccattttacccctgtccactgaactaatattaatctccttcatgtacgcagtacattctcctacactagtattactgatcaggataggatatccagatgataaacgattcacaacatatataac

SEQ ID NO: 16383 - DNA, 6437 bp, Oryza sativa
  unsure (1)..(6437): unsure at all n locations
acactccacaaggcttttgtggccacatatatgagtttattgatgtacttgcatatatataggctgtttattgatctcatgtagtattggatatacaattttgtaatttaaagataattattttttacatgccatgtaaatctatgttacatttatttgcatttgtcacaatgcgtggacactatgcaatttgtcctacttaaaaacaggggttgggggtgattatagcaggctttatgctcatcttctgtgttcatctatgtatagaggtgtatgccatctgtaggatgttttaaaataactgcaccgtatacgtatacatacgtagatagctggttggtatggttttatttagttttggatttgaatatgtgacgtgtatgaatctgaaaactgtatgagctcacgggcctgtgctgtaatatttggcaaaaatgattaaagaaaggacagtcttattttactagataaatatcaccattaaaatatgtttgttatatcaatatcacattttttctgcttcaatagtttctgaaaaaaaatctgttactttaccatcacaaattttgaaatgatctgaatggatattgtgaaaccataattgtcgtccagttattttctttggcgcagcaacacatagggagcggttcactcattccccaaaaataagaagaaaactgttcatttatatttagctgcttataagtagtctttgttgtacggaaggctgcaacgttttatttttacagttcagcatcataattacttctagcatcgaagaattagtcacttgctaatacttctacacaataaaattgcaggccgtactagtttgtcccatttggtgttgatgctctcgacgtaatcagtttgtccactcatgaaggtgatagccccttctttctgagatttttcagggactttgaagcaagcaagtcgtgccaagttatcgacagaatctgcaaatttctttacttgtgtaaccaagtctgaaagaagtgatgcagtaactgccacatgcatcacttgcagcagagctttatcctctgatagctcgctcctgagtgttttggcagctttgatggctgcagacatggaggttgtagaaggtactgtcatttgtcgaagtgctgccgagagctctttgagtgcctgagcagagtgtgagctcatctcactgcatgctgttcgtactttgaaggacagctcaggagtggcttcaggatactgtcatcagggaaaggtacgagctattggtcaataaactgggttgcagtgtctagatcatgaaaattattatgatttgtaggttgtaagtacctgagattttgtgagtgtgatgacataggaagccatagccttcatggaagaagcgcactggccagaaaaaacttccaacttctgggattggcttccttgggtgttggaacttgatttttccttgaccggcttccattttggcaaagttgcactgcagttttggaaataatgtcccattgcttcattttcaccaccttgcttgaagaatgtctgtaggacttcccctctcggcacggggtatgtatatatataactgcatagtatgcttaccagagagtcttcagtggccttcgaattaagtatgctcttgtacgcttggagaaaggctntgccctccaaactctcactcgtagcgctttctccaaagcattcggtttccattcctgcattcatgtataaaagtttaggccccactctggaattaatctgcctgtagcatattacttctatagctctatgtgagtaacaagtttactattagtaatttaatacatgatatagttgtaattctgccttcagttgtattgtgcacaagcagggcatagttaattagaaacataagtgaaaccagaataacatgaaagggcacactattcttctgtgacatatcggccacaagctgccatttcagcttgcagcagtgcgtacgcaccttcaaggaagtcggccagcttgtcgaggttgccggcggcgagcttgtggaggtcctcgccggcccagacgggcatgacgaagatggtggtgcagaggcaggtggcgacgccgacgacgatggtggagaagcgctggtgcgcgagctggatgagctcctctacccggtagctcgacacggccaccaggctgaaggtcaggatgaagatggtcaccccgtagtcgtacctcgcctttatctccggtatgaaccgcgagaacgtcgccgccgacgctgccatcaacaaattaacatgaatgccactggtaagtacatgctactagctacctactgcttctctcctcgtctaaaaaagttagtgcatgacaacatatgaactattatagccatcgtttcgccggtatatttataaaagaaaagtaatttatgaataaaacttttatataagtatttttggtgatctaagagcaaatgctgaaaaataaactacaatgaaaaaactttaaaatcagtacaaatttaatgttgaaaatttaaattttagctgataagtataaacataaacgaaaagataagaccctaaacattgaatagtcaatgaagaacaacaaacacacatgcatgcatgcatacacacatacctagtaggaagacgaagacggcgaggagtatgggctctccctgtgcgccgcaccggttagccacctgatgcgccccgacggcgatgaacccagccaccaccgtcgcgaaggccctgttcaaccctttgctcagcgtgccacctgtcgcgtacgtacgtacgtacgtccaaaacacaaacacgtcactgagatatgtactaatagcgtatgcgtacgtagttacgtacgtagagcgtggtaggtaccaaggatatatagctagcgtatatatatcgtcgcctagctacgacgatacgtacgcccgcgtgtatacatatacgtatcgtcatctgcggcaacgacgactttctggggatggaattttgtccctcaacctcatttatccaaagctactatttttttttattttgacaaatagattgatatagtatatattacttcacaaacatataagattaaattcgatttctacaaattataaaagtaaattaaactctaatcagtatacatacatttgtaattctttttttacaatttgtataaatcaaatttaagcgtgtttataacttatgtatcatatactaaggatcaacttatcacattttctcaagaatgttttgtaactattcaagtgatgatgatcagtaagaaactcaatgagtaagaaactcaataaggccttgctcggtttagagaggattgaagggaattagagaggattgaggggaataattccacaccatcataggtgtagaataaatctccttcaactcctccctcaaagggattaaccgaataaggcctcaacgagaatactttcccccgtgagaccccgacgtacttggcatgcattagcgctagctagcttggtacacagagaaaattacataccgacggtgtactccatgacgacgacgacggtgagcacggcccagagcgtggagaccccgaaccccttgaaaagcggcgtcacgtagtagagcacggacaccagcgtcagcgccagcccgaccttgagcgagtgcgccaccctcctcgggtcgtccgccgcgatcccgcccaccttcctcgccagcccgcccacccacctcccggccacctccaccgccgctcgcacccgcgcccagcatccatccacccaccccccgccgacgacgacgaccacttggccgccgttctccgccgccgccgccgccgccggcgtcgtctccacggcagcagattgcatgatcgccttgaagtacgatgataagtatcgatcgagctagctatagctagtgatcgatgtagctaattagtatatatagctagcgccgcgtacgtacgtctttgagctgggggcttgatagatggagtagatagctacaagtgaagcacgggagacgatggctgggtgcaggggagaggggacgcttatatagacgtgctcgcgcgctccggtgcagagaacgcgcgggccagctgcatacatgcatgagcgcgcgcggcgcctttttgcagacaggatcaacaactttttcggagaatgacttgggatattgttgttgttgctgctgtttcattttattttactccatccgtttcagtttacatgacgttttgactttggtcaaagtcaatctattttaagtttgacgaactttatagaaaaaagtagtaatatctacaacatcaccatagttttattaaatctataattgaataaattttcataatatatttgtcttggttaaaaatattactacttttctctacaaaattatttaaatttagagtagtttaattttaaccaaagttaaaacgtcttataacctaaaacggagggagtatttattatcgagaactgagatatatattgtgctacgtttgttgtttctcgtttcgactcgtcttcgtttagttgctctcgttgtcgttgatatgccatcggtattgccagctcatgatcatgtcactggtccgaggaaatgtgaagtactcctactagactattttggccgggttaagtttaattagccttgtatcactgggtacaaatcaacaattgttggtttgttttatttgtggtatatataatctcataattaacatttgctatagtacagtagctctcaacacatcagttgtaattgtgcacctttatgacttgtacattcacttggaaacattgttgttggttgaggtagaatgcaacttgtcctttgccttacaaatatatgggtgcggctttatacttagctgactcatggcctgtaaataaattaagcaagctacatctttccactctctgacttttttttaatgaaccgaccaagtcgagccgtactgaagcatttttcacaaaaagaagcactttttttggcatttgtgataagtaaagcaactcttatgcatcatttgaaaacagaaaaaaaaagggggatcgatgacctttttgtatgtgctccatttcatgtccgtagtctctctactacgtaccatcactagtggctatcaagatgtggcctgacttatcaataaaaatttctgaaatttaggtggatctcaacccatagcttatcacattgaattccataaaagcttcgatctagtccaagcacgcacttctatttcctgacagcacgaaatttatgagctttttgttcaatgcatgtggacaaattgttaatcgttgtcatcctttagtcaaaactctttttctccaccgttcagagctgaccaccactaactacaaaacccactattactgtttacttgcttctgtaccacgtaatttccgtagcattcagagctctcatgaattctgtgagcagacacagtggcagtcgtactcccaggtgatccacagtatttgcagacgttgatcagtggttcagagttcagactttactgtctgtctgcctgtcgctagctacgtatgtacaggcacagctcatacagcaatacatatacttgactactgcaaatatgcaattgagtggttcttcattttcctgcaatattcttggtatatatacgttaacgttacgtactcagctagcagctagaatcaaattcattccaagtgaagtagtgaacccaaagtacaatccatctatccatccatcgcccaaaaggctcagctttatttcttttttttttttgaaaagaaggctcagctttatttcatcaagaacacgatatgatacgcatatatacatgaaatggctgagtacacacatgcacaaagctagctagctagcacagagtgatctgaatcttggtgccgatcgattcacaggcaggagagcaacgctacgccgcttatttcgcctttaaattcttctctccctgtccaatcctctctctgtaaatattcgcgccttatcctgctgcataatgcaatcgccaacctcaatatgtacagtatcaaagccacgaaatctagctctcgcgttgtactagaaatgagtcggataacaacagcatcgatatgattcagagaacaaagaagggaacatgtgaataactgtttcgtcagtaaaaccggaacggcacagcatagcataatccagagaatatgtgctcatatgctgcttccagaggttctccctctagtgctagctcttgcattgctagcctgtggcctctgtggatccctgaaatcccactagtagcctacatgtctaaaggaaaatcattaccacattatctctcgaccattcagtcgtaaaatttccgctaaagcgaaggacagataactctgaattaatgtaaagcatcgtttctgccttgcatgtgccgttgccaaaatgcatggagctagctagggtagtgaccctaga

SEQ ID NO: 16384 - DNA, 3124 bp, Oryza sativa
ttgtccagtttgcatagttgggggtgaagaatatccggttttatggctcagggagtaattcggacgaccgcgatagtttagggggtaattcgtactttttcctcaacaatatggtattatttctgagtctggttgctatgatgcacgacgcatacgtgcagtcgtgcagcatatcgatggaccgaaacctcttgggcctccatggcactccgcgcgatcgaccggcttgccgcggggcggggccagtgcggaacgatggggctgaggcctgcagcctcggacaccgcacggcccgcgcatgcagacaccccctcccgtcgcccgcttccgcggcccggtccacctcccaggtaggccagcagccggcgaggcccaatgggaccctgactctatttgggccgttagctgcaccgacaatacacgcgtaacgagcaataagtcgtcctttttctgattttagttctgggaaaacgtcgtgctcgtctgcagaaaagggacagaagtgtataaaccgcgggacaagcacgttctttctccagtctaatctcttacacagaattcagggcgaattctcgaacggttagccccaacacgtggcacttccggattcctggatttggtttcccaccagccaatgcgcagatcgtacgagttgcctccgcgcgttcgtgcttgtgcccgcaaggcagctgggcgcctggtccctgggccatgctgcagctgcacattgactagggaggtgatggcccaagctgatgtccgaaaacgggtggaaaccttccaaagaaatacaaatacaagttaggcttgtcttcggcagcccctcttcccaacccatctccctctttttccactgttaaacggtgtgttttttgtaaaaagtttctatacgaaaattgcttagaaaatcaaattaatccattttttttaaaaaatagcaaatacttaattaatcacccgctaatcgctgctccgttttccatgcggtcactttgggttggaaaggggttccgaatacacctttcctaacatgtagtagtagataattgtatcagaagatggaaattagaccatcttaaaatgaaaatgtacagattagcaaaccaaggaaccatttctgaagaaaaaaagcaaaaacagatttaggcacctgtcggtgacatggggccgggggtatcgtgactagaggcttgggtagccgcggtcacccacgtggcctgaccccctcgggggggtcgggcccgagggtgacgtggccacccctccttctgtctccccgagggatcgggccgctcccgtttcggccccgagggctggggcgccccgaccccctgtggttttggcgccacgtgtgtgggttaggtgagccaagagggctcacctaaccgcatttatagcaggttggatgagcgcgccacgccgcatttaatgcggcgcagcgcacgcttatccggtccgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcgaggaagtcgctggccattaaatgaaggttgaaatgggcgtccaccggaaaagcgggcgagcggggcaggaggcgtgtgctttgcttgtcagaggtcacttccggctgtagactagccctcattgtaaaaagcatgtttcccttctcaggcagcaggaggcccatgtggtgacccctgaccagataaaaaggaggcccaggcctaggaagaaaaaggggggagaaagaggaaggagggttgggactctggcgaatgggttctagagcctgaactctctctcgctctccggctctctgtattccttcacgcacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaacctgcaaaggggggcctgcgcggtctcccggtgaggagccccacgctccgtcagcaccatatatagattccatatgcctccatactatactagattacgtcacaaatcccaccgtaaaattttggcatcaaagaaaacatcacgtgacttttatttccttcaaaattttatcattacaatagggtaggtaattgaaccaacggaaaatatttattggtgaaaaaaatgctactactcaaccaagaaaaaaatacaaatcaaatgaccatactaaagaaatttcacaaatcagtagagatactttctttttaccatttagacaaatgatgatgtgctcaatgagctttggcattatcaaatattggcggcagataattgaaccaactgaaaagatttatccatacaaaactgctactagaataaataatgaaaacaattaatcaaatgacagtaaaaacaaattttaatcagaaattaatattgaaatcaaaatagaaagacagtcttttacaatttatacagatggttgtgtgctctatgagctgagttgcatgttctcaaaattctgtcatgccctaaacaatgttgaaaaaaaatggatttataattatctactaggggttaaaaatatttaattttcttcacttacacaaatgggctaactacaaggtgtgccaaatggcgcaccatttttctagttagaggtaattaaggcaatattttttaaaccaaagaatggcatttggaccagaaaaatgtctaacgatagtacccacttttgcggctccgaaagtcggaaagcacgcaaaatcgtcgtcggcctaaaatttaaaaccgtgatcagccgaccgatctagcaaacgagtattataatatcaaaccgttgaacggtcaactagagcttcaatgatgggggctaagcttcatatttataattaaccacctctcatacatataacaaatcccatagcctacctactaacgagtttgtatatacaaaatcga

SEQ ID NO: 16385 - DNA, 301 bp, Oryza sativa
gatgatcattgcaatcaatccagcaaaaggccaaccggtaacaagcaagtcaagaagcaagattaaagcaaaactcaactttcctacaattgccgggtaaagagacatattggtaaaaattgttccattggtaacattcctaagccaaacctctcatttcatcacaatttgcttagaaaggccaaaaatggcacttgtgccactagggtgattagttcgctacatgctagcacaaaggccatttgggtgccgaaatctcttgtgactaacttccatggacccaacattatttggtgaggca

SEQ ID NO: 16386 - DNA, 717 bp, Oryza sativa
tttgatgtgatgataaagttggaagtttgaaaaaaaagtttggaactaaactcggcttaggatacatccttatccatattcatggtatttgaatgtgtccaatcgtgtgcaaaattgctactccctcagttccaaaataagcgcaactatgaatttctgtgtctaattttaatcgttgtcttatttaattttttttaaaaaaactaaaaacataattcacgcataaagtattactcatgttttataatttaacaacaatagaaatactaatcataaaaaaaattaaataagacggacgattaaagttggacacaaaaattgatgcgcttattttgggatcgaggaagtatattttagaatgtataataaaaaacaatctagaggatctaagataacgatatccagattattatcctaggttatatcctattattatttatattggtttattttgaagcggggaaagaagctagcattctagcaaaggagtagacgagtagctcggttcattggccgtcgtaccatgggaaggtcgctgaagcacggagccacagagcaagagggtgtggaagtgtttaactggaactttggggcgtaccgacatccaaccaaaattttctccgtcgattccacgcgccaccgatcgcggcgtccgatctgtcctgaacttctgatcgactgatcctgaaacatcagcgatcagttcagtttttccat

SEQ ID NO: 16387 - DNA, 997 bp, Oryza sativa
cgtaaactaaacacacccctagtatcatgaattagatagatatctattcatattcagatttatagtattataataagaccaattcagtactaagttgctttttttaagatggagtgagtatctcattagtcgcttgacgcatagttataaatgaacagttggtgtacttaatgcgaaatttgttaggaagcaagtgcaagctgattgcaatcagggagcaaagacatcgcgatgaaccattcagtaatactccgtccgtctcatcataatatagtgatttaagataagatgtgatattttatactacaataaattttgtcttaggttgctatatactatatccatctcaaaatatgtacatccgtggatatctgtgtccaacgtttgaccattcgtcttatttagaaaaataaaaaaaattagtcacacataaagtactattcatgtattatcatctaataacaataaaaatactaatcataaaaaatattaaataaaacaaatagtcaaacattgaatgaacaatgcaaaacattatttattttgggacggagggagtatattatgaaaagtaaccacgctagtgtgtatggtagccgcggaatgggctggccttcgggagttcgggatctttacggattggaataagtgcactttaggtctctctattcgtcgctcagtccgattttcgtccctgaactgtaaaaccgggtacaacccatcccccaacttacgaaaaccggacaaacgaggtccctcggcagtatggagggcagttttggccgacgtggcgtctatgtggctaatttgacttgatcttcatctgacgtgatattgacatggcgctgacgtggcaattccatccagaaaaatattaaaccccgtggcacccacatgtcagtttgacacacaaattaataaaaaatagtggggcccacgtgagccccacatatcattctcacccttctcttcttcctcctccctccctctccctctc

SEQ ID NO: 16388 - DNA, 9777 bp, Oryza sativa
tggatgtgaagaagagcgagacggcacgaggcaagtagcaggtgatgaggctgcaaaatgagaaggaacatgagcaagtgacgacgacacagtcgtgcagcttccggcacctcgcccgcgtgagctccagttcgtcggagtcgggcggcgccgtggcccccaactcctccacgagcccccgcgcggggtccgcgccgctgccgtggaggaggaggaggaggaggagaccacggcggccggctgtgccagtgggagagggggaagaggaggccggcgagcaggttgccgccgagttgcagccgcacacgggcgggaacttagcgccgcaccccgccaacgacgaggttcccgccgttcgcttggctccaccgccccgccggcttcgggcgccgccactgcgcccgcgcgtccgcccgccgctgccccactccgccccgtcggctttgcgccgccgtccgcctgccgccgccccccactccgctccgtcgttgtccccggcgccgctgctatgtggggtgagatggggagaaagaagaggtggggtgagaatgacatgtggggcccagtggcccacgtgggctccaccattttttattaatttgtgtgtgaaactgacatgtgggtcccatagtgtttaatatttttccagatcgaattgccacgtcagatgaagactgagtcaaattagccacataggcgtcacgtcggccaaaaccgctctccataccgccgagggatctcatttgtccggtttttgaaagttgggggacgggtcgtacccggttttgtggttcaggacaaaaatcggactgagcgacaaataggggacctgaagtgaacttattccttacggatttgcgtctcccgcccgctgggttaagaacttacgacgagccgctgtttctgatcgtgtgcaacggtgaattggtaaagtctgctgtctgcagcgaagcccggtatcatgccttgtgaggtgaacgaactaggcgggccggtggctcatcacatccacacaagttatctacctgttcaccactttacctcgttaaacagctccagttcaccaattgcatagtctagagtctagacctcgatcacattccaaggtagtagcacgaaaacagagtacctgatctggaaaaacatagtgccggccatcgcctaccaaagtatgatttgcgggtacactactacgtgcagttaaacttgtcgaaacaaagatttcggtaatacgaaaaagggtggctatcaagctagaaaagtggatgggtttagagacacaggttcaggccatctcaatgagaagtaataccctactcctgtccggggattaatccaccgagtatattattgatcgtatgatctgggagaaaagttatgtcccaagagatactcggacccctctttatatagggagaggagtccgtattacaaggtatagcctatattcctaacggaataggcaaataaagataaaatacagtcgtaaccgactagaatcccgagtatttccttgatatacaagttaaggaatgtaacccgagtcccttaaagatattctacctatatatggcattccatatccagtcggatatacatgccgtgtaaatatggggtatccataatctccacaaaactgccatagtcttctactgacgaaattaagtttgcctcggtaggaactactagctgagtactcagcatactggacggcagaaacagccgtggcactggccttatccactcatatccaagtggagtctcccaataggccgctgcacgggcgacgaatctatttcatccgctgcaagtgatccacatcacgcgagcccccacaacgatccgcgcccgctcatcccctcccgccacgtccgcaaccgcagccaccaccacaaaataaggcctaacctacgctgccacaaaccacggagacaacacacgcagctcgccgaccagagacagagagagaccatctgctagcttagctgccatggccgcctccaccgtctccggcctcgccggcgccaccctcgcccgccggccggccttctccaccggtgcgtgcgtcacagtcacaatcatcttctcacgcgctataaccgtgtgtttaatttgatcttggaatgctcgatttttttgtgcaggcttcacgacgggcgcccgggtgtcggcgaggaacccgctgctgacgaggaacctggagaggaacggcaggatcacctgcatgacgtaagtagcagtagtaggatcacctgcaagaagaattctgagagcagcaagcgtacgtggcgtgagattctgacggtgcgtacgtggtgttgtgtgttgggcctgcaggtttccgcaggactggcttaggagggacctgaacgtgatcgggttcgggctgatcgggtggatcgcgccgtcgagcgtcccggcgatcaacggcaacagcctcacggggctcttcttctccagcatcggccaggagctctcccacttcccctcgccgccggcgctcgactcgccgttctggtcagtacctctatcttcttcaggcacgcagtatagtactcctatataattagtagcaaaagcgttcagtggctacgtgtctaattgttcatgtgggttttgtgattaatttgcaggctgtggttggtgacgtggcaccttgggctgttcctggcgctcaccttcggccagatcgggttcaagggcaggaccgagggctacttcgacaagtgaatgaatccacagtggcttttggttagcttgactgtacggacggatgtgtgcgctgcatatccttccttttgtatagggctctgatttgatcctcttgcggatgtacgctgttgtaattctcctcaactccttaaaactttaaaggacaaatatatgtgttgtggctaaatctttttcgcaattagacacagacgcacgcacaaacgacactgcatgtacagttgtacacaattacacactcgcacagaccaccaaaattactggaccaccaaaattttgtagtatcacaaaaccaacccatgtttaacggtatcgaccaataaataccataatatctgatatcatgtagcaaattttgccatttaacaaatatttaagaacacaaaattgattggtttgtaatataacctttctctttacataattcattgattatacaattgtcaaatattttagaatttgttaaatagcattattgaggagtaagatcctggctatagtatttgtggatgtagcgtataagatcggtataaggatatgcacgtagatgtcataagaagaaatgcaattagatttttacaagttcgaaccctcaatgtgagtaatagttctattcatgtttatatctattgaccgaaagtatcacactgagtatgatgtctgaggtgggatctctaatctagcatactcaactaaccttgactaagagcaggtacaatagcaggctataagccaactataaacatattttaaaaagataaagaaatagagagaatagcagtgggctacagatctgtagccagttgcagcacggactccaaaacataatgtgtgtatgatatataggatcagatattaatagtatagtaagcaactattgtatgaattggttattacattggctatagataatttagagctagtagtgggctatactattacaactctaaagatgcggcaacaatgcaattggcggctagctctgggcttcccctaaatggatttggcatgaaggctgtggcttgagatttgacgccctattctcctaggacgtggtgtgtctttataccggaatacgaccctggttcaagtagatcttgatcccaagtaggacactagatcttgtccatgaagccataacgtctatgacttgaactatgcaatctttccttgtgtgacgcgtattcactcctagtatacccctattcatagatatctttttgtgtacaattactccctccgtttaaaaaaaaagacaaaccctggtttccgtgtctaatgtttgaccgttcatcttatttgaaaaaattatgaaaaaaattaaaaagataagtcacgcataaaatattaatcatattgtatcatctaactacaatgaaaatactaattataaaaaaaattcatataagatagacagtcaaacgttggcacgggaacccaggtttgccttttttttttgggacggagggagtagataactacattccccgtaaagtaagtatgagtgtatgggatacctcatatctactacttcctccgttttatattataagattttctagcattttcaaaagactggaccgacatatcttaagattgatgaagtcaacacgaacatcttgctgtcgataggtatctcgtctaccactgaaagaataattagccataattacaaacacctgtgatatactctcttatttcctaaatatttgacgccgttgactttttaaaacatgtttgaccgttcatcttattcaaaaacttttatgaaatatgcaaaactatatgtatatataaaagtatatttaagaatgaatcaaatgataagaaaataattaataattgcttaaattttttaataagaacgaacggtcaaacatatttaaaaaggtcaacgacgtcaaatatttagggacggagtgagtaggacttaaggtctgttcagattatagccaaaataaacctagacatagacttattcaaaaattttggcaatattgtcaaaattttggcaggattttttatgtatttaccaaatttaacaacaaactaaacatagacatttctttggcaactttactcaaaaatagtatggttgaaaatgacatcaatctgaatagccctaaatcaggctggcctgggtcaaatacaagaaacataaccggtgagctattcttgaacgaacgtaattcaggatacaacatattgttttgattctacataatttataagttgaatttccaaaactcaatcaaaccatcaatcttcaaatatttcaattggatatatgaaaaccatgtgtagattttcttttaaaaaaatcgtaaacatgtacaaaaaaattctgaatttttacattagttgctcgtttgctactgggctagctagcagtctagcaccacaccaacatggctaggcccaagcccaactcgtgatccagtcatccatagtcgactcgactttgggttcgagcgatcgaaactcggtaacccaggcgaggcgaatccaaatgcgaccacccgctgggcgggctccccgcttgccgccgccggcggcgcatgaccaccgccgtcctccggccatccccaccggtcgccacccttctcggccgctgccgcaccgcgcgctgcctcgcccagctccacgcccgcatcgtccgcctcggcctccacaaccaccacgcgctcctcgcccgcttcgccgccgcctgcgacgccctctcctgcccctccgtcgccgcctccctcctctccgtcgccgtcccggtacgcctgcggaacgccgtgctcgcctccctcgcccgccacgccccgctgcgggacgcgctcgcgcagttcaacctcctccgcgggggcgcgtcccgcccggacgccttctccttccctcccctcctttgcgcctgcgcgcgcgcctcctccctccccaccggcgcttccttgcacgccgcggccatccgcctcggagtcgacgccgaccttttcgtccgcacggcgctcatccagttctatgggaggtgcggcgccgctgccgccgccccgggtttgttcgattcactgacaaccccagcgaggtctcttggacggccattgtcactgcctatgtcaactctggtgatattttgactggcagggagttgttcgaccaaattccacaccgaaatgtggtgcattggaatgccatggttgatgggtatgtgaagtgcggtgacttggagggtgcaaggaagctgtttgatgaaatgcctgagagaactcctgcagcgtacacatcattgattggcgggtatttaaatgcagggaacatgggagctgcgagaacattgtttgataagctagaggaccgtgatttgttcgcatggtcaacaatgatatcagggtgtgcacagaacggttaccctggagaggctttgaggatttttaacgagttccaaaagcaagaaatatgtccagatgagcttgttattgttggtttgatgtcagcatgctcccaacttggtaacatcacattggcaagatggattgaaggttacatcatgatttatccaatagacatgaacaatgtccatgtgatggcgggtctcattaacatgaatgcaaagtgtggcaacatggagagagctactcttttgtttgaatctatgtcagttcgagatgttttttcatattgttcaatgatgcaaggtcattgcctccatggttcagctagcaaggctgtagagcttttttctcagatgctcttggagggcatcaccccagataacgccgcgttcacagttgttttgacagcttgcagtcatgctggcctagttgaagaagggaaaaggtactttgatatgatgaagaatgagtatatgattgtaccatctggtgaccactatgcttgccttgtcagtcttctcggacgttttgggatgctgagagatgcatatgagcttatcaagtcaatgcctggagaacctcatccaggagcatggggtgcattgctggggggatgcaagtttcattgtgacattgagcttggaaaaattgctgcaaagaagctctttgaaattgaaccggaaaatgctggaaattatgtctcgttgtcaaacatttatgctaacattgaccgatggggaaatgtttctgaaactagagctgagatgacaggaagagggataacgaaaattgcaggctgtaccttggttttgcagtagcatggttgagatgagtgagggatttattttgccatatgtttactggccctactggaaagttcagtgaacatcttttggaatgagaggaaaaaccatgtgtgctgtaatgctgtgcatgttgactcatgatggttatgagatcaatagaaaccaagagtttacactcaacctgagaatgcctacaataaatctggcttcatgacataaatgatgtgcttgttaacaagctgtatgggagttaataagaggaacgggaccatcttaagtagactgttctcttcggagtgctttgaattctttctgccgttgataccttatgagaaccagaggattccgtgacactggtttgataccatccacttctgttgctgagtctcatccactttttcaattgttgatgagacgactcccggtgagtgctcgcttggtcattcctaatcttctttactacctatcttagttattgttcatcaattcgagcttttttataatgtgatttctactgaactactacccatcatgcaaactaggatggttacatgggggaaaaggttgctgattatttgccttggcaggatcagtatgtgatgtggtatcctgatattggttgtcattaatcagaaaaaacaagtatatagctcttcaggtatgtccttaggattcctattatatcttggtttccatgtgtggcttgagcttcaatgccctcactaagtatgttcaaatactcagataattgtatccagaagtttcattttgaaacaaaggcagaagctctgccttaattcattgatatagaagaggcaaataacaactgtatatccagaagttgtggagtgcaaaattttggagttttgagcatcgtgcctcggctatacttcctgaaggtgagaactacagggttcaattagacttgctaactgaaagtagcacatagaatgtttgcttatattgccttcatgcatgcaataagtgtgttatttgcaggaaatgtgaaaaaccatggatgttattttgcatcaaaccaaacatactactgtgtgtctctaccttaccaaatattagcaatgccaaaattttgcatgacaagaattcgttagggttgatttgggcgataaaccaaacagccttattgtcacatttatgctttgaaaaccattaggtcatgtgatcacagtaaggatcaaggttttagttgattgagtttacgaaacattacaagagctcttcttttcttggaattacttcagtaataacataattcatttcaattccaatcatgtttcaaaattctgttgcacctgcataccccttttggtgttgttatcagccattaatgataccaatgacctatcaactcgagggcatatgctcacagaaatataaacctggaaaagtcaattatggcttgatgaagtctaatgagtaagctatgcttacagtaatatttcaggcagtttccattaaggcccacgtgtagcgtgtcacctctgggttaagaggcgcgatgctttcagattcctccatttggaatttggtttgcaaatgtggtaactggtaaggtagtaacatgtgctcctattaaattgtgtcccctcatcctagtcttaaacaaaagtgattagacttgttgttgagtggcgtcaagtggaccaccttctgcaggccttgttgctgtttcatctgcatagtgcctgtcacctgtgtggctgtgtgtgtttttgtggcccagcgtcatatcactgagaaatgtttgagctgaaagttttctgactgtacaacgctatgctaaatatacacatgtatcagacaatgaattcgctaacgatactgcacgaagtgttttctataaaatgcaatgtccatggtaggctggtagttatcagctgcaagtttggacaaggcactaccgccactatgtgccactatatcatctttctcctgaattttcaaatcaaataaagccagaattaattaagatttgggcatggtgaagtagtgggatcattggccagtcatgaagtttagtattttctgattataaaaaggatatcaggacacccatagatacatgataaaacctgtggttgaaggtttggtggttgcaagtgctttcctagggaaatagacctcatttaatcacctagcctggtggaaaacctttaccataggtaatggacgatccttaataatttggggggggaatttaatagggtccggttaaggcagacaaaattatcttcaagtcgatttaattattaataaattgcccacgcattttggtgcaccagtggtctttcaggtcaatgagcttgttattaatgaaatcatgcgttgattcaaacatctccctatagcatttgtattagtagcactagggagtaacgacagtttgggcaatatataaacaatgccattaaattctcgggctatctggttggtccatgttagattcttagtgggatgtgtgaattgcagcactatgtctccgtgtgggcatgcgcacgagtgtatgtgcatgtcgtatcacatgtctaacaccacggtgcacgaactgaatcctggaacgttgtcccgttgaagttatcagcaattggagaggggaagctaattttgtcctgcttcttctttgtcagggataacaaagaggttatttgagcaagtacccgctgtgctgcgagtaagattcgagttatcagcggttgtttaggttggatctcaaagaatcaacatactggtgagtgttcatacaagttcacccttctggttgattaaatcatatgaccaattgttttgtgctagagcaaaccaacattgctttgcttaatgttttcatcaaatgtcaacttttt

SEQ ID NO: 16389 - DNA, 6496 bp, Oryza sativa
tagattttctttttttttatctctattttcaaaaatccggccgggaacagtgactggtcataatgaaagtgaggttcaaaaagtgatttgatcagtttccaattaaaaaaaaaagagaggatactgcgagcaaaattcggaagaaatataaatgtaagtgctccaataagaaacggagtgcaatccaaaaataaacaatgaacccaatgtgcattagacttatgataacaacactgcaccagcacagtgcacagctattagatttgatgctgttttcttttcaagtatttgcttatagcacaaagccagaaacagctatcagataaaatatcagaaagtggctttgcaagacataaaaaataatcaggaaagctgttgatccagccagagagcaaggaacatgatgagcataccacaatcctcgcagcagacatggctatctaaaaaatgtcagttgttaataagctttcctccaaggacttctaaattttaaaatcttctatatataactgaagattaaattgcaacgttaggtggaagccatgcttttggcaagttatagcatacaaatgttgcggtggttcacaggttgttagcaccaaactctaattttcttctgtttaaggttatgatacagtattacagtgcataacagtatgcaaactttgaacagagacggcatatgtgttgttttctgaactcgattttgttttcttcataaatggacactgcagataataaatatttaacattcatagataagatttagttcaatttacggaactttgaccatcaacgacttcccaaatgcttaatttgaaaaaaaaaaggtatacgtatatttgaaatgtacgactatcataatgacaaaaattctttatattttgtacactcaatataataaattattagattttgtaaacctattataacaaaagtagtgattacagtttttaaagttttgaattttatcctaaatatccgagaggagtacctaaaacgcctattttattttcaacggcaattaatggaatgaggggtatgtttctagatcaaaatcttgtttcaaaaaccattagttcaaggtgttctgatctcttttttttttagcagcggccacaaaattcctaacttatatcccaatgatgtgtacgtagttaatactcctttcgtctacaaatataaggaattatggattcaattttatctgcaaatcctatatttctataaagttcatcctcaccaagtgtagttaatgctatttttttctcattgagccacatcatcttaattatttctaacccttgaatgattgatctatggttcaaattatgtccctcctttccttcttctaggaaatcatatcatctttcttttgtctttggatgattattctatatcatttcccttcttttcattccgtcattgaggtatatcaccttagttttgcttttgaataatctatttatatatgatttacattgttataaaccatatcattttaattgtttataactttttttcttccatggttgatcacagatgaaaattatataaagtatataaagtgatgtcgtgtagctatatgcatgttatttatactattatcatatataactcccacagcaactcgcggggtttcattttgaagtggagtactattttcccatttcatccaaccattgcatttattgctactaggcatgacctttccattcaattaaactcacatggaaattacttcgaaagtaatttcacctcaacacttaactttgctaaccaatctagagtctactccttatatttgtagatggaaggagtatcatcagtgatgatgagtagaaacactcctttcaagtaaatattacagtactattttttagccttttaatggtcatgataataccattttttttctactctctctatccacaaaagttacacatattacttttgacaccaagaccaataagaaattaaatcacattggatgttaatcaaagagcgaatataaacatgcaactaataagtatttagatgactccttgagttttaatgaagcatgtaatttatctcttcatttaaatcttgaatatataaagactataaataggaacaatttatttagaaaaacttaaatgtaaaatatgtgtaacttttatggatggagaaagtaactttcacagaaggtgcagtaagcaggtacagggaccatcactcctcagtcaaataaaaaagaactaaaattgatgctgagaaaatgaagcaaatagtggatgggggagtgaaaggccaagtttagttccaaaatttttcttcaaactttcaactttttcatcgtatccaaacttttctacacacacaaacttttaacttttctgtcacatcgttttaatttcaactaaacttctaattttaacgtgaactaaacacacccaaagacacaccacatcaaatcttgtgctagtcattggccaatagaccattcaatggcggtattcaattcctctactgaaaccctctccaaccctctcgtaaatgtgctgcaacctcctctttctcttctccctctctataaaacacaagcgaaaataaacgccacgccacgccaccgcctccgtcaaacacggcggcgcaatgcctcccctgaaccctccccacctccactttggaaagctcaggaagcgggcgcgcgccgtggccgccggcggcggacgccagccggctgctgccatggccaagaaggggctcgttggtatcctgtacaagctccgcgacgtgcaccatcgcgcgccgccgacgccgacgtcgccctcgtcgtcgtcgtccccgcactgccacggccggcatcagctctgctacccgccggcgccgtcgtcgtggccgtggccgtcgtgccggcacccgcgcaccagctcgttcaggtggccgacggcgccgcagcaggggcaggcggacgacgacgccgccgccgccgccggctccgtgtaccgcaccgtgaacactgtctacgacacgtcgtcgctggagcacttcaacccgcggcgctcctccctggacgaggcgtcgtcctgcattgctgaccggagcttcttcgccgtggagtcggaggtggaggtggaggaggagaaggagaaggagaaggagctgcagctgcgtgagacggccgtcgtgcgcggcgtccgctcggagcggctctttttcgagcccgccggcgcggagttcttgcccaagcaggtaatgcggcgcacgtcgcgcactacgattaagacgcgcgacgacgcgagagcaatcgatcttgttataacacgagagaggatttcaggaaatggcgcgaggcaagaacgacgacgaggcgacagccatggacgtcgtcgctcgcaagaacgacgacgtcgacgaggcgacgccgatgaccacgccgcagaccggcaagaacgaagcggaagcggcggaggccgccgcgctgaagggcggcgcggtggtgctgacggtggagtcggaggacccctacggcgacttcaggtcgtcgatggcggacatggtggcggcgcacgggctgcgggactgggagggcctggaggagctcctggcgtggtacctcaagctgaacgccaagggcgtccatggcgtcatcgtgggggccttcatcgacatgctcgtgagcctcgcgtcctcgccgatcccgtcgcagtcgccctcgtcgtcgtgcatcaccttcgaggactactcgtcggcgaccatggaggaggagagctaattaagctgttctcgaggaagacgacgaccacgttttgtttttctttagcctcatcaagagatgacaatctctttttctctttttttgggtgctaattcttttgtgtttccacgaaggaatggcaagtgagggaattattgtacagttgctaaaaactaattgatgctgatcattagtgtagattaattaattaattaatgctgagatggctaattgatcactttgctctgctgtgatctctcttcctagcgtagtgtgggtcaagatgtcaaattttcaatggctgacaatttttatcacaattttgtgaagattttgatgacaagattcagaggaatgatgggtcaaaccctgttccttggtctgcaggtccatgaaggcaatgcaggttatctgggatatattaatgagtcaccaacagctcataaatatgtggccttcatgccattggtttctttggagtaatgcggtaccagatgattttaatccaagagattgcaatgttatcaagctgtcacgtactctaccctgcggcaagtattagtaattattttggtcacattgacagggggctgtgtgtttagttcttttcaaacttccaaaaattctgttacatcaaatgtttatgtctttggacacatgcatagaacattaaatgcaaacgaaaaaaaccaattacacagtttatatgtaaattgcgagacgaatcttttgagtctaattacgccataatttgacaatgtgatgttacagtaaatatttgctaatgacgaattaattaggcttaataaatttgtctcgcagtttacagacggaatctgtaatttattttgttattagtctacgtttaatacttcaaatgtgtgtctatatattttaaaaaaatttggacagggaactaaacacggctagggtcaagaaggcactatttgaccactaattcccattttctacataataacataatatgttgataaatatcagattttaaaaaacgcacactacataattttataacgaatgtaggaatgctattgtcgtgcagccaagctagacacggtttatatactatggtcaaacctaaaaagctgttaaaccacatttaattttcgagatgttttacaatggtttttaatgaaagtagaattaagttagaccgtttattttttttctaattcaacagatcatatatatttatactaccatctctatgtagaattttttttactgctactagaactcatatatcaacgactgagataattttattggtgattatactggtagtaaaatgctatagtagaaaccgcttcaaagattctggtattttggctgaaattattggtgtttagttggaagttccttccaaataccagttgatgaaagttggatttctgttcagtttgagtaaaaacatgttgaaatttgcctcgaaattctacaagaaaatgtctgtttcatgagaaatgtttggccttggattcttatctaggatatccacacattaatccacgcacatattgcaagcatgatacttccattttcgcgagcatagtcagtacaaacactactaggactgtttaagttttgtccatgaataagccttacccacagtcctccacgatcataagtccctttcagtgttttcgacttgaatgcgtcgagtaataacacagtgggtccatgaatttatcagtgcttatcatgaagcttaactcttacggaacaggacagactagtaatatcagctaggccccggcagagtccttttaaatctactactaaatgactacttactctaatcaagcctcatgttcagcagtcttcaggagttaccaggacagtctaatcaagggacaagagtttttcactgcctggagtagagactgcaaatttggtcggtaaagtttatgtaaaatggagtagtaactgggttatgaaccttgcagaattcagaagccatttgtgccatttgtaggttagatcaagcaaaaacatagtggaattgagtgccatattttattttaggttagacaacacttgtagtagtagctcctaagggtagcttaagttttgtccctaaccaccttgtgaaacttaatttatgatgcttaaaggttcaagcattccaagttgttcttttaccctgcaacactgcaagtttgcagcttctagactgctcgctgagacatgtccgttcaatcccagtaaactgtaggctcacaacgagcgatctttgcgtctctattcttaggtcagattgacatccaacgctggatcatgcaacgcatggataccaccaaacaggaacacattgtgcaatgcagagcacttgatcgatgagacgtactactccagagtccagacagatttaagatcgaacagggtattaattacttctgcaattctgcatcctcttcactgctactcctacgtccgggacagcgatcgatcgatcgatcatgcatgcggctgatgcatcacatctcgccaacatgcagatgcaaacacatcaggcgtagcccaaccaaccggcaactacaagcatcgcatgcatgccaatccatctgatcactgatgatttacatggttcgcgtatctttgggatcacaggcttcgactgttttttcgcagcatcttcagtgggtgccgttttttctgtagttcagagatgataagcacagtaaacaggatgtgccgtgttcctgttcaagagatccgggcatgttttgcgct

SEQ ID NO: 16390 - DNA, 2963 bp, Oryza sativa
ccctcctcccctccctcccccacctcagcctccgcctccgccgccgccgcctcctccatcctccagtccctccccctccacgtggtaactccccctccccaaccttctcgatccttcctccattttgctgttctaatccgctgtgctggcttggcttggattccatccccagtccttcgaccgcggcttctacctcctcgtcaaggcgatccaggagctgcgtgagcgcaaggacggcctcgtcgtcaccgtcggcatcggcgggccaaccggctccggcaagaccaggtacgggccgctcccctccttcccgccgcgcgctggttgctgttgctgattggtggtggtggtgttgtgcactttgtgccgggcgcagcctggcggagaaggtggcgtcggtgctggggtgcgtcgtgatcgtctccatggaggactaccgcacggtggccggggccgacgacggcagcgacgttgacgccatcgacttcgacgccctcgctcgtaacctccaggtccgtgcccgcacgttccttcgattttggggattttttttggaggggtggggattggatacgtgcagggtgcttgctttaatggcaggtcactaggtcagaatggcgtgacaaatggtgggcttgaatgctctgttccattgtactactaccattgatagggtgggctagtggttgttgttggagaatagagttgatggatggatacaaatgggggaagtagagttattttcagaaagagaaatgtccagcttcttgtctccgtgccactttatgttctagccctctatacagccggataatttgatcgcagtccatttggtccaaaaccaaaacaacagtttcttcttgataactattgtcaattgatatccctctgttaataattattttttaccaagccaactttacatgacatggtcaaattataaaaaaaaaatgttaaaagatgatcaagtctagtggtttgatactatgtagttgcaaggagtcaaatgatacaggaattgggaaagtggggtaaatgggtgttcctaatctaggaggagcattcaatttgtgcttccattgtgccctctacatctggaggttgcagaacagtttacatgcacaccaattgtattggaatatttatttaccttttcttttaccatgttttcaaagggaaagccgaaatggtagcaaaatgctagtatgatgacgatgtgtaggcgtgtagctatgctggtgatgctgttgagtgtaattactgtgtcaaggtctgtgcattccaatggaaagttggaattataaatagcttctggaaaaaatggagcctctactagtgaaatcaactactggtcataatatctggaagacgtgcaattgagttgctagtatgccttattctcgtcttacagccttttcctgtgtttaatgccaaagccattcgagctgcatatgcctgcataactgataattgtaggtccagtgcttttctatgacactttgcagcggtattcatcatgttgcacaattatcgagtatttttgccgaaatgacgaaaaaaatgctgcataaacttgtttggttcatgggcccatgtgcttgtagtattttagtccctagagcctttcttctgctattattgttttgatttattaccctctgatattatttatgtattttcaacaattcttaaactgtgtataaattctatttttaatgaggccttgaaaagttgtctgaatacattagatgtctaaacaattggataggttaatattgtgattgcattggaagagagaaacaacaacaataaagaaaatgttcattgtggaggttactagtgtgttcctctatgtgttcaattggtcattcatgcatacgaccataatgattaatgaagagatcagtagtagtattgtaatacaattcaagtactttctcttttggaaaccaaataatccaaatttgcatgggttctaccctgtttattttgaaatacataatggacctaatttcccacctcgtagatttgctatgaggaaatatgctggtcatgtgtgatctggcatattttctgggcttagaaatgcccaatctctctgctatactgttgctggttttagtgacaatccagccgatcgtttttggtctataagggttgcttgctttactcctttacctgctgcctgctggaatgcacacatttctgctttctccaatgttctaaaagtgtcatgcttgttgtttgtaattgatgcatctatttggatcaatatccagactcctttgagtaatctatttgtacaaaattttcttcatttgtttgccaccttgacaattttctgcttatttaggtgtattacaagtatccttacaatcatgtctgctgagcaggatcttgtaaagggtaaagatacattgatgccattggttgattttcaagagaagaaacgtacaggatggaggcaactgaagatttcgccatctggagtggtgaaatatctcagaaatacatgctatgaacatttggcaaccttagaatcagatatctttgctagtttgatacaacatatccttgtaggtgattgttgatggtgcttatgctcttcattcaacactgaggtcactgcttgatattcgtgttgctgtggtaaaaattataattgccctaaatatttttcattatagaacagttattttatctcaataatttcacccatgaacttcaggttggtggtgttcattttagccttctgtctaaagtccagcatgatattggagattcttgctcgttggactatctgattgatagcatatttcccttgtttagaaagcatattgagccagacttgcatcatgctcaagtatacatcttgtaccttttttgcctttttatagtctgtaggtaccatttgattcttttttatttgagttgctacttgctagtgcagattagaatcgaca

SEQ ID NO: 16391 - DNA, 511 bp, Oryza sativa
acactcaattgaacttgagtacggcttatcatcctcaaacagatggacaaaccgaacgtgttaatcagtgtctagagatgtatctcaggtgtatgactcaagctacacccactaaatggaatagttggttgcaccttgcagagtattggtataacacatcctttcattctaccttgggctccttgtaaagccttgtttggagtagagtctcatgtcagccaagtgccagttttgttatcttcagttcatcagtcagtggctgatttggtgtctgagcatgaccagttatctgcattctttcagcagcaactccagtgagcacagctgcgtatgaagaacaaagctgaccgaggtggttctgagcgctcctttgaggtaggcataatggttttcctgaaactccaaccatatgcagagtcctcagtgataaatcgtccatatcctaaactggcattcaatttttttggtcccttccgagttgtggagaaggttggctctacagcttatcgct

SEQ ID NO: 16392 - DNA, 1722 bp, Oryza sativa
tatccctttgcacgtctgcatcgttggtgtggcttgctgagtacggtggttgtactcagtcttgctattatgccccccccccttttttcagaagtgtagtgcttctgagctgaagatggagttagaggaccaaggctcagaccccagttgagttttgactgtggagtggagctgaaaccccgctaggatcgcctttttccgctgctgtcgttctgtttcggtgtgaggactaagtgcctcttccgtaagtattttacgctttatttacgtttggaactgtatattacttgtcgttttctgtaccctggctggtcctggacagagatttaatacgcaaaatagtctagaaatttgggttaaatttctgggcgtgacaaagtggtatcagagccaacttgactgtaggttgagccaaatggtcaaaccctaaggacaagttttctgaaaaaccctatttgcaaattgtctcctctcgcccttcgacatttctttatgaaacggtttttcaaaattctcctcccagtccctccaatcctcatagttgttaaacctggaggacaaaccgtcagcttcacgcctattcggaagtcaagtcaagcttcgtgcaaagagtgagaagatcagcccagagtcaagtgaagttttcccggagttttcctaaacccaatctttccctgaagagtagtatcgttagctgctagatcgtgtgttgtttgcttgtgtgtaggggtatggtttgcatcattggtggggatgcgaccatactaggttgtttgcttaagcaacttgaatcataaaatccattcacaacagatcaataggcaagtggtttagtacctcctctctagtaacccctcctatttccccatctctctattgcctgcagcagatggtccgcatgagggacaatttcatcggatcaagaccccgtcagtttcatggggcaactcagtgcaattctaatagtattccacgtcagcctcttgaaggtcagcctcaaccccaagtcatggctaatcaaactcagacagtggaagagttgttacaacagatgcgacgtcggtaccaaatatactagatgcaacagatgcaacgacaatgtcaggagtcacgtcaatgtcacccaccgcaggtgcgagatcagatgccagcccggaacccgaatcagagtcagagtcaggagttcccaatatcggcaccgaagacccctgtcaaaatgctgtccagattcccgaagataacgacagccaagtcaacgtcagaccaaaggaaagtaagtgctacctgttatgactgtggtgagcaaggtcattatgtaaggaactgtccatggaaggtgttcgccaggtcacctgaaaaagacgagaagcagtgcccagggagtaaccaagctccaagtcagtctaccgacaagaaggatggtactttgcagcccaactctggagcgaacaggacagtgatatggaagatggataatggcaggaccatgatcatcaccggttcagaatttactcctgaagacgcagcaaggatacccaagcgtcagagaggaagaaataccttccgaggagcgcgtcagctaacccgtcatctcataaagtacggtccgcccagacccgaagatgatgaatcaggagaacggttttctgctgatgacgatgacgacaacgatgatgataatgatgagaatgatgatgcgacccttgacagtttcagggaaag

SEQ ID NO: 16393 - DNA, 3000 bp, Oryza sativa
ctcttcctccaactccagctccagtggaagccaaccatggaagaagcaacgtcaccaaggatgttcataagtctctgcttgttcccgtttcagctgccaaagtgcataatcagaagcctgcaccctgggaccaagcaagtcgatcctgtcgcaactgtcgtaagccaggacattgtttcagtgattgccctcttccaagagcagcaaaggcagttcgtcgtgattcacaagttaccagcactgcccatgacaccaatcgacacctaaatgtgcaacctccgccccaacggattatcgtcaagggcaccgtcaaaggtcgcattgttccaccggcaatcgtttcaagcctacaacaccaacgccagcaaggtaagcaatgccaggagaataatagctcgctacagctacaaagaggcagtacactccttcgccagcacccgcggcaagcttcgtcagccccaggtcacccagcagttgtcagctctagcaatgcacctcgtattgctccaatccaaaggcccatcggcaaatcaccgctcggtaaccccgcgagcaagaagttcctacctgctgcagctgtcaagagagttgttactccaccatcgaagatcaacaagcagagcaacattcccggtgagacttcagccagtaggaattaaagaaacaagtcggttaggttcgaataatggaagcaatagcagtcctagccaagccccctacgtttcaagttcagcagcagtctacaagtgtttaaccttatagcacttctctctgtacatagatgtttatggcagttatgtaatgaaaagggaatattgaataaagtttgagtcagtcagtttctcttcttttatgattcatcttgagcatgcaaaagcaagttaaaatgtgaatctgtcggtgtcacaagaaaccaagagtttctcttctaactcatcgcaattctgttgaagctccaaaacctgtttgcgagcaaatagaggaatggttaactagcagattgaaaatggttagacgctcaacacccaacatgatgagatctctttaaaggcagtatcaatggtattcggatgaaaagagtgatggaatatttgaaagtgacatcatataaagaatcttgggaactcctctaaaccttggaagccgttagaggatggtaagcggaaatttacaccctagtggtgcgatcatggatcaattacatttttccttagttcaagacagccagtataagctccaggaatcatctcaatgtttctcagaagttgaaaaagaaattgttccatacctgggtcagaagtatacagagtcaagtccagaaatgtgtagttagcagggtatatggcatagaatcccttttaacgaatcatctttaccgaagataggaaagcgaagtggttatgatcaaaaagcagaaactctcggcagtatcaaagtcaatttccggcagtcgttcagattgtagtatttttgggaaaacaattgcagggcctatagtccgtaaacccaggaagagtcagcaaaggacgatcgacgaagtgtaatgtcatgtcaagagaaggacttttgagtttgatctgttaagtgatcagtgggtatgcaatctatttaggcatacgacaccgaagtcaggctagaagcgggacagttatgccagcagttcaattgttcccagtcaggcgaaatgtatgactactcctgtaaggggggtaggtcgcagagatgagttctggctcacctcgtcgctgtttcagttgaaggagccaattgcaaggtgtcatgcagaattacgccggtcctaggtcacttgatggaattctgagggacaccggtgaggccaggtcaacagcttagcttagagaagcaacagtgaggacagttgcggttcagacgaaagacaggtcaagcaggtttcctggaattacgtgtcactcgagtcagaacccgttcaagcggacgtaggatcaatgagttacaaaggtcagatgcaagcttcaggaacaacttcatcctcttcgagtcagcatggtgaattgtcaggttatcaaaattgctaacctcaacaattcagtccaagataagtaagttccttaagcatccacagccctgtctgggtcagttgaagtagaaccagtcagtccagtcttgcaaagcaaaggaacagaaaagttgaatcaatcagttcagtcgtgcaagtctggacaatcagtcaatcagtcagttcgagacagaaagggggcagtgcagtatgcggatccgtccgatcagtcaaaccgcccgccagctccagctttctttctagccatcccagaatctcgggacgagattcctgtaaggggggtagatttgtaacgccccgattttcgttcgggaataaaaatcaattaataatacattttctagaaattaaataaaagttaaaccaatttaatcaagtggaattatagaggaaatttgaaattttcctttaaaaatcattggccgggaatattttgtaatattctttgcgccctaatgtactctccggaattttccgtgaattttcggagctcgagaaatagttttaatagcacaaagatcattgcatcaattaaaataaaaagaaaaacaattaaaatcccccttcctctctttgggcctttttcggcccaagtcttcctaccctcccgcggcccgcgcgccccttttctctccctctcgggccggcctcctccctcggcccgctcggctctctctctccctcaagtctgctttacctccctcgcccgttttcccctctctctccccgacaggtgggacccgaggccccacctgtcatcttcttccccaacctcccgtcgccccaacggccgccatggccgccggtttcgccccacgacgccgcggttcccgcgcttcaccccgccccacgagcgcgtggaatcgatcccctccacctcctccactttttcccccactctccccgtgaaaatcggcgccgggttaacccctccaccaccc

SEQ ID NO: 16394 - DNA, 908 bp, Oryza sativa
tccccttgtttcccgggcccggcactctctccctcgctcttccccacgccgctcccgcgcgccgccacactccggcgaactccggccgccgtttcccgtcactagggtcgccgccgccctgctccgccgccaccgccagctttgccgccgcccgggcaagctcggccaccgctccatttcccctctccacctccgtagcgccgtagccacgcgaaccacctctctccgctgccgcccccgactccagccgcgtcgcgccgccgcttcggtcgacgccgaccagcgccgttgcctccctcagctccgcaaggacgaggaggacctcggccgccgcccctcttcgccggaaatccgccggagctcctccttcctcggtcgccgatcgaggccgagcccgtccgccccatcccgagcgacgcccgtcgccggagctccgtcacgtcgtcttcctgaggagccccgtcgccaccgttccttgccgtcggccgcccctttgccgtcgtgcatctcggtgagcactcccctccctctcccttttcctccccttcgtcggccgcctcccgggcgtcctcgcgacgcgctgccgccgccggtggccgtccgaccgggtcgacttgcaaaattcatctaaaattgagctctacatgtttgtttactttttatgtactgtttgcttggtttttataagagtttttcctcgttttgcgtgccagcgtgtagttcccgtcgtttcggaagatcgcggtcgcaaggataagagttcggaagattgtttgaagaagcaaggcaagtcacacattccccttgagcatgttgatcctaatttacaaatcttttactgtttgcaaataaatatgcatgttttgctaattacacgggatcagggtttacctatctgctcgcttgtg

SEQ ID NO: 16395 - DNA, 10056 bp, Oryza sativa
  unsure (1)..(10056): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtcctgggaggcttacgcccgaacttgccgaccaattcttcgtggcgaatccctttggtgaatgcggcgatgataacgtcgtcggtgatgtcggagatcttgttacgttgttcggaaaatcgtcggatgtaatctcgaagggattctccggacttctgaataacgttgtagaggtcgtattgtgtgccgggacgctcgaaggtgccttggaagttggcgatgaagtggtcgcgtaattcagcccaagatccaattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccgtcgtacttctctattccagtcggcttgaagccggctggccaatccactcgacgcaggtcgtcggtgaaggctgctactccgtcaaggtcgtcgtcgtggcggtccggcgaatgatgatggcctcgagctgctcggcgctgtatgattgtgtcgcgaagatcgacggggcggcgacgaggtggtgagcgaggccgttccactcggcgctccctatgatggtcgggaggtgagtgaacggaccgctcgtcgtgacccctgctcctgcgattggatcctgcgccggtgatgctgaggcttggatgacggtagtcatgagatcggaagtgggggactcggctgccggtcggcgtatggacgctttcggagttaactgggaccgaagccgcaatcatggtcttcgtctggttcaagatgttgacgacgtgatcagattgattgagctcgttttccttgagaagggtgtcgaggagggtgatcgcggcaaccgcattctgttgaggggtgcggaaaaccggtgtcccttcaacatcttgttggccgatgagatcacgcgctcggcgccctgcttccaaagctcgctgccgtcgatcctcagcctccttcgcggtccgctcacgctcctgctgctcacgccgtagccgttcttgttcttgtgcttgatgctcctcctccagtcggcgacgctcagtctcgcgacgtgcttcggtctcccgggcttggcgttgctcctccgtctcgtcatcggccatgaagacgccgaagtagagaggggtgtagttgtcatctaggcttccgtcgaagtcgtcgagatccgggtcgttgtagcgagagctaaactcgtcgtactccacgatgtcggtggggcgcgagtcgacggtgggagagctgtagtagccatccagctgatccgtcgaaaccgtgccgagtggttggaggatgacgccgacttccctgaagctaggcgaaatcggtgttgaagccgacttccgcctaggcctacgggatggagacgctgtcgtgatggagacggccgccaaatcgtcggggagcttcatcaggatcggtgggtaagccccatcatcttgatctggtgacgttggagaagatgcgatctcacccaagtggtttgaagccaactcgattgagatggtcttgaagtaactttcagccgcgtttgggagtccaaacgggactgaaatccggttctctcccgactggtctgacaccgagtcaaggagagagatcttgccgaagttgttggtgacgaagtcgaggctgccgaaccgaaacgtctgcccaggtgggaagacgaggtcgtcgatgccggagacggaacccattgcactgatcggcgaaaagcttgacgcaacccctacctggcgcgccaactgtcgaaactagatttcggcaataataaaagggggtggctatcaagctggagaagtgtatgggtttggagacaaaagatttatacaggttcaggccttcttattcaagaagtaataccctactcctgtccggggatgaatccgccgagtgtcttattgattgtataatttggagaaaatcaacctctgcccctagaggcacccggaccccccttatatatgggagggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagcccaaatatcatcgccgtgtagatatgggatatccataatctccacaatcacattagtcccggtttcaacaaactgggactaattcatctttagtcctggttcaaaagtccatctttagtctagtttcgttaccaaccgggacaaaaaaaattatatctttaatcccggttggtaaccgggattagatatctctctcccacgtcattggcatctctcactctctctccccctctctctctcttccttatctcggcatcggcaacaacgccttatcccctcctcctcctcctcctcccctcttcacgccttcttctcctcctcctccactcctcctccccctcccctctcgtctgatcccctcctccccttcccctctccctctcccatctccacggcgacaccctcccttgcgtcggatcgggcgggagaggagccggcgggagaggcgggcaacggcgcacgaggcggcggcctcccctctgccagatccggcgggaggggaggcgataggatgggagggtggccgggtggcagcccggtggaggaggcggcggcggcggccgggcggggccctcctcctcctcacccccgtctgctggctatgactgatttgtttttagattttattatagatttttttagatttgggaagattttgtggatgggccagtgatttgtggatgattttatagatgggcctataaattgtggatgatttgtggggatttggggtgacggcgtcggtgatttcggctcaaaatcaatagatgcaagcagcaaagaacaatagaaaaagaaagaaaaagaactttagtcccggttggtaacaccaatctggactaaagttggtagcaccaccaactgtgactaaagatgaatctttagtcccagttatttcaaccggtacttaaaaaatgctcatcggagtctcggtttgtaacctaggactaaaggcgttgtaaactagatctgaagatcacttctccagcggtggaagaacaaagaagagagaaaggtagagatcatcaaaatgaatactccactacttttagatcatcaactgttttatttccaaagattacccaaatataaacctttcatgatatataagaaagtacccaagatttttggcgtctgcgccaactaggaaagctgacatgattatccatgaactggagaaccgttagttcttcggcctaatttcgatcccctctacaataatttggcattggtgcgatccggttaagcccctaaactcaatagaaatgtctccattctcttcattgttctgttttaccactgatatctctgtactaatttcctgctccatccatccatcacttcttacacaaatgcctacatatttcagttctttcttctggttattgttggtttttacaaatgatgatccatcataatccatgttgaacaacagtgagcgcagatgtttctgcggcataagatggttgcattcatgactgcaaatgctggaggtggatgatgacccagatgctgttgcatcttgttctttgtagcctccattttgatcttctgtgtgcaagaattggacattgtacacaagataagctccgtaggatgtaccgtttgagagatgctttgtgttgaagataccatagatgtccaaccaacacaagtgggagaggatggccacctcagaaaacctagaaataaagaagggaaaataatggacatataatcgtcagaagggttgtctgctatttatgggagagaaaaatcaacaaggagtacatcccatgacaaaaaaaaagacatgtttacaatgttctgtggtagtagaaccaatctagattttctaatcaatatggaccatatctactgatagcagaattcataaatcaacacttaagatcatttctacggatgataatactcttagtattcaagaaggaaatgcatgatattttgtactccctccgtcccaaatataagcatttttagctattaatctggatgaccgtgcgtccagattcatagccaaaggtgttacattttgggacggagatagtagtaaatgatatttacataaagccagaattaaatttgaaaacatactgttgatttgtttttttcttataaatattcggaatgtaaatgttttggcggaaatataccgtcgacctcgcataaccgttgcgtaaaaatgatgtaggcgtaacgacacgggcgatctcgcacggcaaagatgcgagaccgcacggtcttgtgcgaggaaacagctgagaccgaacggtctcgcataaggaaccaacgagaccgaacttcttgtccaacggtgccgtctaattagtgattaattacctgatttatgatgataattaatcactaattaattaaccatatgaattggcatggcagtccgggatcgccgactggttcagcggggtctcgcggtatggctgcgcaagaccgctcggtctcgcgccgccacgtactgtccacgtcctcgttttcgcgaagcgatattgataatatatttctcccaaaataattacaccccgaacaatttaaataaaaaataggtaaacaatatatttctaaatttaattccgtaaagccttgcaaaaataacacatataatgtgggatttcttcattggttttgtgcaccaaccacaaacctggaatccggatggttttgtatccagacgagacctccgtagggatagccgctccatccaaaaccgagagctcttgctcgcatcatgtatttcttggcaccactacgcttctccaacgaaaagctctggtgcaatgagagcagggatatcagtgaactgaatgcccagtactgttagtgtgaaggcaaaactggtatgaactagtctattactcccttcattttatattataggtcatttgactttttttagtttaatcaaatttatagaaaatatatagtagtatttctaaaacaaagcaaacatattatcaaaatatattcaattctagatttaataaaattaatttaatattttagatgttgctaatttttttataaacttgatcaaatttaataaagtttgacttagaaacaaaagacaaacgacttataatatgaaatgtaggaagtatctatctatttatgtatttagttgtgctattcttcttatctatctatctatctatctatctatctatctatctatctatctatgtgctatcagtcagtgaaatgaattacgaaggtctagattaaaagaacagatcatatcaagaaaagtttccaaattccgtaattgtgttttatcaatagaaaacatatattaaggttcacaaaattaatctagaaaaaataattgtccacaagtatgtgttgaaaataaaaatattcaataattttttacgtacaattttgaatacagttttaaataaataacagttattaaataatagccttgacaaacttacccataactactatatgctatgaaaattttccttttaatcattacaatttacatagaatttcaataaaatccaaatggataaaaatagttttgtaatatattgtatccacctattaatatattttgacaaacctattaattccatatttacctgtcaacccctttatttttacttataattggtcagttaagatttggagcttcagagtttaaacatttcatagaacgagattaaggcactgtttagttcctctaaaatggcataagttttgctgtttttgagtactttttgtcaaaatggatctaaacactaatatcaaaagttagcaatttagcatttatcatttggaagtctagagtagcaaattttaccaaaaaatacgttgggagcattgctctatctgtctttactagtaaaatggtaaaactttaccatgcatctaagtcatctagacaccaactaacaaacttcaatgccaaatcttttgccaccaaaacttttaccaaaaaaatttaccacagcaaattgatcttaacaggccctacaaaagaggcaatagtagtacatagtacttcctccctctagttttggttccataaggctattcccaacccaagacactagatatagtttccataaacttcacataattaagaaactaatactagacactactcttccaaacatcactattccatacttaagtttaatgctacttatctcacatgatgtcttggatgttgtgtagaaactatgtcccatgcaagacgtggtttccttctctttcctcatttattcacttgtcacctcattttttatcctaggtggcagtttatttaatgctatgacaccattctagtcattggattggaaatggcctaatgttttgaacaatgacatagtttctaaaatatatatttaactatgtttttctattatattatatagaataaataaatacatttttatttttatatagtactactatatatattgctcaagtgcctttataaactaaatatttataaaattattgatagtcaaaattataaatgtttgaccaaaccgtgttcaaaacttcaataattatggaaccaaaggtaaaaaaaaagaattaacaaacaacgcagataaggaattaaatggcttttgattaccagcttgccgccgtcgagaaggacaggcaagtcgcagaggcggaggaacatctccttcttgctctccccctcgcggccccccggcttaccgtccagggcgtcgccgtcgccggcccactccggcgggaggaagctcccccacacgtcatccgagtcggccaccggccggagcgccgcggccgccgccgccagccggcacgcgtcgccgggcgacgtcagcgaggcaatgcacgcgatgcagtccatcggcaggtcgcacatgccgctgccgccgccgccgccgccgctcgacttcctctgcatgttggatatatgtatatatcgttctcacgtctgcccttctgctgttgttgaagctgcttggcggcgagaggtggaggatgaatggcaaaatgcgggcatatatatgcatataaatgcttgttctgtggtaatgaaaataacatggtgtcgcgaccatggcgacacgcagagctagtcacctgcgtcctgtagtttctgttttcattgtaggcgagggacgaacaagcgttcttgtgttaatcacataatgacgacatcgtgtataagagcgtacatagaaaggttgacccaaccggtcggtcggtgaagagaacaaatgatgactagctaatactccctccgtttcacaatgtaagtcattctagcatttcccacattcatgctaatgttaataaatttagacatatatatctatctagattcattaacatcaatacgaatgtaggaaatgctaaaataacttacattgtgaaacggagaaagtaactctatgttaggttatatacttatggtgtactcctttttatccgtgtcactgtgttttgcaacaaaattttatgtaaaagagaagtaatgttagtatgttgttgccattattttctttttatatatatttattactgacatgtcgattctttggtcccatgactttttttttctttagacatcctcaatgtttattgtaaactaggtagtaaggtagactcgtgccatgtggtaatagtaggatgaagaggcaccacaatatatatatgtgtaaagtagataataaggtgggacccatctgaaaaattcttcaaacatgagtcatgctacaattaaaaaatagatgggaccagacataaagtgctaatacatggtagtaagtttatatttgctagttgttaaccatctccacgatgtgatgcattctgtttattacccacaatttcaccacatgtaagctctctaaccccgtatgttactagctgatttgctcgtgcgttactactgaatttttagaaaataaacttttgcattcatttttaaatcctaaaactatctacctatcaagctatacttcaccatgagtttttgatgcttactgaattagctagagtagaggcatagagctatttctgtttgattaatcataggagaagcaaaaaagtttcaccaacattatagggtccatacaaaggtgaaacacgtgatggtgatagattcagtgtcaccactattaccaacatttaaaaatagtatagcaaatagtaggcagttggtgaggttgggggtggcgaaaccaccaccactcctctgtttcaaagaagtataaataataccccttatttaaatatatatatatagtgaattatggtttggatcaacttttgttactaaaatttcagcttcgaccattttttatccaactaggaaggtagcccgcgcagttgcgcgggcatcttatttaaactatcataatttttgttattaggattttgaatatcatgacttttgtctctcggtgaaagaatttgaaggttctttccaacacatgattgaaaaaaatatataagtcagaaacatgttagaaatgcatgtgtgaaacaacgaataaatgaattttggacagtaaacgaattttttacagagtacagcaataatatgaatgttaaaatttgttaacccacatagatgaaatcatcatctttcattgcataaataaactgcagttaaccaaacaacctttgcatcagcagcttgattttctcgatcccatgcgaaggaaaaaaacatgcgcatgcatcttatttctattttattaattttattgccattgagatataccgcaactttttggatatcagctaatcgttaggtgcaccgtgcatggatacctcgtaagcaatatgatttggggattagcagatagtggtagtgtggatatacctcataagttataattgatagtatacatattaagcgtttaagcgttttagtagctttctaaatagcttatcggattggctactcccttgtccaatatatctgtaaagttcatcccactaagtgcagctaatgctaattctctcttctctcatgaagccacatcatcttaattgtttttagcccttggatgattcatcaagggtgcaaattgcatttcttctccccaaaagccacaccatacaactcaaccatttataacttttcaataattgatcaaagtacaaaatatacaagcacatgaaagaaaatcatatagtaaataagatttttttttctacagctcatatctactattttatcacacaaatctcccgcagcaatgtgcggggtacccatctagtttatagtgagaacgtttcccggactactaaacatgtaatattttatctttttctcataatttctatgattttatctaatttattatagtatcatgtatgaatttaagagtgttcataagatgtttaatggactttaacttttctatgtttatttttgcatggtatcgataggatttgaatttttcatcagacttactataatgtattcgtgcaaatcaaaagatgcaatcaataggaatcccaatcgcatactttttttcctataatctaaaggagctttgaattttaattttaaatcccaactatacttttgagctgagtacaaactttttaacggtgtattgccttttggatttcacaaaaaaaaatgaaagagaggaacatcgga

SEQ ID NO: 16396 - DNA, 225 bp, Oryza sativa
gggcacaggcgcggcacgaagccggcccggccgagccaaggcgcggcggcggaaatggggaggcggcaaccggctgcccggcaccaccggcaacggcgcgggcacggagcgcggagcgcggaggcagcgacccggtcggacggccaccgacggcggcagcgcgtcgcgaggacgcccgggaagcggccaacgaaggggaggaaaagggagagggaggggagtgct

SEQ ID NO: 16397 - DNA, 621 bp, Oryza sativa
tgcgggggaacggtccgcctgtatacaaacgcctattttcgcaagcagcccagtcacccgcctatgaaaatcctctggccggatctgggaggggaggggaggggagcagcgccgtgtgccgccaccgccgccccgcgcgttgtcgtcgccgaccccgcgtgtcgccgtggccgtccctgcgcctcgccatccccgcacgcgcgtcgccgtcgccgtggccatccccgccgaacgcccacggccgctaagggggagggagaggagagctgggggctgtgagggagaagagaggagataagacttagaaaaaaaaattgtgcgatttggcgcctatttatatgctacatcaattttggcaggcggaccctgcagatataaagggttcttttacagacgcactgcttaggtggtccgcttgcgaaaatagattttcgcaggtggacaaccatctcaccccacggttgttattttcgtaagcggtcatttagttccgagaggtctacccgccttcaaaaataaaatgccatcgtcgggaaaattggtcctagtagcgtaattttccctcactggatcaaagtaagtgcaccagaggctcacaacttgcattcaagaaggccactt

SEQ ID NO: 16398 - DNA, 4422 bp, Oryza sativa
tgacttttggtggaccccattaaatgatctcaaagctaaatggatgtttccaagtagcccaaaaactccatcacaaaattctgctttcgcacaccttgattgtgtacattctcatggagtcatggtgatccctagtgaggtcaaaagtgattgaggaaggctgatagagtattaggacaccataagaggagaggtatggtttcaatagacagtgaaggagatgatgagttgggaggagaaaggggacagaaaaatggacagtccaagtaacatagtatgtattacatcatgtgggattacagcttcttaagcaacaacgaatattgtagtataaaaataccccccctccatatgtgacatggtagttaccaaaccaagaatattacccagaaatgaaaaatactgggtcccttctgaaccataacaaaatgtatgtcaatgaaaatatgaaagagaaagatggttatgtattttaccactccacattcctcagagacttgaagctcctcgaatttctttcttttgcacttctcaaagtcaaagcaaggaacttctgctttgtgattctttctgatctccataatgttctgcggggcgataagagaatcgtcatttaacaggcactatagaacccaaccatatgattccagaaaagaaaaggcagcatgcaaaatgctgtggagtaagaataattttatcaccactattgaatgcttaatataaccaatacatatttctggcaaattaatgtcacataataattttctgtctctgttgaattaaaatcagttttgtaaatacaagaattatctggtaatgtggttgttcaccaccagattttgaaccctaaattcaagtgatctcgtatagatagaaacatggttcaagaaggcgctaggtgctagagggtcagcagagctggtgcctagtgcctagcgggcacctaggacataccaatcatagaatccaagaaattatcaagcatattacatagagaaaaatagcaacacaatagcgcccaaagtaggttagcctcctaatgcactatctaatgcctaatcgtggcagctaccaagtgcctaggcggcgccttgcatcgacttttagaacaagatagaaatttggaagcatgcttgaaatatttaagattctagtagttatgcacaggaatttgtaattcacatgataatacagaaaaggaatcaatataaaaaggaatcaccttagtaagcaaacctatatccaatgagctatactcatcatatttataatccctaacttgttcaggcttataataactctccaagcttataacttcacaaccaattatattggccatcttctgagctaaacttgtcttgcctgatccactagggccacctacaaataaacagtgtatcaacttaaacagcgacagcatagtcagtaaatgtaatttgctgggtgtgtgggtcatatcatttttgcacaagtttaacagaattattattacagaatcaatctattccatacaatataaaattcttagaagaattcttgtattcacatacatggactagtaaaaaaacagatggggcgcaaataatcgctcagtaatctgccagaaggcccatttatgtttattgtctgctttagcacacattttcacaatagatggttgttcgccataaataagggacaattgcttatatttagaagccgaactaccaaattgaccctactttttcaggtttgctcatttgaccctgtttttcaaaagcgaagccaccatctgaccctgtttttactagtccgttagggtttcagttagaaaaagaaaaaaaaataattttactcgcatgaactgaccaaaatacccctcatcccaacctttatcccacattggcgtggctggccggcgcgtggagggaccaggagcaggtgagcagcggtgctggcaagcaaagagagggacggcagtgggcgccagcgtatggaggagcagcggcggcggcttctgccgcacagagagaggaagggaggggcagcgccggcgcgcggacaggcggcggcgcctgttcgcggaggagcagcgcgccggcttttgccgcgctgagggagggacggctccagcacgtggcaggaggagcagcggagctggcgccggctgttgccgcgtggagggaggagggatgggcggcgacggctgctgccgtgtggagggaggaagggagggagggccagctccggcgcgcggaaggaggagcggcgacgccggcgcacagagggaagaggagcagcggcgcgggcgcgtgtagaggcggtggtggcgatgcgtggataagcagcggatggtgcggcgctgatggggaaacgcgcgggccggcgcttgctgtgtggatggagtgcgtggccgtgtggacggaagcgtgcaacgcttgcctggctcagccggaggcacaggtcctgcgtgaggcgctcatgtggcccacatccttgctcgctcttgctctacccacacctcctctctataccttgttctactagatctggaagttgctttgctcttgttttgctgatctgattgaataatctctcttgttttacatgtattaatttcacacttttttttttttttgctttggggtcgacacaaatttgagcttcgtgatttgcttggggcaattgttggatgtgaaatagcatatatgcttttctttcttcagcgtgcaattggatggataatatatttccaaagttttattaaaattcagtcatctttgcttaagttatcaaatctaactcaaattcacacacaatttgtcaattccaagtcaaatttattaaaactttcatcacatacaccgagtacacaaaactaagccaaataaataaaaactcagagagtatactcaaaatgagcaggggtataaacggcatttggcccctaagttaacaccgttaggttggcctgatagaatagggtcatagctaatgttcatttttgaaaagcggggtcaaataagcaaagttgagaaaatagtcaaactggtagttagctttcaaaacagcgtcaaacgtgcaattgccccataacttaaatatattacaaaaaaggcatgacatgtagccccagcaactggtacaacaaacccacagagaattgtaatacaagttaatcctaaaataacaggtgtataggaatagattaggcacaacctatcaggcactcttttttgcacagcaagcataccattatagcacattaaaaactggatcatgtgaaatttggagatatagatgctctgatatcactttaatgaaactggtagtcattgcaagtgagacttgtcacaagggatatctggtgcagatgtctgactaaatgattttaagttgccccagcaaagtagagtgagttgttttagttatttatcattcacagcaagcagatgcttggtcttagtaaacacaaaactactgctactttattaacggtaaagatgttattaccaatcccaacaatgacaggaaatcctttgttctccaacaatgcctgaaagacaacaattaatggaatatgttacagatcagtaatgcgtaactgtgatgaaaaaaatagaatgtggtttcatttacctgaattgcttgaactgataggagaagacccctatctaagtcataggagtctggcagtggagctaactggatgttacttcctgaagaagaatctgcaaaagtgtaagaatatattcaatggattttctacagaaaaaataataaataaatatggtttccaatgtactccgtaataggcatggttgggattagggcacttgcgcctatttctagttgtgtatccctggacccaagtggcagcggtgccattgaggcagccacgccacaagggcaggagagaaggggaagactaaatactcttgtttattacttgcttgatgagtaaaatacaaaccccgtcatatagatgtgttagcttgaccattaagaaacctatccctagtattaagaaaataactaacttataagtctaaccttatctctaataagaccacctgacatgaactatccacgcacgaaaattaaccaagtaggtactattaatgcacagtaccaccagccctagagaggcagaccactctatgggccctaatgggctgcacatgatatccaatgacaagagaaaatgccctttgttttagcattaaagaacagaatatgcaaggcaaaaatcataaatgaaagcacaagtttaaaaccttgattgaaatgccattttcccataacaggctcctggtcaaactttttgggtggagacctcgtccatggttgtgcaaagtcatcaaaatttgcaacattttcggtcgaaacacgaattggctttggtgcaacaatttttttttcttgactttcagtcagtaattt

SEQ ID NO: 16399 - DNA, 5527 bp, Oryza sativa
ggcctatcagtcgatcggctatcggttgactaattgtagcacgagttccaatatagtatgtaagagagatgggtggattagatattaatgatgcagtatatatctataactaactattgtataagtggctattagattggctatatatgatatttcaattttgggagctagtagatggctatattattaaacttgctctaatctcacctcttcgtctgtctagatttttaccccagctagtgaaatgcctctaatttgttgtggaattaagaaaaaaatgggaaaaagtgttccatatcatcacaagtttccagttttagtttgatagcactgaaatttcgtgttgcactttaataccgttagagtttccaccgttactcttcctactactaccattaaaaaagcatcgtgaactttcgatggtataaaattaaacttgaaaactttcaatggtatggaacaaatttctaaaaaaatatatttatatgaaacatcagcatgttacaacgaataaatgtattttgaattttaaattttagaattaggtagaggtttttttatcttcttatatcttagtcataaaaaaactagagtaaattgcacccacggtacaacaacttggcaggtgggtgcgattcagtgcaagaacttgagaattaaacgtccgagtgtaacaacttgacaagtgggtgcggtttagtacaagaacttgacaatttagtattttggtgaatcaatttagctaagcatatgctaggtgaggtttttcacgatgtcaatatgccaatacacattaatcctatggatattaccttataatattgaatttaatctttaagaattatattgcacatacaatttacattcagttacctttaagaattttttgttttcttcaccttctcaaatatcaaccgaaatataataatttctacatccagtttaattgactttcagttattagctattagagttattagttattaggataaaaatataaatatgtttatacaaatccacgctagtatattgtcaagtacttaaaattttgaatttatataaaaaatgctccaaataattaagttgtcacaacttcttaatttattgtatcaaaatcgtacctaccttacaagttattgtatttatacgatcacttataaagttcttatactaaattgcaccttcttgccaagtggttgcactagaacgctcattttttaaattattataccaaattacacccacctaccaagttgttgcactgtgagtgcaatttactcaaaaaactataatagactcagttgaaactcgtctttgccggattgccaagccacagggctaggatatcaaattaatccataccttagcaaaataaaagatgacacggtgtcttttgttttattttaacttcattagaatatgttttatattcagtaacgccggctatttctaattcaggatacatactctatgtcccattttggttctgattaaggtgcagattcttgaggccataatagtataaccagcgatggattagaactgaacttgaaaaagttaaggtttagcccgtcaaggatattatatgggatgctcaagctatagaacaatacaggtaaaggttttcatatatcttatatgtagtgtcgtgtgtatgaaaagcgaaatcaaatttggattggagtcaaatttccatatggcacactctaaattattttgtttatatattttcatgcgacgtcgccaactctcttggtgggcgtccacccgtgcgacatcgccgtggctgaaccagaaggccaccaggcaatcggcatcagacccggtgatgatgtctgctcgacaaccttagccgcgtgtaagttttttaaggctatatgtttgtagtgactatctatatatatttgttgacaaacaaatttgtcagatgtaaatatgatataatattagcgtaattacatgtaattataatttgtgaaattgtatataactttccaaatttctgtgataacatgttatttccgcgaagcggttgtcgtggaaccgaatcccctcacccataagtgtgcaatgatttttttcccttctcaaaattttgaaacaaatccgatttaaaattatatgaaagttatattatagttacaatataattacagaattatgttgtatttacatttgacaacgacaaatgtgcaaaatcgcttttgtattttttttccgctatatccacacaaacttcacaccgtttctgcaatgctgatatactaaagttctctgcatattggccgtttctgcagagcaggcggtagattatattgcgctggatgaatggatccaacgctggtatactgcatagtgcatacatattcttctctaacattactatggcaacttgtactgatgtgctttgacctaacattacatttgacaacgataaatgtatagcaaaatcgcttttgtatttttttccgctatatccacacaaacttctctgcatattggccctttctgcagagcaggcggcagattatatttgcactgaatccaacgctgatatactgcatacatattcttctctaacattgctacggcaacttgtactgatgtgctttgaggtaacattattttccgacattttcattgcgggatataatgaacgaacaacatgcatattaagaagctaacaattatcagttataataacaatatgtaatcaaactgtttcacgatccagattaataagcattgatattcaaattaagcgtggtcttcctctataggatcgatcttgcaaattactgcgattttacctttcttttgtttcttgaatagagagactcgaagccaattttctttcatctctggttgtttccattctctaggtaggatattgcactgcacccttctcagagtataagtccaaagccctggatgcaataggagagacagtccacgatcgtacacggctcaaaacggtccaaccgtgtacgttcgatgcttccatctgcaaggctataccgttctaagtttccacagtatccgaagtagatggtatcagcagcgacaaatggtaaggtctccgccgacacggagatcgcgcgggacatgctgatgaacagggcgcgccagttgaaaccctttaccgggacgaggatcccggcatcgaaatccaccctccacgcctcgtacttcctgctgcgctttgttctgtagctaccatcgtcatgagcataatggtctggccaaagcatccgctgcaccagaatcagctccccgccattgtcgaccaagtgaagggtgctctgcagcgctcggctggaatggatcaatgaactctcaatcgccatccgcatctgcggcggcggtttccggcgatcatccgaagcgatatcgagctccattattcccctgtcggtggcgcggtagaagcgactgacgaatggcagagccgcgggggaggtgttgtacgtgctgttgttgttgtcgtctattaagttgcatgcaccagccagttgcacctagaagcctaagctgatagggaaaggcggacaattcactttatacactccaacactccccctcacgcgagaccccctcaagtctcaagcgtggaatattggagtgtgctgcaattattttatttaattgcgcgccagccaggatttgaactcgagacctctggctctgataccataaaagtgtgataggctcaacacgatagattggattatcacatatggtagagtacatataggcacatgccttccatatctagcaaccgatttatagaaacaatatcggagaagattaaggaaggatggcaagggataaacacaatctaacacccccgcagtcggaacgtcgtgggaacggacattcagactggaccgaaactccaagaagatggcactgggcaaccctttggtgaagatgtcggcaaactgtgacgtagtaggtacatgtagcactcgaacagatccggcagcgacgcgatcgcgaacgaaatgtagatcgatctccacatgcttagtacgctgatgttgcaccgggttagaagagagatagacagcactaacattgtcacagtaaaccaatgtggatcggctcggaggggtatggagctcatgaagaagctgtcgaagccaccaccgcgttggccacgacacgatattctgcctcggcactggagcgcgatacaataagctgacgtttggaggaccaggagaccaagttgtcgccaaggaacacagcataacccgaggtggatttcctggtgtccggacaacctgcccaatcagcatcagagtatgcactcaagtcaacagtggaggagcggcggatgtgaagaccataatcaaccgtgccatggacataacgcaagatgcgtttgagagcagcaagatgaggctcccgtggatcgtgcatgtgaagacagacctgctggacagcataagagatatctggcctggtgaaaatcaggtactggagggcgccagcaagactccgatagttcgtgggatcatgaactggggcaccatcagcggcagagagcttggcgttggtgtcaacaggggtagcacatggcttgcaatctgtcatgccagcacgctccagaaccttgaggcagtactggcgttgactgagatgaaggccagaggactgccgagaaacagagatgcccaagaaatgatgcaagctgccaagatccttcatcgagaactccgactggagagcacggatggtccatcgaagaagtgcatcagaggaggctgtcagaacaatgtcatcaacatagaggagcaaataaaccgtgtctgatcctcgatggtagatgaacaaagatgtatctgattttgcctcaacaaagctgagtgtaaggagaaagctggcaaaccggctggaccatgcccgtggggcctgcttgagaccatagagccgcataggccggcgggaggaaggcttgctgctgggccggcgcgggcgtggtggtgaaggctgtcccgacgaagttgggccgcacgccaaggaggcctagaccggcctggcccggccacatgtggattctccctgtccatgggttgtaggccgtgggccaggcctggttggcccgtggtgcagtctatgcgccagggctgccctgtgcgacgccgctgtgtgcttgtccgccgccgccacttgcgccgccgctgccattgctcccgccgccaccaccaccggagccatgaccacggcgtcggttgttgttgcgggagttgttgttggaggtgttggtggaggtcgccgagcgagcggtggtcgaggaagcagcgaggaaggccgtggcagtaacgggcggccggtggcctttcgtcagctcatcgaggagaagctgtgcgcgagccttggcgaacgtcgggaacaggacttgcagaggcaagagggacttgaggttgtcgaatttgtcgttgaggccgccgatgagggtgaggatgagagaccgatccttgacaggttcaccgacgtcggcgaggttgtcggcgaggacctt

SEQ ID NO: 16400 - DNA, 32481 bp, Oryza sativa
tccatctgtgtccagtcggcgtgatcgggccgaggtacgtcgaagaagacatgatcggtgagggcgtattttccaagcgcgatgaggaaaaggcctcgccagcgggagtagtttttggcgtcgaggtcgagggtgacggggacgagcgccttcacgttgaggacggcgacggctttgctgtggaggttggcaacggcttcggcgtcaagcgccgccggtggcgcggcggcgtcctgcgtgggggcggccggcgtcgtggtgatgccgagacgggcgagaagcgccaggatctcggggggaagttgcgccgcgggagccggagtggaagccggtggcggcgggatggcggtcgtcgaaggcgcggtcgtcggaggaaccggtggaggcaccgtggaggagtcgtcggaaggagaccgaggataacaggggcgagggccgcccgggccacggtcgcggcacgatcggtggcgtcgccagcgacggcggtggtcagggtgtcgtcgtcctgaccagagggagccttgaaggaggagcggacggcatcggcgatgattttgatggtgtcatcaaggacggcgtcggcagtgagggaggagggaggagaagccatggcggcggcagggtgcgccggccggcggctggggtggagaggaggcggaagcgagaaggaacctaatctgaggacgcccccgtcgatcaaccccaggccaggaacgtcccctcttggccacgtccgtgtgtccagtgccagcgcatgtgccatgctgtatgaccactcccggtccacaccaaccatactcccgtgaaaccgcgagagtcagctctgataccattttgtaacgacccgcctttcccaggctaggcccacttacatctggtagctttcataggtcataagactgtcctcacagaccaacacaagtcttttctacgcactttgtcctcactcatgcgcactcgggaagaattttctggtcggtcacccatccttaaattgctccagaccaagcacgcttaacctcagagttctttagagatcggcttccgaaaaagaagttgcaatttgttgatatgagtattctagtaatcctattaagccctagaccgggatgttacaccctcaccccttacaaagaatctcgtcccgagattcggaacggctagaaagaaaagggcattggtcaactgcagtctatcttattccataactatgataattattctaaggctttaaagaaaactactgctgctttgagactggtggctgagctgtaacacttgaagatgcaactggcactacattggctcctgtgacgacaaagatgtcgatggggtctacttatggaggccaagtcaagtggatcgagggacatgaagatgatggtcgaactaaagtgtccagctgtcaagatggaatgaagtttggatcctagcttagaacctaaaccaccaaattgactttgaagaatagttagtagggtagaacgtttgttgcttgcttgtgtgtaggtaaggttgcattcccatcattggtgtagttcaatgatgagcgtgtaactatattaggttgcttgcttaatcaacttaaacaatataatggtttacacacactagatcaatgttaacatggttaaggtcttgtctttagtgtcacccctctccttctatcttctccaaacctatagcagatggtgaacacttgcgctagtggaagtggaaacaataacaatgatgagaacccaactcttgctcaagttctagctcaacagactcagttaatgaacataatgatgcagcagatgcagaaccagctcaaccaagggaacgacaatcctccaacgccacagaacaagttagctgacttttcttcgtgtgaggccgcctaccttttctagcaccaccaacccagtggaagtaggtgattggctatacactattgagaagaggttggaattgctccagtgcacagatcaggagaaagttgttttcgcttcacatcagttgcatagacctgcttcagaatggtgggatcacttccggatgaacagagcagaaggacaaccaatcacttgggaagagtttactgaaggattcaagaagacacacatacctacaggagtagttgctttgaagaagcgtgagttcaggacattaaagcaaaaggatcgtaccgtgacagagtatcttcatgagttcaaccgtctagcacgttatgttccagaagatgtgcgtactgacaaggaaaggcaggagaagttcttagaaggcctgaaggatgaactatcaattacgttgatttctcatgactatgctgatttccaagagctggttgacaaagcaatttgacttgaagtcaagaagaacaggatggacaaccgtaagagaagactgattgttttcaaggaagcacagggtactagccaaaggcagtgtatcaagcaatcccaagttgatgaatcaagtctaacatctcaagaacagtcgcaacagttgaacatcggtgatgagatcaattcagagactaatgcaagcaatgaagttaacatcaagcaagctactcaatcagtgccagttcagcagaaccagtctcaagaaaataatagtagtggaatggaagggagcagcaggtatgtttcaactgttacaagccatgtcactttgcaagagagtgttcgaagccaaagcatcagcagccgcaaggtcaagtcaacaacattgtcgtcacaggagccaatgcagtgcaagttgcgtcttcaagtgttacagctcaaccaccagtttcaaagcagtagtagttttctttaaagccttagaataattatcagacttatggaataagatagactgcagtttacctatgcccttttctttctagccgttccgaatctcgggacgagattctttgtaaggggggtagatttgtcacagcctgaattttcgtttcaagatttataaattatttaataaattattaatagaatttatattaaatgttcattaatttacaagtgaagtgaaatgtgggaaatcaaatttcctaattataaagcatgggtggatttaatttttattaaattctccatgattaattatactctctgaaattttctcggatttttcggagctcaattattaattttaataatacaaagaacatttcagtaattattcacatattaaattaatcattaatgagctggtttcaatgtttttaaatacttagggtgtccaagtatgttcaagatttttcttggaattatttgaccattggaagtatttttaacaatcgaaagatcatcttattggttaatttatttggaaaagtaataaaatcttcatcctcagcttgggcccttttcagcccattctctcccttcctctcagcccgcagacaagtctgcttttcgtccctctcgctacagtgttgtcttcaacccctagacagagccgactgtctccagcccgtgcacagttgccgccgcctcctccttccaaatccggcctctccgttgctcctttttccaaattagttgtgggaatggaatcctctcaatctcctcttccttttccccaagaaatccccaaaatttctatggaaatcctttccaatttcgcggatcaatctttcctttttccggcgaagatcctaaactttcccgagtttttcccgtcgatttgggcccgaacccgagctcctgtgcctatataaaggaccccctcgtcgtcctctacctatcccctcaagttccatcttccgccgtcgtcggaatcgctctccccgcgctcttcttctctctccaagcgccggcgccgctccagccgcccctagccgtcgcttcggtcgtcgccgtcggtcgccgtctccttcatcagcatcgcgaggtcgtcgccgtcctcgtcccgtcctccgtttccgccgaagatcgccagagcgccgctgacactgtcaacccgaagctcgccgccgcattttgatctccggcgaggccactgctgctccttccgtcgtcgccaagctttgccgtcgcctccattggattcgcagctgcgaagtgaagcccggccacccctccgttgttgccgcacatcgccggaaagtcgtcgccgccgtggacagtacctcgccgcccttcgaagctcgtcgccggccatcttccgtcgctgtccgtcatcgcgtaagtgttggtaaggaccgtcgtctcgtgctcttcctcccggtgccctccgtttgcattattgtgccgtggttcgccggcaaccgctgcccctatgccgttcaccggtgtaggtttttccctagggtcttaatccaacataatctaatccgtgatttgtctagcgttgtcatctccgtgtgttgtagccggaccgtcattgtcgaccctttctctctgatcgctttggttcggtgagacttctatccgttctcttttttcagtggcatattatttctttttaatatatgccatctactaaatataacctaatcttttctgaatgttgctttaatcttttcttaattataaatcatttgtaaattgtttaattaatttggaatagttttttctttaataggtttaattggaattaaatcttataaaattcataagtaatttatatgaaatcggaatgaggccgttcaagtctcataattcatctaaaatcatgatctacatgtttatttactttatatgtattgtttatttggtttttattagtctttttccttgttttatgtgttagcttgtcgtttcgaaggatcgtgagtgcgtcggaagtgttcaagaagattaattgaagaccgaatattgcaaggcaagtcacatagatcccaaacacaattcctttgagcatgttgatcctatatttaaattctctatttatttcaagtatacatctattttcgaatgtcaccgggtggtgtgaacctatttctttgttatggccaatttacattgattatcctatttcttgattacctcggggtataatttgactagttgtatttatatattggttcaactagatacattagatataattgcttagccatgtttagaaacattagcacactattgggataactaatgtttcacatttacttaatgataactaatgttttgctattacttaatgattggttaattaattaatgtgccaactaaaacttgataatggtgggttgtgagcacatgattttgatggtcgtgctcatgacaattaaggaccggttcacgagtttcggttgtgaaacattaaccgtgccaaacacaagccagcataggcaacggctggacactttgtatagcaaggctcattgtggtgtgccagactgagaagtggcggagataagcccacgggggtcgctggggagtctatgcctttggtttttgagggggtgactacgatccaggaaaggtgcgctgctttgagttgagctatgcgaggggtcttgtcacaactacacaaatggtgacatgttcagcatgggcacatgatgatatggtgacatattatggagttgtgtcttgtgggtacagtggtacacctctggccagagtaaaactattcgaatagccgtgcccgcggttatgggcgggtctaacaatgtctttcgtgattagtctcacactactcattaataataatgtggtaattgatggtaattaatttagctcctggtttggaatggtacattcctggtttagagatagatctgtacagccgtgtatagttgttcaggatggttgggcctgtgcagcatgggtgtgcagttcagtgttaattaatattgatgattaattactctactgttttagaattctcaaatgttttgctaaatgctgcttttgcaaatgagctatatattatgccattctttggtatccttgtgcacttgcatatttgttgtgtggcttgctgagtatgtcatatgcccacattgcaataatcaatcgaacctcagttgaagacaagttgcgaaggagaagacgtttggcttgtaccccagttgagctacttgtggtagtggatgtcacgccctgaagtttccccctttttccttgctttaaaaatttgttaaataaatcgtccgaagaaattgtcttaattaacctagagctaaatccctaattaataaaggcatttaataattggaattggcaatgtgggattttccttgagttccacatgtcacaatacattaacaggattgatttttagtgaaattttcagagccttggaaataattttaaccaattaaaaatcaccaaagtgcaattttaaatcccaggaaaaatcctttcccctttttccctttttcgcttttcttttcctctttttccatctttttgggccgtcggcccagtccaccccccctttttctcctacccgcgctcggccttcctcttgttgggtcagcccatgcgcccctccctcctctctctgggacgccgataggtgggccccacctgtcggtcgtctcccacctccggccgttggagccggagctccaaccgctgccgccgaaaccgccgcgccgccgcctcctccgctcctcccgtgcccacgccgcgtcgctcccgcgtcctccccacgtcgccgccctctcccccgcatctcccggcccgcgcgcgcgctcgctaggggcgggattcgaatttgaatccccccattctctctctctccacccccacgtcgccggccaaatcggccacctccccggccacgtccgccccctcccgcacctataaatcgctccccgcgtccccctctctcgtttttcgcactcgctgcgcccttccgtgcttcctatcctcgccgcgccgctcgccccttgcgccgccgcctaccgccgtctccggccacgcgccgccgccactatagccaccaccgcgccgcgcagtcgctgccgtcgcgctcaccgagcccgcccgcacctcggccgccgcttcgttgccgcaaatcaccgccggagctccgattccctcgcgtcgccggtgagctctccattttcatccatctccggccggccactttggccgccgtggtcgctctccctactcctaacccctcacctccccttctctaggtgccgccgccacccgtccgccgtccgtgtcgccggtcgtcgccggccgccaccgcctcctctggtgaggactcccctcctccctccttccctatgtgccgcacgcgccgcagctctctgtgctcgccatcgccttcggccgccgccgccagcctgtgcgccgtccgccgccgcctcccgcaccgccgcttgttgttgccggcgctcgcgcgccgccgccggtcgccatggccgccggtcggcttcgaagccgagccgagccaaccgggcacccttcctctcctcttgtgccgctgcccggtggggcccaccagctggtggaccccccttttagccgctgccggtggggcccgcgtgccgtcgccacctcccccccttttagagccgctgacccatggggcccacttgccggcgccgcccccctccttggctgacgtcagccctgggtattattgcgcaataaattgattaaggactttttctttattagtaaaaacacagttttatcttctaaaattcataagtaattcatccgagctccgtttaagtccattcaagtctcagtaaattcataaaaatgcaaagaatccattaaaaatggttttgtttcctgtttcattagtcttatagcatgttttgcttgtgtactttgtttgtcgcgtagatttcggccgtttcgtcgatccgcggtttctcgaagacgttgctgaggtctcatcagtgcgagagcaacgcaagtcatgcattacaattgatcatattgtacccaatttacaaatatcccgcatttctattaaatgtcgcattcttttacaatgtcatatgggatgggtcctattactcagccatttattgtttaccatatgccattaataacttgggtatcaaaatgattagatgttggtttaggaaatgcttagccatgcttagctccactagtacacaaatggggatcacattattacatagactttgactatgagcatagttttggattggtgccaccgcaatggtgttagttaattaaaatacactgaatggtgggctgtgggtgcatggttttgctggtcgcacccatggcaattaaagaccggttcacgggaaaccctgggagacttaccgtgcttaccacaagcgagagtgggtaactgcttgatctgaagtatagctcgaccctttcctaggcaccggtggcgagggtgggcgtaatggagttgggtcggccagggtgtccggttgtccagctgccagattcaccgcggcgcaagaggggaccgcccactgcccgttgggggtggaggtgaaaccttagcgtggtgtggatggttaggggagggttatgcggagggtcttgtcacgatttccccctttgcagtattatggtgatacttcggggcatggtgacatgtgtggaatcgtgtcttgtgggtacagttgtacatctctggacagagtaaaactattcgaatagccgtgcccgcggttatgggcgatcaaccagattcaccgtgattagtctcacccctagtttagcttaatgaactagtgtagttcaggtggttggttgggcctgttgcaacgtggtgtagcgttggacagtgattggttaatattgattaattactacagttgttttactgctttcaactactgcttttaaatgctagttttatgcaaaagaacccctagcctcctttggttatatcctgcatcatacctcctcttccggtatgacttgctgagtacagtgggtagtactcagtcttgctctcttttcccccacaccagagttgaagttcttctcagttggagctgtctcagaggggttggtttcgtcgctgccgtcaaggtttgcctatggagtggagtcgcccgctgctgaagtcaagcttccaaggctagctcgttttatcttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacagtggagccggagcttcgctagatcgttattccgctgctattttctcttttcatttgtaagtatgtaacgttgtattattgatgaatctgtatattaaattgtcagcttgtgtacctcggctgattcctggacgagggttttatgcacaaattagttcggaaattactagtgaatttctgggcgtgacaagttggtaccataataaatggcgtcgtcgtcgtctccatgtgttgccgccggttcaccgtcgtcatctattcctctccgatcgctttggttcggtgagacgtctatccgtgttccctcggtttagtttttaatctctcgtttgtgtcgtcgagtagccgccgccgtgccacgcttagctgctgccctagcgtcgccactgcactagccgcctagtcgtcgctgtgccgctccctgctacagccgtgctgctgctgctcgtgcgtgacaagtcgctgccgtcccgctaccgtagccaccatctgccgtcgctgtgtgtcgtcgtcgctgtgatgtcgccctaacccgagccgcgtgtctccgccgagtcaccgccgcctggccgagccaagtcgccctagtgccgccgtgtcgcagctgtgtgccgctttaacctagccgccgctttaaccgttgctcggtagtcaagttgtctagccgtaggtgcatccctaaattcctaccggcctatcgtttgccgtaccggggctttaccgtgaatcgtttctagcccaccggtttagccgcagccattgttgagtcgttcgctcgttcgttcgaacgaggtgttacccgtgcttcgttcgtttgtccgtgttgagtcgtcctttagtttagagccgtttagagccgccggttccgttcgccggtttcggttgatcatttgggtaatcccgtgtcacgtagaattgactcgttgagtcggtatctcgtgaggctcgcttgccagatcaatctaagccatccgttgaatcttggtcaactctatgtcaagattaatcttagccctccaaaatcgatataaatatgttctctcttttcagtggcatattatttctttttaatatatatcatctaccaaatataatctaatctatttccagaggttgctttaatgttttatctcagttataaatcatttgtaaatgatttaattaatgtggaatagtctttttctttaataggtttaattggaattaaatcttataaaattcgtaactagttcatatgaaatcggaatgaggccgttcaagtctcataattaatctaaaatcatgatctacatgtttgtttactttatatgtactgtttatttggagtttcttagtctttttccacgttttgcgtgttagcttgtcgtttccatcgtttcgaaagtccgtgagtgcgtcgggagtattcaagaagattaattgaagaccatttattgcaaggcaagttacacagatcccaaacacaattcctttgaacatgttgatcctatatttaaattctctatttatttcaactgtgcatttattttcgaatgtcaccgggtggtgtgaaactatacctttgttatggccactttgcattgattactctgtcctttgataccttgggttacaatttgactagttgagctttatatattggttcagctagatatattagatataattgcttaggcatgcttagaaacagtagcacacgattgggataactaatgtttcactattacctaatgatggatatttaatcatagctcacgatggctaatcgtgattggttaattaattaatgtgccaactaaaacctgataatggtgggttgtgagcacatggttttgttggtcgtgctcatgacaattaaggaccagttcacgagtttcggttgtgaaacattaaccgtgccaaccacaagccagcataggcaacgactttaccttttgtatagcatggttcattgcggggcaccagactgagaagtggcggagataagcccacgggggtcgctggggagtccatgccttgtttataagggggtgattatgatccaggaacggtgcgctgtggtggattgtgttgtgcgaggggtactgtcacaactcctttcagaggtaccgtggtggtattgaggcgcatggtgacatgtcgtggggctgtgtcttgtgggtacagtggtacacctctggccagagtaaaactattcgaatagccgtgcccgcggttatgggcggggtctaacaatgtctttcgtgattagtctcacactactcaccataataaatgatgctatcactggtaataattcatggtatcagattaggttccttctcgcttccacctcctctccaccccagccgccggtcggcgcaccctgccgccgccatggcttctccctcctccctcactgttgacgccgtccttgatgacaccattaaaatcatcgccgacgccgtccgctcctccttcaaggctccctctggttaggacgacgacaccctgaccaccgccgtcgctggcaccgctgccgatcgtgccgcgaccgcggcccgagcggcccttgcccctgttctcctcggtctccttccgacgactccggccgccgatgacgccatctcctccacggtgcctccaccggttccttcgatgactgcgccttcgacgaccgccatcccgccgccgccgacttccactccggctcccgcggcgcaacttccccccgagatcctggcgcttctcgcccgtctcagcatcaccacgacgccggccgcccccacgcaggacgccaccgcgcaaccgccggcgctcgacgccgccgcaccaccgccggcgctcgacgccgaagccgtcgccaacctccacagccaagccgtcgccgtcctcaacgtgaaggcgctcgtccccgtcaccctcgacctcgacgccaacaactactcccgctggcaaggccttttcctcgtcgcgcttggaaaatacgccctcaccgatcatgtcttctccgacgtacctcgccctgatcacgccgactggacacagatggactgcgtcgtcctcagctggctctacggctccatctcctctactcttatgcaggaggtgctctctcccacggcgacggcatgctccgtctggcacagactgcaccacgggtcaaccaggcctggcccacggcctacaacccgtggacaaggagcatccacatgtggccggtccaggcctccttggcgcgcggcctagcttcgccgggacagccttcaccaccacgcccgcgccggcccagcagcaagccttcctcccgccggcctatatggctcttcctaggccggcccagtacactgcaccaagcacggcgcctccaactcttgttgccgctgtgcaatctccattccagtggacggggccctcacagtgggacccacgggccctcgccaacgcgtacaacacggccacattaactactccaccgtccaatgaatggtacatggactcaggtgctacttctcatatgacgtctgacaccggtaccctctccacttcccaaagccccacccgcaatactccctctcatactattgttggcaatagctcccttctccctattacctccgttggtcacgcatatttacattaccccaattcttcctttgtgcttaacaatgttctcatttctcctgagattattaagagccttatttccgcacgccgttttacttgtgataattggtgttccgttgaacttgacccttttggcctctctgtgaaggattacccaaccaagatcgagatcgtcaggtgcaatagttcctgtgctctttatcctctcccggcagatgcgtactcctcggcggcctccactcgtgcctttgtcgcctcctccaccaacaccgacctatggcatcgccaccttggccacctcggtcatgaggccctcacccacttggcgtaggcgtctgttgtcacaccccgaagttttcctcccaagccaaattgtaaattacaaatgaccccaagaaaatgcagaggaaatcaggataaaaccctaagaaaacaatgcaaataataatcggatttgacatgtggaatttttcttgaattctacatgtcgaaattcattaacaggatttttagtggaattttcagagctctagaaataattttaaccaattaaaaatcactaaagtgcaattgttaattccagggaaaatccttttcttctttttcttttccctccctttttcctcctttttcttttcggatgggccgccggcccattcccctccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgtctccgccttctccgggccacgtcgaccacgcccgcgcgtgcgccgcattccccgcgcccgttcccctctctctcccgctcgcgcccgcgcccgagatggctgggattcgaaaaccgaatcccgcctctctctcctccccactcccccacgtcggccgtcgaatcccgccgctcccggccacgtccggttcccccatcccctatttaagcatcgccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgcggccgaggtccacctcgtccacccctcctccgtcgaggttcgtcgccggagccctcatctccacgcgcacgggtgagcgccacctctaccgccgccttcggccatggatcccgatcgccatggtccatctctctctctctaatccctctcttctccttccttagggcacgccgaagctcgtccgctagccgacgccgtcctcccgtggcttgccgtcgccgtccgccatcgccttcctccgcgccggccaccctcggtgaggcatcccctcccttcttttccccttcctctcctcctagagccgctagccgccgcttcgagtcgtcggccgtcgccttcgactgccgccgccgtttcccgtgccgccggtagccgccgtcgtcgcacgcgtgccgtcgccgtttaacccagccggccggtcggctttgatgccgagccgcgccggcggccgcatttaccgcgcgccccggccgcgaggtccccgtcgccgtcggttcggccgccacgtggcgccgccgcccctccttttccccgtgccactgaccagtgggcccgcgcgccgccaccccctttctctctctcccggtcgctgaccggtgggccccgcatgtcggcgccgcgccccctcgctgacgtcagccctggttaatattgcgcaataaattatttaaggatttcttttatagtaataaacacagtgaatcttctaaaattcataactaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccgatccctccgacgctccagtgtacttcgagatagtcgccgaggtccctccagcagcagagcaaggcaagtcatgcttgtcatttgaacatgttgatcctatattgcaaatgctctattgttttctttcaaatattgcattgttttataatattactatgggatggatacctattgttacagccatgcttttggatatcatgctcctttgttagcttgggttataacatgattagactttggactaggaattgcttagccatgcttagttcaactagcacacagtggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgcttaattattacaaccgttttcgcattcaattcctgtttataaatgctagtttttatgcaaatgaaccactctagctcttctttgttaattccctgcatcatacccctattccggtatgacttgctgagtacagtgggtagtactcagtcttgctctacttttcccccaacctcagagctcgagtatgtgtccgatggcgggttctccgaggagtaggcttcgtccgtgccgtcgaggatgcctgtggagtggtgttcccgctgcagttcaagtcaaggcttagctcccgtttcttttgttttccgctgcatttctgtaagacctttataatgtttgtaagacgtggatctgtatgtcaacattgtcgtttgtgtaccccggctggtcctggacgggggttttaatacacattctgcttggaattctattcgggaatttctgggcgtgacatctgtcatcccaccacctaaagtcactacatctttatgtcatgcttctcagttaggtcgtcatgttcgtcttccttttcccactagctctagtcgggccaaggcaaattttgatttagtgcattgtgatttgtggacatcacctattcctagtgtgtctggttttaagtattatcttgtcattcttgatgattgctcacattatgtgtggacctttccacttcgctttaaatccgacacattctccacattatctcatttttttgcctttgtgaagacacagtttgccacgaccattcacagcatccaatgtgacaatggtagggagtttgacaattcctccgcccgctcctttttcctcaccaatggagtctccttgcggatgtcctgccctcacacctccccacagaatggtaaggccgagcgcatgcttcgttccttgaacaacatcacccgctccttgctcttccaagccaaccttcccgctccctactaggtcgaggcccttcacaccaccacacaccttatcaaccgtcatcccaccaaaactcttcaacaccacacccccttttttgccctatatggtgctcacccgtcctactcccacctccgcgtgttcggctataagtgttatcctaacctcttcgccaccgctccccataaactagccccacgatccaccccatgtgtgttcctaggctatccctccaccataaagggtatcggtgtctagaccttaccaccaacaaggtcatcacctcgcgacatgtggtgttcgatgagacatgttgtaacgccccgattttcgttcgggaataaaaatcaattaataatacattttctagaaattaaataaaagttaaaccaatttaatcaagtggaattatagaggaaatttgaaattttcctttaaaaatcattggtcgggaatattttgtaatattctttgcgccctaatgtactctccagaattttccgtgaattttcggagctcgagaaatagttttaatagcacaaagatcattgcatcaattaaaataaaaaaaaacaattaaaattccacttcctctctttgggcctttttcggcccaagtcttccttccctcccgcggcccgcgcgccccttttctctccctctcgggccggcctcctccctcggcccgctcggctctctctctccctcaagtctgctttacctccctcgcccgttttcccctctctctcgtcccacctgtcatcttcttccctaacctcccgtcaccccaatggccgtcatggccgccggtttcgccccacgacgccgcggttcccgcgcttcaccccgccccacgagcgcgtggaatcgatcccctccacctcctccacttttcccccactctccccgcgaaaatcggcgccggttaacccctccaccaccccacgtcggcgccccacttcgccggccgattccgccacgtccggcctcgatcccgccttcccgagcccataaaaagcacccccgtgctcccctcgtccatttccccttgtttcccgggcccggcactctctccctcgctcttccccacgccgctcccgcgcgccgccacactccggcgaactccggccgccgtttcccgtcactagggtcgccgccgccctgctccgccgccaccgccagctttgccgccgcccgggcaagctcggccaccgctccatttcccctctccacctccgtagcgccgtagccacgcgaaccacctctctccgctgccgcccccgactccagccgcgtcgcgccgccgcttcggtcgacgccgacccgcgccgttgcctccctcagctccgcaaggacgaggaggacctcggccgccgcccctcttcgccggaaatccgccggagctcctccttcctcggtcgccgatcgaggccgagcccgtccgccccatcccgagcgacgcccgtcgccggagctccgtcacgtcgtcttcctgaggagccccgtcgccaccgttccttgccgtcggccgcccctttgccgtcgtgcatctcggtgagcactcccctccctctcccttttcctccccttcgttggccgcttcccgggcgtcctcgcgacgcgctgccgccgccggtggccgtccgaccgggtcgctgccgccgcgctccgcgctccgtgcccgcgccgttgccggtggtgccgggcagccggttgccgcctcccccttgccgccgccgcgccttggctcggccgggccggcttcgtgccgcgcctgtgcccctggctgccgctcccctcggccgcccgatcggctcaggccgatctgggccatccacgtggtggacgcgcacccgaggccacgtgtggaccatgtccaccgtgcgccctccccctttgactcgctgacatgtggggcccgcgtgtcggcgctggccgcccctttgctgatgtcagcgaggtccatttcctctgtaaaaataaataataattgcgcaataaatcgagtttaattctagaaattcatttaaatggctcaaaacttctaaaattcatatctaattcattcgaactccgaattgagccgttcaacttgcaaaattcatctaaaattgagctctacatgtttgtttactttttatgtactgtttgtgtcacgcccagaaattcactagtaatttccgaacttatttgtgcatgaaatcctcgtccaggaatcagccgaggtacacaaactgacaatttaatatacagattcatcaaattaactaaaccgataaatacttacttaagaggcacttagtcctcaccaagaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatatcggctcatttgcaaaagcagcatttagcaaaacatttaagagaagtaaaacagtggagtaattaatcagaaattttaaccaacactgaacagcacacccatgctgcacaggcccaaccattctgaacaaccatacccggctgaacagatctaactccaaaccaggagctaagcaaattattaccagttataacatctataattatggtgagaggtgtgggactaatcacgaaaaacattgctcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatttccgccacttctcagtctggtgctccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacggttgaccatcgtgagctaccattaaatataaccataagtgatagtgaaacattagttatcccaaatatgtgctaatgtttctaagcatggctaagcaatcatagctaatatctagttgaaccaatatatataaagctcaactagtccaattataatcacccaaggtatcaaggaataaagtaatcaagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctatttaaagcccatttaaaaagaattaaataaatttaattcaatttatggacaattttaatatgtagatctttattttaaacaacttttgcaacttgaaccacattaaactgagttaagatgaattagatatgaatttttaaagattaaatcggattaaaacacttaaatcggtttaaattgaattatgacgcaataatgaattatttttgaaaaggaaaaggggattattgcgtcagcggctagggtttcggtggaccgggcgcacgggcggcggttcacgcgaacggacggccgagatcgaaccaatccaaaacggacggccgagatcgatcgggtccacggcggctcacggcggacgactccgatgacgtcagcgatgacgtcaccaccggcggcggcggctcggcggctcgggctcacacgctcgccggcgaacggcggcgcggcggcgcgaacggaaagcaccgggatgaagcggacgacaaggcgaactcaccggtgaccaaaggaacggcggaaaagcaacggacgacgccggcgacgaggaggaagcggcgaagctcttcggcttgacgacggcgacggcgctccggcggtcaacagcgacggcgaagcggcggacggggacggcggcgacttggcgatcccgacggtggccttcccgagtgacgacgacgaccgtagcgacggcggcgcacggctagacgaacggcggcgacggcggcgcaaaagctcccgaggctagggcgctacacacgacggcgggcgaaggcgagggaggcgacgggtagaggagagcttgggggtccttataaaggggctagcgagcggcgacggaggcccacggcgaccggcggcgagaaggaaactttagggtttgggagagagaggaatccgattcgatctcgattccatcgagtttccaaaccgaattgaccggagattccaaaagagaaaaggaagaggagatcgagaagatcatttcccctctaaagatttcaccggagaaggaaagaatcgagcggatttggaaggagaaggcggcggcggcgcgctagggttcgcgggcggcggcggcgacgcgaggaagacggatccgacaagcggggcccacctgtcagcgaccgaacgcgcgcgcgcggctgcggactgggccggctgggccgaggagggagagaagagaggttttgggccggctttcggcccaaagccaaaagaagacttttaaaacctttttcaatttaaattatttcttaaatgcaattccatttattaaaaatacttccttagctcaaataaatcccagaaaaatctaggaattatagaattaagcaaagtatttaatgaaattttatctagcccaattttatattgagatttaacaaattaaaattagatcttctcttataagcttttaaaatcatttctaataattccttttaaacaacaatttataatttaaggatttttaaacaagaaaagctcttaacaattataattagatcattaatgatcaaataattactgaactgttctttgtattattaagagttgagctctgaaaaatccgagaaaatttcagagagttgacttaatcatggagaatttaataaaaattaaatccatccatgctttatatttaggaaattttatttcccacattttacttcacttgtaaattaaagaacatttaacaaaaattctattaataatttattaaataatttataaatcctgaaacgaaaatcaggatgtgacagtttgcttggtttttattagagtttttcctcgttttgcgtgccaacgtgtagttcccgacgtttcggaagatcgcggtcgcaaggataagagttcggaagattgtttgaagaagcaaggcaagtcacacattccccttgagcatgttgatcctaatttacaaatcttttactgtttgcaaataaatatgcatgttttgctaattacacgggatcagggtttacctatctgctcgcttgtgccatgtttacttgatatctatcatttgtcaaccttgggtaataaatcgactagctcatgttacttatgtgacccagctagaactatatgcttagcgatgcttatttaccactagctcagttgatgggataattacagtattagacctttttagtatcagagtgagctgcgtgctcgagacatctggccatgcttcatggtcgtaattatccaactaaaatgcgactgaatagtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaagctattcgaatagccgtgcccgcggttatgggcggtcgaccagattcaccgtgattagtcccatcttaataaatcgacccaatacactgtaattcaggtgggttggttgggcctgttcaacgtggtgtagcgttgatcagtggagtttttaatgttactttaattacccaatagttttactgttttgctcaataaaatattttacaactgcctttatgcaaatagccacaaacccctccttgtatccccttgcacgtctgcatcgttggtgtggcttgctgagtacggtggttgtactcagtcttgctattattccccctttttcagaagtgtagtgcttttgatctgaagatggagttagaggaccaaggctcagaccccagttgagttttgcctgtggagtggagctgaagccccgctaggatcgcctttttccgctgctgtcgttctgtttcggtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacacatgttttccttttgctgagatgactaatgatgcagttgctactgacttgaagtttcttgaggatttttcagctcctctccctgcgccgattggcagtcgccgccgccctggtcacactgacccggtggcctgcacgcccacggccctcaccgagcatagccgctctcggccggccgctccaccaactgggccggccactccaccaactgggccggccgctcgcagcttccccgcacaggcttcggtgcgctcaaccactgctgggccgtcgggcccaaccgtcactcctactcggtcggctggtgtgccgaccggaccgcctgcccctcggtcgccctggtcagctggcgcaccgactgggctgtctttacttgcgcctgcctggtcagccggcgtgcccatcgagctggctcccctaccgacgcctgcttcgttggccagcgcgcccaccgagtgagctcccctgctaccaccaccgactggtgctgccacacgcgcccgcagtgcgcgtgtccccggcattcgattgccaacgcagctcggcatctctcccatcatcaatgagcacaccatgacgacacgcggcaagcacggacttcaccaacccgtcaagcgctacaacttgagtgccaccactctctctccagttccgcgcacatatcgtgccgcactggccgaccccaattggcggtccgccatggaggaagagttcactgcgctgcaggccaaccgtacatgggacttggtcccccgcccaaatggcgccaatgtcgtcaccggcaagtggatcttccgctacaagttccagtccgacggcagcctggacaggtacaaggctcgctgggtccttcgcggcttcacgcagcgccccggcatcgacttcgacgagattttcagccctgtcatcaagcctgccacagtccgcactgtcctcagcttggcggtctcccgcgattggccagttcaccagctggatgtgaagaatgccttcctccataggacacttcaggagacagtctactgcactcagcccgccggctttgttgaccccaccaagcccgaccttgtgtgccgtctcaacaagtcgctctatggtctcaagcaggccccacgggcatggtacagccggtttgccagctttctccttacactcggctttgttgaggcaaaatcagatacatctttgttcatctaccgtcgaggctcagacacggtttacttgctcctctatgttgatgacattgttctgacagcctcctctgatgcacttcttcggtggaccatccgtgctctccagtcggagttctcgatgaaggatcttggcagcttgcatcatttcttgggcatctctatttctcggcagtcctctggtcttcatctcagtcaacgccagtactgcctcgaggttctggagcgtgctggcatgacagattgcaagccatgtgctacccctgttgacaccaacgccaagctctctgccgctgatggtgccccagttcgtgatcccacggactatcggagtctttctggcgccctctagtacctgactttcaccaggccagatatctcttatgctgtccagcaggtctgtcttcacatgcacgatccacgggagcctcatcttgctgctctcaaatgcatcttgcgttatgtccgtggcacggttgattatggtcttcacatccgccgctcctccactgttgacttgagtgcatactctgatgctgattggatgagtgcatactctgatgctgattgggcaggttgtccagacaccaggaaatccacctcgggttatggtgtgttccttggcgacaacttggtctcctggtcctccaaacgtcagcttactgtatcgcgctccagtgccgaggcagaatattgtgccgtggccaacgcggtggctgaaacttgctggcttcgacagcttcttcatgagctccatacccctccgagccgatccacattggttttctgtgacaatattagtgctgtctatctctcttctaacccggtgcaacatcagcgtactaagcatgtgaagatcgatctacatttcgttcgcgatcgcgtcgctgcgggatctgttcgagtgctacatgtacctactacgtcacagtttgccgacatcttcaccaaagggttgcccagtgccatcttcttggagtttcggtccagtctgaatgtccgttcccacgacgttccgactgcggggggtgttagattgtgtttatcccttgccatccttccttaatcttctccgatattgtttctataaatcggttgctagatatggaaggcatgtgcctatatgtactctaccatatgtgataatccaatctatcgtgttgagcctgtcgtcgatgacggtccagctctcgtcgccaggcttggcaatggcgcgcaccgtgggatcggagaaatcgactgccactactgtggaggcatcctcgacgacaaaaccggcggcgttcacgcgaagacccacgccatgggcgcccaaacgccagctcgctcgtcggcgccactccggtgtcaggagcgctgtcaccggcgggaggtcggtgcggtggcgggtgagcgggttcaggaggtggaggcggaggctgggctcgtggagcagcagcaggaggccctccggcgtgagcgccagcatcgtgtggtcggcgagctccgggatgtcgtccgtgtggatgcacccgccggtggagacgttgagaaagcggtggcggcggtgggtggcggcggcagtggtgcccttattgtggtgggccttgtcgagcatgatccagtgacgagggaggaagcggctgtctaggccaccatcttgcgggcgcgggtgcagcgaggaggagagccgccacgggcggcacacggcacggaagcggacgtaatcggcgacgtcgttggcgagggtgagctccgcgatcttgccggccggcccgtccccgaggttcgtccagtcccttgtgccagttttgctattgtggttgatagagcttggtagcgagcgcctgggcaccaccaccgccaccgcctgctcattgccgccggctggcgtggggcgggagcgtttcgcctgggttctcgctggttcggtggaggcgcaagctccccgcggcgattgtgacttattgaactggctggctggtcgcttttccatcccaccgctgcaatccatcggacaccggcgaattaggggattagacgtagcttctccctttgtgcaggcgaagaagggcgcggtgaggggaggatggatcggcgtcggcgtcggctggagacgtaactctggtatttggtattgccctagtttaggtcacaactttttctttaaacttttaatttatccatcatatcaaatctttcctgcatacataaacttcaaacttttataaacttccaacttttttcttcaaacttttaattttagtcaaacttctaattttaacgttaaactaaacacatagattatcgagtcgagacgagtctttaattaacgtggttattatttattgtcgttgggggtcggactcgcgatgcgcgtcggatcgatcctcggatcgggtggtcagtcgtatccgaggttcgagcaatcaccggcaagttcttttctccccacatgtttcctcccaagagaggctgatgcggcagcggccgttgacggcacatgcagggatccacggcgctgtggatcagggtggtcgatcggatcctgagaggatgcaacgttgggcgttgagacgatgtgttggatctgtggacatgactcttcatcatcaagcctcctgctccgccgccactggacccgaccacgtcgccggtcaaggaaggaagggatgacgacagcggctccttttctccatcttattcatcgaccacagcagcaaagagctgacacggatgtgtatgtgggaaagtttgtttctttgcaaatgtttttcacctacatgtaaaaacatttactaattgaataatcaaaattttaatatttgatcaatgacgtataacggaatacacatacgtcaacttttgaaatagtcatccgatcgatttgtgaggctatagaaacgtgtacacaatgacgcatgcagcgaacacaacctagttcaatactatatataatttctgattttgttttgtctttattttgtttctcttgtttcagtttatcgtttaaattagcagagtttttatcgatcgtaaaaattattttcgcatgttacaacgcacatgcattctactagtaataacaacatgtaatcagatagtttaactgctcatggttcagattaataaatattgatttaatactcaaaagagtggtctttcctatatagtgcgctgcaaattataagtagttattgcaattttattggagaatcagcaggaaaaatcgggcgcctctatcgcgcctccagctcgcgcgctgcaagcctctagctcaggtgccgcccccaccacacaccctagcacacacgccgttgcaatatatcacccacatattttagaaaccatctattaagagaattcgtttcagtttgtttccacaaaaaatgtttcatctagtgtactacaatgtttcactatgtatagatctaatgctgcagtggattgaaacattcttttgcaacaaatcacccacatattatggaaaccgaattcatttcatttttttccacaaaaaatatttcacctagtgtacttataatgtttcattatgtatggatcaaatgttgtagtgaactgaaacattatttcgctatttgatgaaacattatttttatataaggtgaaacggcgcccgatttaaatgattgaaatattttcgatttaaaacaatttcaatatacttggtgcaacaacgtgcaacatttaaaaataattcaataataagctaaaaaagttttcgtcggaatatatccatgtgtagtcttgttttaaagatttaattgcaacgaatttaatagtgcaattggatcatgatttggataaataatttaaaataaaaaaatagtttaaaatagttttgcgcgcatacatcttgctgacgtcatgctgacgtcaacatgacgtgggcgcccgattttcccaccccggatcgggcgcctgacgtgtagttgcctcccattttattgcttagagtgatgggtttctttttacaaagacacggagtcatcttttcccctcctcttcatttacattctctaggtcaaatatgaaaaattgcacccttctatttgcctaacaggccacacacaatttccttccaaagcccaaaatgtacggtttccgtcggcctaaactgcgaggttttcatttttccatcttcaagccaattcaattctgtctctcttatctgaagcaaggttttcattttcagttttgctcaaaaattcggccatgtcggtagcatcgaaattcccaaatttttgggattttgaagacttattggatcaaaattatttaaatttttaagacaatttgactagatttgaataaattttgatcaaattcaaagaaaaagaaaagaaaaaacaaaagtttcagctgagataatgacttgcccgaggttaccgaaattgtttttcactgatccaaagtagaatattagcagtaacaaaggaaaacgcttctgccgataaaggctccatttggatattgggttatacctattgggaaaagaaaatgatatgctggtagattgaggtgggagattatatgaaagaaagtcatatcccatgtttggtttgatggatgggaaatggaagtttctagagaaatgaccaaaatacccctccctacaataagtggtataacattcaaatgcagccaacgatcacataatatatacatgcacctcaccatcttcgagagccttcgtcccacgcgaggatctcggtggattgctgccagctgcttacaccaaagagcaccctcagatttgatgctatgagctgtggtagatgaatcaacagattatagaagggtcaaaatggcgagggcaatttggtaatttcacctggcaatattaccctcaatccagcatgattgcatatcccattcccaacctatccaaacaagggaaatatcaaaactggaaataatatccatttcccactctctttatcccattttccaaacacaatcaaagagattgtgtgatacatgctcatcaacacgtgtgcccgttaaagcccttggctaggacaagaatccaacttaaaaatccaccacacatcgtactttccactttatactagtataaaataagggattttgtccgtacagttacatactttgtattttacctacatctaatctcctcattttctgtttttattatccttctctaccaaatttctttcctcataaatattttttttaaattatcattaaggtgtgtctacaacaagtttgttactttgcaaatgctttttatctataggtaaaaaactttcactaattgaataatcaaactttcactcatctatagcaaaatacacatgcgtcaacttatataatagccacccgatcgatttgtgaggctaaggaaatgtgtacataagagatttttcgtgtgatgacacaggaagcgagcacaactgagttaactttgttttgccattgttttgttcatcttttctcggtttgttatttaaattagcagagtttttatgaatcatgaaaattatcttcacatgttgaaacataccaaacatttttgctagtcattttaaaaacagaaatgctacttaccgatataccgtttgggatcggtcccggacaggacaatttcccatggatcaaacacacaccctcacggatcagatacacaccctcgagaagcattgagacacctacagctggcaaggctgcggcggcggcggcggagcctgcttgctgctcctcctcttcagcgacgccggtgcgcacgaggtcagctgtgccaatgagagagagtgacgtaagcatgttgatggcggctgcggcggcggcgtctgcggcggagctggtgcgcatgatacccctttctctcattcctccttgatgaggacatcctccactattacccactggcaaagacgctaaagtcgggcggcgaccgtgtgagcctctgaataatcccaccttgcttagcttgggaggaggaatccaccttaaaagggagagccacccttcccttattagactagtcttttagggagattgggcattttcccgagtgagtgcgcctatgaactgttggggtccgggcaaccttaagttattaggcctcggccaaccccacctgggccggattattatcatttggtatcagagttgggcccttgttaagggggtgggaatgatgaggacattctctactattacccgctagcaaagacgctaaagtcgggcagcgaccgtgtgagcctctgaataatcccaccttgcttagcttgggaggaagaagccaccttaaaagagagagtcacccttcccctattggactagtctttagggagattgggcctttccccgagtgggtgtgcttatgaactgttggggtccggccagaataatcccaccttgcttagcttgagaggaggaagccaccttaaaagggagagtcacccttcccctattggactagtcttttagggagattgggcctttccccgagtgggtgtgcctatgaactgttggggtccagccaatcttaagttattgggcctcggccaaccccacctgggccggattgttatcactcctttttcatcgatttcctgatttcgattttaacatctcttcatttttgtattttctagggtttgttgaatccccaacctgtggatggggctcgtcatatcacatccaaattgaaatcaaagtaagctaatactctctcttttttctatgcatttttgttcattcactggggatgtttgtaccagaggtgaggggtgtgtgtgtgctgaatcatatgatacttgatatgatacttgcagcaaaatgttcgaattggaatagatcgctaaaaatgcttctagttgtatattgatgggaaggcaaatattgcttggagcaattttgtcgttaacaagtacacactgtcttgaaacagagaaatctccattcaactagtagcttactgcttaggacttttttaggtgaactgaagtgtaaacaaaatcagagaaatccgcatcagtcggttgctggcttctagttccgggtatgctttgcttgtcaattgttatcctttttgtcatagagggcagcgcgtggcgacagagatggcagatgcagctgagtcatagatgcagatgatttggatttttttttcctgttgatgtttgtagatctcagtggctggctgggagttttctgttttaaaatgatttgatactttggttcaatctaagaagaatcaccattgaaatgatattttctttgtcctttcacacatgtgcacagagttgaaatagcattgccacctgcttcaagcgaatccgatttcatgcatgtttcaaagaagaaaaggtgctcttcaaggttgaacaagggctcagcttaacccccacttgacaaatctcacactgctcattcttgtcatccatgcaggactacatgaaagaatatcatagggagctatgcaaaaggttgttgtaccatcgcttcaatgacttacatccaaaacgtcatttctatgctcattcggttcaa

SEQ ID NO: 16401 - DNA, 3842 bp, Oryza sativa
acatgatcctacctacccaggtatcatgatcgacgattttcctaggtaggatcatgtgtgatacttcacaagtatcacaccatcctactaaagtatcatctctgaaacctcacaaggatcatgttaccagagatgatacccaagtagaatcatgtgtgatacctgtaaagtatcacatcatcctactaagtatcatctgtgaaacccatagggattatgttagaaaacatgatacctaagtgggatcatgtgtgatacctcacatgtatcacacatgatacctaagtaggatcatgttagaagacatgatatctaagtaggatcatgtgtgatacctcacatgtattacacttaatgatactttttttattaggatcatatgtgatacctgtaaagtatcacaccattaagtagcattcgtgaaactcatagggatcatgttagaagacatgatacctaagtaggatcatgttagaagacatgatccctaagtaggatacatgatacccaagtaggattatgttagaagacaagatccctaagtaggatcatgtgtgatacctcacatgtatcacacttaatgatactttttgagtaggatcatgtgtgatacctgtaaagtatcacaccattaagtaccatctgtgaaacccatagggatcatgttagaagacatgatacctaagtaggatcatatgtgatacctcacatgtatcacttaatgatacttttttgaggagaaccatgtgatgctacaaagatatcacatgatcctacaagagtaccatgtgatcctcaagagtatcatgtgatcctactagcgtatcacatgatcctaacagagtatcatctgtgaaaaccacatgaatcatgtgctacttgtgtgaaaatttttagcaatcacataacaaattgtgtgtgaaaaactacctccaccaacagccaggacactcagtgtacatcttttgatcatttttctaatacaaaagttcaacgatagtatgcaaacacacaagcaatcttttgacaaatattggagattaagcagtccttttatgtacattccatcaatttttgtaccacacagggacaagtcatgcataccatctgttctatccacttccatatcatctgggtcacatctagctctttttttttcgccgggccagccaagataggccaactaaatttatacttacgattgaagaatatatacaaatatacaaagttttaacttcaactagaagccgtcaaagtaatggaagttgtcaccggagcaacctctctcctatatttctgaaaaccccagcttccttccaaatcgccacctcctctttgattgaaccaaacaggaaaccggctgagcgccgctggttctgaaacacacgcgcatttctttccttccaaaccatccaacaaataagcagcacaaggctatcaatggcatccatgtagttgttccgaaatttttgccgcatcgctaaccaccattcgcccaagtccaagcctgactcatatggcagcaggaagccaaccccaatccagcccttgatcattctccacaccctggtcgtgtaggtgcaagacacaaataggtgttcataatcttcatcaaccaccaagcaaagttggcaaacctgctggttcggccagccacgcttacttagattatccgccgtgaggcatcgccctttttcggccaaccacataaataatttcacctttgacggcgctcttgtttaccaaatcagagtaccacatcgcgccaccgtgtttgccatgaagaacatgctgtaggccgagtagggagtgtatttttcatttggtgcccacttccagattgtctcatcttcctccccatcttgaagttgcaccccctagaccacgtcccaaatctgaaagtattccccaattgcacgattggagggtgcccccttgatgtctcgtacccacctatggttcagaagccctcatgccaccgtcaagcccgagcgctcgacgtggctgaagatcaaggggaatctcaactttatgctcctcaccagcaaccagtccgccagccaaaatttggtgttcttcccatcacccaacacttgtctcgttcctgcgaggtagaggtcttgcaagtctttcgactgatctattggaactgttgttcacggtgtcgacgttttatgtcgcgattccggtatttgcatagtatgggaatcgttggtactaggatatatgcgagattgaagtaaaagagatggggacgaggatttttatataggttcaggccccttatcttacaggtaatagccctacatcccattggccgaagccggtgttgctctttattcatctggatcacacaagtacaatatttggagtagcctatctaactgttgtcgacttggcggtctgaagtgctgacttgtagtcgacaacagggtagccttcctcctcgaatccgcatccggcgagatcaaagacagcgctatatctctcctgataatatccgtagataccgtaagggactagccatgcttatctctgaattcgatatccggcgtcttgtcttgcatgttggcttttatgttgatcttgtgtcttgatctattgttccgtgtcccctctcctcctagggggccctgtatttatacccataggtgtccccttgtctaagtagaactagggaaaccaatatggatacaatccaagtagtccttgtcgtttccatgtagaactctattcatcattccttatgcggaattcctcctatatccgaaggttgttttcgtataagacatggtatgtggtgggtcctgccgagatttagtcaactactattaggtatatggtatccataaccttgacacacggcctgtcctgttgttccccctttttgccaaccacttgagacgaagtccttgccgaaataattgatgttcttgattcccagcccgccattttcatgtggcatgcagaccgctttccaggcaaccaagcagtgtccgccattcacctcttcctgcccttttcatagaaatccccggcacttcctatttatttctttgattgcccactgtgggagctcaagtacagacatgtaatgcactggcaaagcaagtaggactgtcttgatcaaggtcagccggtcaccggcggagagaaactttggcttccacccggcgaatttcttgacaaaccggtcaaggagcggttggacatcgtgcttcgtaagctttcaaagggggagcgggagcccgaggtaggtgattgggaacagctcgactctgcaacacaggatcgactggactagctctgattgctcttctgaacattggatcatggtgactgcactctttaacatctagctctaacaagggcctcctttaacatctctatttcagcacttaactcatccaacactaacttatctactattgttgtcacaactgactcgctagctacagacacactagcagaaagtgcacacaaaggagattcactcgagggggcatcacttttttttattctcctgggcatcaaaagaaatcacacaaaatagcaacaaaacatcaaaacacatacattgcatgcataaaatagagataacagagaactggctttagaattcttacgcgggctgatgttgagcttgcagcgcatagctggagcagaatcggtcgaggaggtaggagcagagcaccggattgcagaggaaatcggtagacggcgtgtgcgccggcgaaatcaacaaaggaggcgcgcgattccgaggatcaatcttggggatgcggaggagctcgcgccggcgaggaatcgtgcgcggaggcgcgcgatttcgaggaggattc

SEQ ID NO: 16402 - DNA, 10947 bp, Oryza sativa
attctttctgtttttgttgacgcgcggggtgaccataccgggttggttttagaatcatccctgttttcaacgggataccggtagatagcggctttttttaaaaaacgtgcccgtgtaagaggaggaaagggtagattgaagccgtttgtaatccggatcggactcgtgtagtcgtattgcaagacgcaatcacgaccgttggccacagatcgggcggtcaggacaccactcgccacacgttctcctcctcacccgcagcggcccgtacccttcccaaggagaggcggcggcagcggcggcggaggtggcggcggccgtatgcgggagagagaaagagctcagctcgcatggccatcgcggtgaggtcggctgcggcggtggcgaggcactccctgcgccctccgctggccgcgcccggcagcatccgcggcgcctcgctcctgccgccgcagcgcgctcgcggcgtgggcccgtgtcgcgcccgcgctcgcgcggcgagctcctccgcgactggaggtggcgggcaccttcctccgctgttcaggtgagcggggagcggaattattccgtgttttaggcaatggagacgggcggggatggcggtgctgctcatggatagctgattgatttcgtggttttccccctcttctcctgcagcgtggcgccgatgatggactggacggacaaccactaccggacgctcgcgcggctgatctcgaagcacgcgtggctctacacggagatggtggtcgcggagaccatcgtgcatcagaaagataacttggtgagctatatgcccttccgcccttcacttcttcatgattaaaaccgggtgaaacgtagatgagagaaatgcaaatccttgctacggaggaggaaaccctgcaactgatcagcagtgaagcaacctgtggttttaccacgattctgaattactgtgcgatgtgaatctggtagtgatttgattggagtcagcagcaaactgaattcgtttacgattggcccactttcattcatgtcaataacaatgccacaggtgttccatgaaaaactttcccgtgcgcattgcataagttttccattctcttcaagctatatctggtgactctttaagtacactcatcagagtcttatagtataatgttcatcttaatagttccattagcccatggtgcgctttcatatatcacaacttggaacctaatcatacagcggcattccactgattccttttgtcagatatagttcatctcctctgctgtctcaatctaggcatatgcgaaggatatccattgttttagctaatcagctctttttttcacataaatattgcagtttaatgaaaaaaagaatcaacttactgccttatcgggataaccagcaatgtattgcccacatgttttttcttttgtatgttatcaagttgcgatgagctttcttggcggcactggcagcttaatatgggggaaccacttcaactcaacttggcaccatcagtgctggcttgttttgtatatttgtcactatgtcttcaatcattgtttcttaaattctacttttggtgcaatgaaggcaactgtgaaacgtgtctacgacatatggttcacattatgtgcacatgacactgctacacagaattgataaatcttattcttttgtcgtcacaatatgcaggatagatttttagcgtttcctgctgaacagcatcctattgtgttgcaaattggtggaagtaatctggataacttagcgaaggcaactgaactggcaaatgcttattcgtacgatgagatcaacctaaagtaaaaaagcgtcactcaatctcatctaatcatgtatgacatttcttttattacatataatttactccaaacgttttgtatcagctgtggctgccccagtggcaaagttgctggtcatggttgcttcggtgctcgcttaatgtttgatccagaggtttgctttatgaattcattgcagtaaaccatcaggtagcatcaatttgttctttctccacccttagtaaatattgattcaattatctgaagtttgtaggggatgctatgtcagctattgctgccaattgtaatgtcccagtcagcgttaagtgcagaattggtgttgatgatcgtgactcctacgaagaactttgtgagctttcttcagagacctctcatgttcctttaaatttccttaggcttcccagatatgagccatggaaatcatgtcaaataagtacactctatcagatgcacttttacaccgaaaaggatcaatcaacaatgggttgcggcatgctttaatgtctcatattatcaaaatatgttaacctataccataagctaaatataagtaaatcacttgctggtgttatctggttgttttacaagaaccaggttacctagctgtagttgttattggttactggtcagtgtatttgtactcttctggcggtggttgtgcccttaaggtcaaattgaagaaagaaaaaaacagtagtatctcttgtgcatagtgatgctggacggttaaaatcttggattagtattaactgacccctaaaatgtaccactggtgcaattactccttacatttcaagttttcaacagcatcagagcataaaaaaaatctcatatcttctcaaatcaaaagaatagttgaaagcttctaacatcagtggagagtctctagttctctgcatatatttatcatgacttattccaaattaatctactgtatgtaaatctgcttgtagatgaaatggtggcatgatgacatttactgcagtttatctttttttagggccaaaaataatcacccatggctgtttggctaaatttgaaaaattcccctttccccctgagttggctgaggattatcttcaaagcattggactcctattaaattgcaatgtttaactatggttgccagttaattggtgatgtatatatttgacatgtgatcaacctttttgtatgataacaacatccttttacatttatttagagattatcccttctgcacacatcaagctgaaataattaggtaactgaataatgggaaatcaagtctaagaataagttgctcaatttaattgttttcttcttgttatgatatatggatatggcccatttctttttaacatgtcacacgacatagttccttttgttaggaatttgtaacatatcttttttttatttatattacccagttcaaattctatgtcatgctgtaggtgcatacttttaatgattctcattcatgttactctagataaatttttcatatgatgtttaattagttcttgtattgcatggtatttaattatcataggagtattgtttgagggttaatttaacctcatgtgctgatacagtgccatattgcaacaaactacgtatctttctcactgttaggtacattgactttttttttctttcccaggtgaatttgtagataaggttgtttcaaaatcaccaactaggcatttcattattcatgcccggaaggcattgctaagtggcctcagtcctgcagaaaatcggaacgttcctcctttaaagtatgtcacgcccatgattttctttgtgtaaaatattattcaaatttgatggataagtcttcgtggtccttggtcgtgattcttctttttgcttttgggtagtttcaccttttcaggacagcatctacttctttagcgtatttttcagttgctaggacagctgcggttagtaggacagcagcagttagcatctcctttatgcctcctttatgctttattcagtttggatgccctctaggacagcatcccattcaaatttcgaattttagactaggagggtgcagcaataggctagcagccagctatggctatatatatatgtatccaacctccctcgggtaggtatggctttgtgttttgtgaatgaagaaaaccagaaaattgccccatctcgagtgccatcctcttctcaatgagagtaaccattgaagttctaacatctggtatcaaagccacactttcctgtaggctaaacatctcttgttccaccccttcccaagctcggttgagctctcagctagcagcagcagcagcagcaacaccggctgctcctccttcccctttcccttccccctctccacgcagcagccccccggaggtgtgccatgtccgacgttcggtctcggcgttcggtcgcctcgagcactcggcgtcagcaggacaccgagctcgccgcagcagaagagcgcaggcgagcaacggctcagaccgctgcagcagcagcgagggcggccagactggcggcagcggagttggcagcagccaggtcggaggcggaagcagaggcggcggaagatgcggcacgtgcggcggaggtagaggttgagaccttgcgcagcagcatcaacggctccatcgccggcgacatcaccgccgacagggagcttgaggagctggcaagaggaagggcacgggaacgggcagagcggcggcggcggcccaagggaccgcgcacccgccgacgggaacccagatgggcgcgggcgtgccggcggcagcccggagcccgcgcgcggccctcgcaggcagcgcggctctccctcccctgaccggtgccatggtcaccacggcgtccagacggtggtaagggactttggtctcggcggtgggtggcctaccctcaccaaaaccaactacatcgagcgggccgcggtgatgagggtgaggctccaggtgcggcacatgtgggaggcagtccggtacggcgacgttgactacgatgaggatcggcgggcactggatgccctcatcgctgcagtcccgctcgagatgcagttctcgctttcccataagtggactgccaaggaggcctgggatgccatcgctgtggcacgtatcggcagcgaccgcgcccgcaagtccacactgcaggcactccgcaaggagtgggagaacctggccttcaagccaggtgaggatgttgatgactttgccctccgtctcaacactcttttgcagaagatggtgcagtacggcgacgacacctacgacgaggagagagctgtcgagaagctctttcgttgcgtcccagagaagtacaggcagatcgctcgctcgatcgagtctctgctggacctctccacgatgtcgatcgaggaggcgttaggtcgcctcaaggtcgtggacggcgatgagccacagcctctctcggggcctatcaccattggcgggaagctccatctcactcgggagcagtgggaggccagccagggtgacgggaggaagggggagtcctctccctcgacaggcggccgcaagccgtgcaaggcgcgcggaggcgtccaactgcggtgggcgcgaagacgcgccgagggtggtgctcgcagaggcgcccagggcggcgccgccggcaaccacaagccggcacgagacgacgcttgccgcaactgtggcaagcttggccattgggccaaagactgtcgacagccacgacgcggcatcgagctatctccagcggcaccggccgcaacggctttcctccacctcgatgagccgaaggtacacgccttcctcggcaacagctccagcaacgacaaggctgatgggtggtacctcgacaccggcgccacccatcacatgactggccggcgggagttcttcaccgagcttgactctagcgtccgaggctccatcaagtttggggatgcctccggcatggagatcaagggcgtcggctccgtcaccttcaccgcaaagtccggtgagcacaggctgctcaccggagtctactacatccccgtgttgaggaactctatcatcagcgtgggacagctggatgagaacggctcacgcgtgttggtcgagcacggagtcatgacgatttgggatcgccgccgtcgccttcttgccaaggtaaccagaggcactaatcgactctacatcctcagcgcgcaggtcgcacaaccagtttgcctcgccgctcgtcgggacgacgaggcgtggcagtggcacgagcgtttcgggcacctccactttgaggccctaaagtggctcagcgccaaggagatggtgcgaggcctgccgtgccttgaccacgtggagcagctctgcgacgtctgcgtcctaacgaagcagaggcggctcccctttccccagcagacgagtttccgagccaaggagcagctcgagctcgtgcacggggacttgtgtggcccagtgacaccggccacaccaggaggacgacgttacttcctgctgctcgtcgacgacctctcccgctacatgtgggtgatggtcctcggcagcaaggcagaggctgcggacgccatccggcgcgcgcaggctgctgcagaggtggagtgcggccgcaagctgcgcgtgctgcgcaccgacaacggcggcgaattcacggcggctgaatttgcgtcgtactgcgctgatgagggcattcagcgccagtacaccgcgccgtacagcccgcaacagaacggtgtcaagcggcgcaaccagacggttgtagggatggctcgggctctcctcaagcagagggggatgccggccatattctggggagaggtggtggtgacggccgtctacatcctcaaccgctcgcctacgaaggccctcgatggcaggacaccgtacgaggcttggcatgagcgcaagccgggggtctcccacctgcgggtcttcggctgccttgcgttcgtcaaggagcttggccacatcggcaagctcgacgacaggagcaccccaggggtgttcatcggctacgcggagggctcgaaggcctatcgcatcctcaactcggagacacagcgtgtgcgcacagcgcgcgatgtagtgttcgacgaagggcgagggtgggtatgggacaaggcggtggacgatggttcgactccgaagtacgacgacttcaccgtcgagtacgtccacttcgagggagctgggggagtaggcaactcttcttcaccgagcgtgtctaccccagtccccgagcctccaccgactccgacaccaacacactctcgggccacgacttcgactacgacgagctcctcgcctacaccaccacagccggtgaccccacgcgctccagcaccaacagccactcctccgagcacgtctactccgacgccagctagtgttgagcgcaacccggtggagttcgctactccgctctcccacgacggggagcgcatcgacgcgtaccacgacggcgagcagctacggtaccgtacgatggaggatcttctcggcgaccagccggtgccgggactggtgcctcccgacctggaggcgcagttgcaccttgcgtgcgacgacggtgagcctcggtctttcgcagaggccgagaaacacgtggcatggcgtgccgcgatgcagtcggagatggacgcagttcaggagaaccgcacctgggagcttgctgaccttcctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttgcgctggctgctcaggaaggctgggcgtccatcacatggacgtcaagtcggcgtttctaaacggcgacttgaaggaggaggtctacgtgcaccagccgccaggatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttggtgatcaccggcaccaaggatgcggaggtcgcggcgttcagggaggagatgaaggccaccttccatatgagtgatcaggggcctctctctttctacctggggattgaggtgcaccaggacgactccgggatcacgcttcgacagaccgcctacgccaagcgcgtcgttgagctggctaggctcaccgattgcaacccagctctcactccaatggaggagagactgaagctgagccgtgatagcacgacggaggaagtggatgctacacagtaccggcgtcttgtgggaagccttcgctacctcacccacacggctggacttggccttctccgtcggctacgtcagtcggttcatgcaacgaccgacaatggagcactagcaggctgtgaagaggatcatccgctacgttgcggggactctcgaccacggtctctactacccgaggtgtcctggcaaggcacacttcgtcgagtacagcaacagcaaccacgccggtgacatcgacaccagcaagagcacgagcgggattctcttcttcctcggcgagtgcctcgttagctggcagtcagtcaagcagcaggtggtggccctgtccagctgcgaggccgagtacatggcggcctccgccgcttcgacccaggcgctctggcttgctcgactgcttagtgatctcctcggcagagatactggagcggtggagctcagggtggatagcaagtccgctctggccctggcaaagaaccccgtttttcacgaatggagcaagcacatctgggtgaggtaccacttcatccgaagctacttggaggaagggagcatcaaggcgagctacatcaacaccaaggaccagcttgcggacctgctcaccaagcctcttgggaggattaagttcctcgagctctgcttcaggatcgggatggctcaacttccccacaagacgacgcacaagacttagagggagaatgatggataagtctttgtggtccttggtgatggaataagccttgtggtttttggtccttgtggtccctctcttgcttttaggttgtttttcccttttaggacagtatcctttcagttttgcttttagcatctttcggttttgcttttagcatctctaggacagcatctaggaccatcacctttctgctttattcagtttggatgctctctaggacagcatcacgttcaaattttagactagtgtgggcagcaattagcttgcagccatccagccagctatggctatatatatgtattcaacctctctcgggaaggtatggcttttgtgttttgtgaatgaagaaaccagaaaattgccccatctcgagtgccatcctcttctcaatgagagtaaccattgaaattctaacatctggtatcagagccacactttcctgtaggctaaatatctcctgctccactgcttcccaagctcggttgagctcttagccagcagcagcagcaccggctgctcctccttccccttctccttccccttctccacgcagcagcctcccggaggcgcgccatgtccgacgttcggtctcggcgttcggtcgcctcgagcactcggcgtcagcaggatgccgagcttgccgcagcagaagagcgcaggcgagcaacggctcagaccgctacagcagcagcgagggcggccagactggcggcagcggagttggcagcagtcagggcggaggtggaggcggaggcggcggaagatgcggcacgtgcggcggaggtagaggttgagaccttgcgcagcagcatcaacggctccattgccggcgacatcaccgccgacagggagcttgaggagctggcaagaggaggggcacgggagcgggcagagcggtgggcagcagcccacctccacggcggtggcggcgacccaagggaccgcgcgctcgccgacgggaacccagacgggcgcgggcgtgccggcggcagcccggagcccgcgcgcggccctcgcaggcagcgcggctctccctcccctgaccggcgtcatggtcaccatggcgtccagacggtggtcagggactttggtcccggcggtgggtggcctaccctcaccaaaaccaactacatcgagtgggccgcggtgatgagggtgaggctgcaggtgtggcacatgtgggaggcagtccggtacggcgacgtcgactacaacgaggatggcaaagaaccccgtcttccacgaacggagcaagcacatccgggtgaggtaccacttcatccgaagctacttggaggaagggagcatcaaggcgagctacatcaacaccaaggaccagcttgcggacttgctcaccaagcctcttgggaggatcaagttcctcgagctctgctccaggatcgggatgacccaactttcccacaagacgacgcacaagacttagggggagaatgatggaataagcctcgtggtctttggtccttgtggtccctctcttgcttttaggttgtttttcccttttaggacagcatcctttcagttttgcttttagcatatttcggttttgcttttagcatctctaggacagcatctaggaccatcacctttatgctttattcagtttggatgctctctaggacagcatcgcgttcaaattttagactagtgtgggcagcaattagcttgcagccatccagccagctatggctatatatatatgtatccaacctccctcgggaaggtatggcttttgtgttttgtgaatgaagaaaaccagaaaattgccccatctcgagtgccatcctcttctcaatgagagtaaccattgaaattctaacacttggtcgtgattcttctttttgcttttgggtagtttcaccttttcaggacagcatctactcctttagcatatttttcagttgctaggacagctgcggttagtaggacaacagcagttagcatctcctttatgcctcctttatgctttattcagtttggatgccctctaggacagcatcccattcaaatttcgaattttagactaggagggtgcagcaataggctag

SEQ ID NO: 16403 - DNA, 2322 bp, Oryza sativa
tatcctcttctcaatgagagtaaccattgaagttctaacaaaatttatggagtggcgccaaaaaaaatctctaaagaggataaccatttccataaacaagaatatgcattaagtagagtttcaactttcaattgttaactttgggtaagattccaaatgatgtagatactacgtgtagagcatgaggggcacaaacacaatcctatagtccaaattgcttcctaatctgttgaattaaatttaaggtctgcagaacagattttatttcctggttatcaccagtaactgactagttctcatctgaattttcatccccggcctcaacattttttttgcagatatgaatactactttgctttattgcgggacttcccagatgtgcagtttactctaaatggaggtataactactattgatcaagtgagtatcttactctagttatgtagttttgataatgcaattcctggaagttgctattttaatgaacaaattgcgtagcgagtccatcagttcaaattaggtcaaactgatgttaatgatacaattttccttggcaataaaaaaacaattttgtttcatgaatgcaaaaagaatatatttgttctctctgtacttagtactagacattcatgcagagaagtagctcttgttgcaatcagatataatatgcctgagtcaagtcatttttattgaacatcagttatattcatttgcaggtcactgcatccataagacaaggtgcacatcgagttatggttggccgggctgcatataataagtatggtcataattagaagcctttgtgtctctaaattctttgatgctttcaaacatgcaaactaagtaactagaatatgtttccttttgttgctgaaaacctgaaacagtatttagttgtaattttaattttggtatggaataaatgttcagtccatggaacatgctggggcatgtggacagtgaagtctatgggatgccgacaagacgctcttctcgtcgccaggtttagcatcaaaggatggttttgttttcagctatcaactatttcttttataagtattaactgaactccttgttttagatccttgagagctaccaggtttatggtgattcaataatgggccaatatggccccagcagaccaaacgtgagacaacttgtcaaggtgtgggttgcacttacatttaatgaaaacaacctattgttagctttatgatgtgatgtagcagggcatttatgtacttgtttcaccttataatgtaattatctgtgacgtatgcaccattgtgttgatcatagctttctgaattactcaagaactgttacttttgtttgcgtatagatagggattctactttatgcctaaaagcctaagatatgagttataaaagataattatagcacactaaatagaaaatagagttcattgaagaaaaggaaatgcactgatcaaacagtttcatctgtttctcctggtattctgagctgcttaattgtggtctaacagttgcgagttctgcattctgtgtattgatctggaaactagatttaatgcaattactatattgacctttatcagtccttttgtaaaatttatgagcttatgcaaatatgtgctttcagttactgagaaaatcgcttgattttgacagccattgttaaatttattccactcggaacctggcaatggcctttggaaacgcaaggctgactctacactgcgtcattgcaaggtaagttataaaaaaaaaagtctatcctttgtcatgccacattacttcttccaacaaatacaacagaagaaagatgcctatactatactcaaatgaattattgtgagacttggttttatgaatacttgtaaggttaattttgatctagtaaatgaaaatgaggaagctgttcaatctccaagtggtcaagtaatcatctcaaacacttaactagttttttttttctaacttaattatctgaatgttgttggtcatcattttatatgctagccagttatgttttaagctacctgaaaatgagaaaatcagtatgaggtgcacaatcatggatttggaattttacaccttgagggcatgtggcccggaatttccaaacctttcaaatatcaattaaataaatggaaaatattcaaatattaaatttaatttatcatttcagaacatttcaatttgaaactcagatgtgtatatgaaggaaccgaagaatgactccacccttggaaagcaagagccaattcatagctatattttgtttcactaatgacttgacaatttgtgcctttaacttcattcaaaattttcatgacgg

SEQ ID NO: 16404 - DNA, 793 bp, Oryza sativa
caatgggccccgaaacccggaacccgacgggtaattactctattaggggctgtttgtggttcagtttttgtccccatgggtctcttagcgggcaaaagtgtcacccgtcgggtggagcgggtgcaggtccgttatcttgcccccgtacccgttaacccatggggctgatatgcagttcttgtttaataggtggcccatcagaatttcgtttcacatgcattgtttggcccaaggcccatgcggagaagagctctccagtaaaaatcaacgcaaccctaatctcattcctaagtcctgaccagccgcctcccttcctcgtttctcctctttcctctctcatctcgctgtagtccacacgcggacatgccgccgccgcctctgcactgcgccgcctgcctgcctgccgcgaccccattttgtccgccatccgtgctgcacctgcgcctcgatgccagccaatagatcgacgaccggcggccccaggcgcactgcgtgctcgaccacgccgcttcctcttgttctgcgctgctcggcttgctgtcgtggttgttgctgttggggtttgaaaacccgttggttccccggaaccgtttccgggaacgggaacgggaacggggaaattcaccattcttgtccgggaatgggaaggttgccgttcaattttttttcttccgggggtgggcacgggttgttgccacccaacgggcccagcccggttcccatccctacccataaccaatggccacatcgtccaggtgcgctacggtgacacaggtgcgggattgggaggagg

SEQ ID NO: 16405 - DNA, 713 bp, Oryza sativa
atccggcgtcgcgcagccgcgggaaggcgagcatgctggggaacgtggcggcgctgtccgtccggagcgcgagcgcggggacgccgagccgggccgccgcgcccagcgccgcgtaccactgcccgtccaccacggcgcacgccacgccggggagcagcgacgccagggcgtcccggaacggggcctcgcaggcggcgttgagcgcgaggagctgcgcgacgatgtcggcgccaggggaggtggcctcctcggggagcgccgcctcgtggatggggaggaaggcgaggtccggcccgtggcggtggcgcgccgggtcgggcgcgttggagcgcgtgtggaggacggtgacggcgagcccccgcgcgcggaggagatcggcgagctggagcatggggctcaggtggccctggaacggcagcgggaacagcgcgacgcggcggccggcgtggggttgccgttcgggttcccgttcttgcgtggccatcgctgccgtcctcggcgaggtcctggggcttgcgacttgcgaggtacaagcagcgagcgctagagagtactgacacggatttctttttcaggtcggtggagaattgtttcaacaaatgcggctatatgatattatgatgcgatggcatttgctaaggtagtacttccattcttatcacttgctcccttctttcaaaataaactaaaattaagtgaccagtatacatatg

SEQ ID NO: 16406 - DNA, 194 bp, Oryza sativa
tttggacctaccctccaccggttccacaaacccttccgggaggtccggtttccccgaaaccccgataacgaagacaggccgaaccccccataagaaaggcctttcaaaagttggccaaccccaaggtaccttggtggaattattctgggttcaccaggcccacactcccaaaactaacatatagcaggggtgca

SEQ ID NO: 16407 - DNA, 632 bp, Oryza sativa
ctctgatcagaggtgtacatctttacccacaagacacattttcctcacgtgtaaccacgtgtcacataccaccatggtatacggacggaagacatgacatagtttccaacccatcctagccataaacaagagtaccgacccaaccccacctacggccggaacccccgggacaggtaggcaggactgagtccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgtaacagaggcccgaagaccggtccttatatggccgaggtgctactatcaaaaccatgcaccccgagcccagcctaaaaccattttgagggttttgaatagaggggaggtgtgaatccaattccacaataatccaacaattccatagtgtcgaggtgataagagtattcccaaagtctagagttgtaaaaccacctaatgttgcctaattaaccagcgaagcatctacctaaaatcatactagtggt

SEQ ID NO: 16408 - DNA, 240 bp, Oryza sativa
gtaaactacgcagaataacatgaacagatcaaatatgcgcaacatattgaacacgtaccgaggtgacgaaaagaccggctgcttggtcgaaacttttcgcaggtgtctacgaaggcacgaaacacgtgagcgaagaggaaggcgagccgtcgcgaacgaacagggagcagtcgcgcgaagcgcttcccaaaaaccttattgccgccttctcccggtgcagaacgtcaaaggcagaggttc

SEQ ID NO: 16409 - DNA, 806 bp, Oryza sativa
gtagcgccgtagccacgcgaaccacctctctccgctgccgcccccgactccagccgcgtcgcgccgccgcttcggtcgacgccgacccgcgccgttgcctccctcagctccgcaaggacgaggaggacctcggccgccgcccctcttcgccggaaatccgccggagctcctccttcctcggtcgccgatcgaggccgagcccgtccgccccatcccgagcgacgcccgtcgccggagctccgtcgcgtcgtcttcctgaggagccccgtcgccaccgttctttgccgtcggccgcccctttgccgtcgtgcatctcggtgagcactcccctccttttcctttttcttccctttcgttggccgcttcccgggggtcctcgggacgcgctgccgccgccggtggccgttcgaacgggttggtgccgccgcggtccgcgttccgtgcccgcgccgttgccggtggtgccgggcaagcggtttccgccttcccctttgcggcggcgggcctttggttgggcgggccgggtttgttccggggcttgggcccttggttgcggttcccttggccggccgaatgggttaggccgattttggccaatcaagttgttgaaggggaaccgaaggcaagttttgaacaaggtccccggggggccttccccttttaattggttaaaatgtggggccggggtgtgggggttgccggcccttttgttaatgtaagcgaggtccatttcttctgtaaaaataaataataattgcgcaataaatcgagtttaattctagaaattcatttaaatggctcaaagg

SEQ ID NO: 16410 - DNA, 212 bp, Oryza sativa
ctttaggagtggcgtcacgcccgaccgcttcccttgagaagggcgatcgccctggcataacgccgggggctactgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtc

SEQ ID NO: 16411 - DNA, 11646 bp, Oryza sativa
caatcccccattgagaaaagcatttttaacatcaagctaggagatattccaatgacgagtagaggctactgcaagagttcaaacaatggtcatgtgagccacaggagcaaaagtctcatgataatcacgaccatgctcttgttgaaaaccacacgctaaaaggcgagctttatagtgttcaagagttccatcagagcgagtcttgaccttaaagatccctttacacgtgataggacgaacatgagatggcaatggaacaagatcccaagtaccagtacgctcaagtgcaacaagctcctctgccattgcatgttgccattcttgatgaataacagcatcacgataagaactaggctcagcgagaacagtcgcaacataaccatagcgatcctctggacgaatcgtaactaaattacgatcccgaagattgtatctcggaggagcaacaggagaagcatcaacagaaggctccataacacgagggcgacgactatagacttgagtaagagggtttaggggaggtagcagaagcaagaagactggtaagcgcagcggaaggaagacgaagccagtcaagctcccaaagatgctgagaatcatggcggcgagggccagtaccaaccaggagacccatgcgtcgatcctgaacacaacaagagtcagaatcaagaataacacgacaatcatgatcaacaagctgtccagcagacatgagctgtatggtcaaatttggaacataggaaacaaaaggaacactacaagaagatgaaagagtcccatgaccaacaacagaaagaggggtaccatcggcagtttgaacagtaatagggactaaaggatgacatatagatgaaagacaagacttatcaggggtcatatggaaagaagcaccagaatcaagaatccacggaaaagtgagaaccaggaacaacaaaatcagattgtgcagagggcaaagcaactaaactagctaaacctgtcgaagcagaagcagtgaggcaacgcagtaacataaggatctcctgtgtatcagaactgcagaactgccagtactcttctgagaagaagagcgagtactcttctgagaagaactcccagcaaccgatgaagaacgactgcgccataaatccttcttcttcctaaagcaaaatgactccacatgtccatctcgatcacagtaagtgcaatgaagatgaccactggaagatgataccacttgagaagaagtatgtgctggtaaagtaaaggaaggagctgctgatgatgaagacactgaagctgtggtacgaacgagtactgaagaaggatgcgatataatacccgcttcacgaagacgaatctcctcagaatgaatctcagttagagcctccatcaaagtaacacgggggtgccgagcaagcaactgtgcacggatcgactcatactcagagcgaagacgtgtgaggaagtcatagatgcggcgaagatccatgtgagaccactggcgctgacaacactgacaagtacgacaaatatcaggtcccaaaggatcaagctggcgctagacagaggataactgtgtatagaactcatcccctgtagcatctccctgctgtaaagactgcttctgacgcaccatagcaagatatagagcatcaccagtaggtgcataacggtcacgaaggtgtgtccacgtgaaatgagctgaagcaagggtaaccacatcaccagtaagatggacctccatactagctacaagaatagcagaagcacaagcatcctcatccaaccaagtcttgtacataacatactgaccctgataagtttccaaagcatcatcatactcctcttgtgcctttgctctgtcttcatcagtagtctgagctgaaaaagtaggcatagcttgagccaaggggaaaggggggcaagctagctcaccaaaaagaacgtcccaaaggcgttgaccacacatatgtagacgcatatgctgagcccaatgattatagttgatgccatcaaaaataactgggcaacgaggaactgaaactgtgcctgatagagatgacattggcacggagcaacgggcgacggcgagagcgcaaatgaaagcggcaacaagcgaaagaacaggaacctctctctctctctcttttcttttgtttttcttttcttttcttttttttaacagcctcggagaaacacccaaacgctggtgcaactgcacaggaaaggcagcaagaggctcttttttttattattttttttagaaaaatcacccgatctggatcggtaccgattcgaaggaaacgaatcgacaccggcgggcaacacgaaacgaaatggcggttggcgctgggcagcaacgagcggcagctgctcgacgggcagtggccggagacgggtggcgaccggcggcggccggagacgagcggcgccgcagccgacgaggggcagcggccggagacgagcggcgacgggcagcggctgaagacgagcggcgccacagccgacgacgggtggcagctggagatgaggggtgggttgcggccggagacgagcggcgccgcaaccgacgaagggcagcggcaggagacgagcggacgacggtagccgacgacgagtgattgccggcggtgagcgacgggcagcagaacgaactggagctggtgacggggacgacaagcggtggccggcgagcatagatgagcggtcgccggcgcagagacaagcagcaccggcgaccacgacgagttcgatgaccaccgcgaaaaaatcgaccacaaaaaccaggtaacgtgtgtggaaaaatctttggatcatctaggacaagaagaaaagtctaaccctagtttaggctctgataccatgttatgaacagcacttttattcaccttagggcaaaaggcccaaatatatacaggtacaggaatacacaaatatacagaaaaaccctttacaaataaaggaatataaaatctaaatatacatctaacagaaagaagctcaaatataattggtaaccagaattttggtattaattggagccggttgggaacaattaccataggcaaaatgattgcccagctttacatttaggtgcaaatcagacagcgaattatttttatgaaaatgacttacagaattggtagctactttggctaagcttggcaccattagtagccctactaggctattatgccccaaaaagaacatcttaagtcatttggagcaagtaaactagtctaaaaggatatgcctactttgcactttattttatggtatctggccagaagcattgctacttaattagacttcactctaggccagatatgattacctcaaaatgcagaaccaaggcagactaggcaaggttaaccacttaattaggcttctcgaaatgcagaactaacataatcaaacttctatatcttgtaaagtaggggctatatgaagttcacccaaactgtaacgctatccagttttcttgtctccagtgccgtcaatggggacacaacagcaatgaaatattaaaatgtggacactgaccagttctcgaatgtaatttatgtaagtatggagatcaagatcttggattgttaaaaaggacatagacctctgttagaatttcaatggttactctcattgagaagaggatggcactcgagatgggacaattttctggttttcttcattcacaaaacacaaaagccatacctacccgagggaggttggatacatatatatagccatagctggctgctagcctattgctgcaccctcctagtctaaaattcgaaatttaaatgggatgctgtcctagagggcatccaaactgaataaagcataaaggaggcataaaggagatgctaactgctgctgtcctactaaccacagctgtcctagcaactgaaaaatatgctaaagggtagatgctgtcttgaaaaaggtgaaactacccaaaagcaaaaagaagaatcacgaccaaggaccacaaagacttatccaacattctccccctaagtcttgtgcgtcgtcttgtggggaagttgggccatcccgatcctagagcagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttcgtgaaaaacggggttctttgccagggccagagcggacttgctatccaccctgagctccaccgttccagtgtctctgccgaggagatcactaagcagtcgagcaagccagagcgcctgggtcgaagtggcggaggccgccatgtactcggcctcgcagctggacagggccaccacctgctgcttgaccgactaccagctaacgaggcacttgccgaggaagaagagaatcccgctcgtgctcttgctggtgtcgatgtcaccggcgtggtcgatgtcgctgtacccgacgaagtgtgccttgccaggacacctcgggtagtagagaccgtggtcgagagtccccgtaacgtagcggatgatcctcttcacagcatgctgctgctccgtcgtcggtcactgcatgaaccgactgacgtagccgacggagaaggccaagtccggccgtgtgtgggtgaggtagcgaaggctccccacaagacgccggtactgtgtagcatccacctcctccgccgtgctgtcgcggctcagcttcagtctctcctccatcggagtgagagctgggttgcaatcggtgagcccagccagctcaacgacgcgcttggcgtaggcggtctgtcgaagcgtgatcccggagtcgtcctggtgcacttcgatccccaggtagaaggagagaggccccagatcactcatttggaaggtggccttcatctcctccttgaacgccgcaacctccgcatccttggtgccgatgatcaccaagtcgttgatgtagacacccaccagcaaggcatttcctccattgccccgccggtagatggccgcctcgtgcaggctttgctcgtagcccatccccttgagcgtggaatccaacttggcattccacgccctcggtgcctgccgcaagccgtagagggccttgtgcaagcgtagcaccttgccctccttgccgggaatcacaaatcccggcggctggtgcacgtagacctcctccttcaagtcgacattcagaaacaccgacttgacgtccatgtgatggacgccccagccttcatgagcaaccagcgcaagaaggagtcgcacggactccatccatgccacgggagcgcaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctctaggtcgcgaggcaccagtcccggcaccggctggtcgccgagaagatcctccatcgtacggtaccgtagctgctcgccgtcgtggtacgcgtcgatgcgctccccgtcgtgggagagcggagtagcgaactccaccgggctgcgctcaacacgagctggcgtcggagtagacgtgcttggagtggctgttggtgctggagcatgtggagtcactggctgaggtggtgtcgacgaagagctcgtcgtagtcgaagtcgtggcccgagggtgtgttggtgtcggagtcggtggagattcgggggctggggtagacacgctcggtgaagaagagctgcctactcccccagctccctcgaagtggacgtactcgacggtgaagtccaaccatcgtccaccgccttgtcccatacccaccctcgcccttcgtcgaacacaacgtcgcgcgcagtgcgcacacgctgtctccgggtcgaggatgcggtaagccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccatctggttgcgccgctcgacgacgccgttctgctgcgggctgtacggcgtggtatagtggcgctgaatgccctcatcagcgcagtacgacgcgaattcagccgctgtgaattcgccgccgttgtcggtgcacagcacgcgcagcttgcggccgcactccgcctctgcagcagcctgcgcatgcctgatggcgtctgcagcctctcccttgctgccgaggaccatcacccacatgtagcgggagaggtcgtcgacgagcagcaggaagtaacgtcgtcctcctggtgtggccggtgtcactgggccacacaagtccccgtgcacgagctcgagctgctccttggctcgaaagctcgtctgctggggaaaggggagccgccgctgcttcgtcaccacgcagacgtcgcagagctgctccacgcggtcaaggcacggcatgcctcggaccatctccttggcactgagctgcttcagggcctcgaagtggaggtgcccgaagcgctcgtgccactgccacgcctcgtcgtcccgacgagcggcgaggcaaactggttgtgcgacttgcgcgctgaggatgtagagtcgattagtgcctctggttaccttggcaagaaggcgacgacagcgatcccaaatcctcatgagtccgtcctcgaccaacacgcgtgagccgttctcatccagctgttccacgctgatgatagaattcctcaacgcggggatgtagtagacaccggtgagcagcctgtgctcaccggacttggcagtgaaggtgacggagccaacacccttgatctcgacgccggaggcgtccccgaacttgacggagcctcggacgctggagtcgaactcggtgaagaactcccgtcggtcggtcatgtgatgggtggagccggtgtcgaggtaccacccatcagccttgtcgttgctggagccgttgcagagggagacgagtaccttcggctcatcaaggtggaggaaagccgctgcggccggtgccgctggaggtagctcaatgtttgcatgagctgggagcaaagccggctcttcctccacccgtgcgacgtggacctggccgcgtcgtggctgtcgacagtctttggcccaatggccaagcttgccacagctgcggcaggcgtcgtctcgtgccggcttgtggttgccggtggcaacgccctgggcgcctctgcgggcgccaccctcggcatgtcttcgcgcccaccgtagctggacacctccccgcgccttgcgcggcttacggccgcctgtcggggaagatgactcccccttcctcccgttaccctgagaggcctcccactgctcccgagtgagatggagcttcccgccgatggtgatgggccccaagagaggttgtggctcatcaccatcgacgaccttgaggcgacctaacgcctcctcgatcgacatcgtggagaggtccagcagagattcgatcgagcgagcgatctgcctgtacttctcagggacgtagcggaagagcttctcgacagctctctcctcgtcgtaagtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtccctgccgatgcgtgccgcagcgatggcgtcccaggcctccttggcagtccgcttctgggaaagcgagaactgcatctcgggcgggactgtagcgatgagggcatccagtgcccgccgatcctcgtcgtagtcgacgtcgccgtaccggactgcctcccacatgtgccgcacctgtagcctcaccctcatcaccacggcccactcgatgtagttggttttggtgagggtaggccacccaccgccgggaccaaagtccctgaccaccgtctggacgacgtggtgaccatggcgccgatcaggggagagagccgcgctgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgcccgctcccgtgccctttctcttgccagctcctcaagctccctgtcggcggtgatgttgccggcgatagagtcgttgatgctgctgcgcaaggtctcaacctctacctccgccgcacgtgccgcatcttccgccgcctccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgcgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcaatggttactctcattgagaagagaatggcactcgagatggggcaattttctggttttcttcattcacaaaacacaaaagccatacctacccgaggaaggttggatacatatatatatatagccatagctggctgctagcctattgctgcaccctcctagtctaaaattcgaaatttaaatgggatgctgtcctagagggcatccaaacttaataaagcataaaggaggcataaaggagatgctaactgctgctgtcctactaaccgcaactgtcctagcaactgaaaaatatgctaaagggtagatgctgtcctgaaaaaggtgaaactacccaaaagcaaaaagaagaatcacgaccaaggaccacaaagacttatccaacaacctcaatggaatacctgattgaatcattgacaagtagccttgccctgacaagtttggatcttgctaggtcactgtcctccttgtcactaataaagtttagcatggttagccttgccaagtgtaccaaagtaacagctacctgtaacattaggaacaacaggaaatcaatcactgtccactggagatggaatcatttcaaaaactgtgttaagtagtcgcaatacccagttagaacccaccaggtggactaggttccagctagttgctagtgacaaccagtattaaattgattgtatatgaaacggcaggaaaacccaattctcggtgttattgacttttcatgattccagggatgcaccttcaacagtaaatctcgcaataacatatttgtggaagactaaactgtactccctccagtcacaaataagtgtcgacttttcaaagccaaaagccaataagacataactttgaccacttaattcaattccataaatccaaaatgagttgcagaagcgtgacattatgaaagcttttttgatataacgaatttggccatgttattttcatatacccagatctatattctaaacaataatccctctgtcttaaaatataacaacttctagcactaagaattttgtccaaaaatattacaacttctccatcaacattctcttcccaaccaatcataaccctccaccattcaatttctacacctacctccacttctcaaccaatcacaacctctccatttaattctacttactttcttaataaccgtgtctaacactaaaacttcttatattctgggacggatgtagtaataattatgtcgcatggattctaaaacaacacttatttgtgactgaagggtatctatatggtaattattattttcattagattgatccaaatatttgaggatcatagcatcataatgctactattagagtattagttttgattgccagtttgccactagagtccccagttccccaccactaggcattttgctgtatcacctgacatgtaggggtgcaccgtgaactcaacatagcagatgcaggtcacatggtcttgtgtgtgccgtagctgccgcaaccatcagtcaacaatgacaattgccattggtgatatggacaatactctacctaaagcaagggagtcctacattcttcaacaaaacatttgcatttcttgggctcagcttctcaggacacagcatgcaccaaggaagtgaaacactaatgaagcaatctaatcatgtaatcatcaaactatggaaatggtgataatcaacatgaattggcgatgccaccatgacctagtaaaatacatatggagcaacagtgattacattgcttcccaatcaagcatcgtggcaggggcacatggcacaaatacctcccagtctgtgttaattgccaataaagcagagcttgtggtgaaaaactcaaatacctggtaagtgatctggcaaccataattttaagaaacaagagaattgtgatcatgtaagaaagctcgtgagttttttcattgagatgatgctttcatgttttatttccactaaagatcacgtgaaacattaaatatgatacaaacctgaaaatgttcctcagacaaaatcctttttctgacttcaaggcatctaaatataatacaaaaaataaaattatgttagtaagaaatttaaaaaacaatcaatggccaaaataaacagcttttacgctccacctttccaataattcttcagattccttcaacttccccatggtttgaagagtcattgttaagagttcagctgcattcgtagtgtcaaatgaatcccacccctatcaaacaattgcaaagacgaacattgataggttttgtaaaaaaattggatgattcatgataagatttgataaagacttaagaggttgttcattaaaagaatatgacatataaggttagcatggtccattaatagactcattatgaccgagcctgatattgctggaatatttgtgttaattcccttttcagtttaccgtggactatggtgcatacaaaaataaactactacagggagaggggatagggacaatatttccatcggttgctaagaatacagtattactggaacatggctgaggtggttggcttggtttgttctttccagggtgaagatacaactccatccttatatagctaggctaacttgacccataagggtatgtacaaaggtagagtcgctcttagttaatacatatcacttagagattatcctccaacaatagttgagacaacaag

SEQ ID NO: 16412 - DNA, 1268 bp, Oryza sativa
taattattcatgactcggaggaacacctttgttgtgtgcaaagtcttctagttggttttgcaccaacagattttgatgccagcatggatttttattgtgctctgaactatcgaccatatgcttccgtagttggtggcgactttgcaagcaacaaaggatggtgattttgttttcttctggtttacaggtttatgctgccgtggttttttgtttgatttgcggatgtcatttgcccggcaaattttacttgtatcatgactgctccattttggaacacttaagtaagcttccaccggggcaacgaagtgtgctaagatccactctttaggattttatattcttatactcaccttgttcttcagaagcttctttttcctgcctggaacaacttcagaagttgatatttgcaaaaatatataattttcctttggggtcataacacaaaccattattgtttagtagtaaaaacatgggcatttaacattttcaatataggtagagtcattgggtgttcgctctttttccataactgtagcgttggcaatatgttgccgagttcgcgaggatagtgggcgaaatgctggcaaataatcctaagacctggctttcttattagacctacctcaacactatttgaaatataaagctataataactacttgttatgtctgtgtcgtgtttttgaggtgtctactagagatcaggtattacaaacattatgtttgtttgcgcacataaaagaatataacccctaactgcggtaaggagtattaaaggaataaaatatcttaatttataaaccaagagtagataagaggatataaaacggtaatattctcaggtccagaaaaaagtttggtaatcttctccctttggtgggcatttacgcaaggtactgatattttgagtctcgattatactccacattaaactagatgatgccccgcgctttgctgcgggatatatatattagatattgtagaaatgattaaatgatttggattgaaatattgtgaaaatgatttgagaatgatgtttatgtttagtttagttttagaatgaaataaattgtagatataattactatatgtttgtatgttgagctttatgtgattagtaggttgatgtggcatgcttgcatgctaggctttaggggtactaaggccatgttcaacgctccacgctggagctggagcgtggtctcacccttcccaaggggaatattcatgtcacgtcgaccaggaccgcaccctcacctagcgccgcga

SEQ ID NO: 16413 - DNA, 651 bp, Oryza sativa
ggtttcgttggaccgggcgcacggccgccggttcacgcgaagggccgccggagatcgaaccattccaaacggaccgcccaagatcgatggggtccacgccggctcacgccgaacgactccgatgacgtcagcgatgacgtcaccaccgccgccgccgctcgccgggttcgggctcacacgctcgccgccaaccgccggcgcgccggcccaaccgaaaacccccggaatgaaccggccgccaagcgaacttccccgttgaccaaaggaccgccgaaaaaccaccgaacacccccgccaacaagaagaaaccgccaaacttttcggctttcagcaggcgacggccgttcggcggttcacaagcgcggccaaaccgccgaccgggaccgcggccactttgcgattccgacggttgcctttccgaagtgaccacgaccgccgtaacgacggcggcgcccggctaaaccaacggcggccacggcggcgccaaaggttccgaaggtaaggccgttccccacaccgccggccaaagccaaggaagccaccggtaaaagaaaaccttggggtccttaataaaggggcaaccaaccgccaccgaaggcccacgccgcccgccggcgagaaggaaactttagggtttgggagagagaggaa

SEQ ID NO: 16414 - DNA, 377 bp, Oryza sativa
gcagcagaaaaaatcgaacgccaccctccccatccccgcacacgagtgtagatttcccccgtccccgtccccgtccccgcaacgggtacggggcacccaccgggtctccacacacaacagcaacaaccacgacagcaagccgagcagcgcagaacaagaggaagcggcgtggtcgagcacgcagtgcgcctggggccgccggtcgtcgatctattggctggcatcgaggcgcaggtgcagcacggatggcggacaaaatggggtcgcggcaggcaggcaggcggcgcagtgcagaggcggcggcggcatgtccgcgtgtggactacagcgagatgagagaggaaagaggagaaacgaggaagggaggcggctggtca

SEQ ID NO: 16415 - DNA, 712 bp, Oryza sativa
taattatttggacaaaagagattctttgtccaaagaacacaaaaaaaaatccaaggattacaagagtttgctttgttctcataaatatcaatgtgaaatacttacaccaattaacttagccacttatgattcacaaagataagatataactaactagcctatcaatagcaatttgagaggacccaccgtcttccaagcagcgtgccactttgttcttaagctcatttgctctttccctcatctcagctccctcatttttccccattaatttcataatcgctttctcaattttgcaccactctaactttccctcgagctcaaaccctacaccccacaccgcttccacgtaccttgtatttatcatctgatctgcgaattgaggcctacatatcataagaactccctcacatatactctccaatatcgagttccatccaccgtgtgtccaaaaccagcccactgcacagtgtgccagcacctcctgctgtggggcccacttaatcaccttacccctaccttccaccgcactctcaaacccatccggcaagcatgctctctccacccccctcacaaggtttggacgaaccacccatagaaaaggatggccgctcttctccaacccaaatgcgacctccatgaactcgtcggagtccatggatgccaagctcccaaagctcacgtacaacacggaccctgtcgcctgcgtgtccag

SEQ ID NO: 16416 - DNA, 695 bp, Oryza sativa
cctgcaccccttctcaaattgccatcaacaggttagtgaattatataatatctctctaacacttgaatttaattatgtacctatcggggtgaatcctcccatcgaccaattgggaaaaaattggaaggttccctttaattttcttatttatatgtatcaaaccaagtgatttaaatgtcctcattctcccaatgtccttcttcgccctggcctaggggtaaaatttcactcctctaaaaccacccacatttagttggtcactgtttctgtcccgttgtgaggcatcaagaatcaataagcatttcatcatcgtctttgccatcaacgcacagatctctcgtaggccctatgcatgatattcacgtcatgtggccagtggcggagctagaaagtttccacgtctaggactgatctaatgggaacttaaatattttcataaattacatagtatttttcaagattataatagggattatggagctaggcatggggcccaagccctagctgccctatgcctgattccgcccctgcatatagcctttacaattttcaccatgtatgtggctctctcttgatgcaccacacaacatttatttgactgaagtgccaatagcccatgcataggagaagaagagatgggacaaagtcctatcaatgtgagaaatattatctttccttcatccttatgcaccact

SEQ ID NO: 16417 - DNA, 758 bp, Oryza sativa
cctgcacccctatggaaccaaaggtaaaaaaaaagaattaacaaacaacgcagattaggaattaaatggcttttgattaccaacttgcccccctccaaaaagaccagccagtcccaaaagccgaagaacattttctttttggttttccccttccgggccccccggttaacctccaagggcttcccctcccccggccaattccggcggaagaaacctccccaaaacttattccaattcggccaccggccgaaccgccggggccgccgccgccatgccggaccgcttcgccggccacctcagcaagcattgcacgcgatgcagtccatcggcaggtcgcacatgcccgtgccgcggccgccgccgccgttcgactttcctctgcatgttggatatatgtatatatcgttctcacgtctgcccttctgctgttgttgaagctgcttggcggcgagaggtggaggatgaatggcaaaatgcgggcatatatatgcatataaatgcttgttctgtggtaatgaaaataacatggtgtcgcgaccatggcgacacgcagagctagtcacctgcgtcctgtagtttctgttttcattgtaagcgaaggacgaacaagcgttcttgtgttaatcacataatgacgacatcgtgtataagagcgtacatagaaaggttgacccaaccggtcggtcggtgaagagaccaatgatgactagctaatactccctccgtttcacaatgtaaatcattctaacattttccac

SEQ ID NO: 16418 - DNA, 876 bp, Oryza sativa
caaaattgtgcgcacatgtgaaggttgccaatttttcgccagacaaattcatctaccagctcaagagttgcagactatcccgctgtcttggccgtttgcggtttgggggctcgacatggttggcccgtttaaaaaggcagtcggcggttacacacatctctttgtggccattgataaattctccaagtggattgaagctaaaccggttgtcacaattacagcagataatgcgcgagacttcttcatcaacattgtgcatcgatttggagtgcccaatcggatcatcactgataatggcacacaattcactggcgaagtttttaaagacttttgtgaagactttggaattaagatttgttatgcctcagtggcacaccccatgagcaatggacaggtggagcgagccaatggcatgatacttcaagggattaaagcacgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccgagtgaagttgaattcgagtctttgcgctttcgaaatttccgtgaagaacgctacgaagaggaccgagtggatgacttgcaccgactggaagaagtccgcgaagcagctttgattcggtcggctcgatacttacaagggctgcgacgttatcataatcgcaatgttcggtcccgtgcctttttagtcggcgacctggttttgaggaaaattcaaactacacgggatcggcacaagttatctcctttatgggaggggccgtttatcatctctgaagtcacccggccaggttcctatcg

SEQ ID NO: 16419 - DNA, 1247 bp, Oryza sativa
atgtatttccaagacattagacgaccaagctggagttattcagaacggcatcacttgagaagatgagttacctgaggatgtgcctggctgagcgtgaggtgatccttgctctttatctggagacccaatcactgagtcattaccaacttctggtccttgaaaagttgtctgcgctttagcttcaggaatctcttgatttagatctacatccgactggtttccagtcgggggctctcgggttgttgcagtttcagttgctgccgactggtttccagtcagcggctgatcactcggattggccttgtcgtccgaagcttgggcgccagtcggctgactttcggcagtcggttggctttcggcagtcggctggctttcggcagttggcttagcatctttggataaatttggctctgtggcagccggatcaggttcttttccagttggatctatatcggacggtttcctgcaaagtgtcctttcgatattcagcgtaatttctatgagagaagcatgtcgaaataaaatggtaccgagaggtttatacctggaagatgttctaatctttggcatttgacggccagccagttttttcctgggcatggtatgctttgggggtttattgggcgttcctttgtccccagatttgttgctgtcatcatcttcgtcgtcattaagcaccagctttctcttgcgagaacctgtctgcccagccggtttagaggtttgaggttgcgggtctgacctgattgtcggccctccgcttccctgaacggtgtgctggcgaggagatcggcgttgagcagttgggggatcagatttcattaatacatactcctgaatgagatgcttccacggttagctcactcaacatgaagataaaattatgttttggtcatgagttgaaggtttcagatacgtacctgtggaggcggattgaatgcattatatggtacaactggcagctgatgtgagtagctgacgacaatagcatttgagaagattttatacattctctccttcatgattttaaagtccagagagtctgggtcttcacggtttggatcatgcttgccgtcgaactcgaatgctgtgcgggatctctctttgattggagctaatcgacacttaatgaaatgccgagtgatttgctctccctgtaagccttgctctttgagcttcagcatgcgttccatcagttctaaggcttgggcagcttcatctccgatcggaagagagttccaagtatc

SEQ ID NO: 16420 - DNA, 858 bp, Oryza sativa
tccttcaggttctcttccgtcacgtcggacggcgcccattggccttcgaagctttctttctcttccgtcatcgattttccccgaatgcactgatttgattcgagggatggcttgggaaaggtgaggaattgaggcggtggatcacgggaaggattttgattactttttgaaggtggatttgagtggaatggtgaacccttatttgccggcgcagctctgtactgtagcaaggagtggggaaaatggcgagagttccggcggggaagacgaagcgtcgtttggatctcgggttttcttgttaagggtatcggaggtgcgaatgggcctaggcctgaacagtacctcagcccaatacttttaacagcgtggcccattgtgttccttagggacttaggcattctttgcttcggcaatttatgtacacaatagtgttgcccaatgctgataaaatcctttttacgcggtcatataattctttggaattattgcgatgcaaattaaaaggtgcctgacagaaaggcgttatgctgttttgtacgcttttttaggctacaaaagctgtctgggttaacttggaatgacttgtttttatcatagtcatttccttggtatgatatatacctatttccattgtggtaaatagtcatagcctaggctattagacttatttgttaccataatttttataatatttggtgggtaatctttagagtttttattcggatgcctgtcaagtgtgttcattcgtgaacctttttagagtgtaaaccactcgggttctttttattatgactaaaaagcagtcggctagaatgcctctttaggcgtcgcgtatgcttttgtcatgtgatgcgcgat

SEQ ID NO: 16421 - DNA, 17680 bp, Oryza sativa
ttgcaggtttgcatatttgcaagagagccgcgtgcatcacgcacgcatatatgcatgtgtatacgtgacacggtaacacagattattggcgaatccaaaaattgtggcgcgcgtgggaaatggcctgaccatacatgatatagggcgtgtccactttactaccattttcaatcttaccaagttttagcattgctaaattttagtaaagttgacaaaatgttaacgaggttgtcaaattttggcaagatttcatatgtgcttactaaaatttagcaacaaactaaacgtagccaaaattttgacaactttaccaaagaataatatggttgaaaatagcatcatagtgaacatgcccatatactcacttggttttttaataggtgacacatttgacttttaaacatatatttgatcttctgttttattctaaaactttgtgcaaatacgtaagatataaataatgcttaaagtattttaagtgataaaacaactaacaataaagtacatgataattttaaaaaagtgaataagacgaatggtcaaacatgtatcagaaatcaatagtgttatctattactcccttcgtcctaaaatataagtatttttggacttagatacaattttttagattctactttgaccaacaataagtataaaaataagatgtcttaaataaaaagagttattatgatattttgtttaataataaatctagtaacatcaattttacatgattgatctttttaattatttttgctattaattatcaaagttaaaaaggttgacttgacagtatgttataaattttatgttttgggatggaggcagtagaaaaaaaaaggtagtatatgtacttacatgcagtatgcacattattggtaatttggtattacaagataaccgtgacaacaaataactgtaggttttgacattgggttatatatcctacattgatcaataatattttcaaaatattctaatagtttagcataaaagatgtatcattagattttatatcaaaattactatactaatatcttatatttaaatttatctgctttcctatcggttaaaaattaatagttaaagttctccggtcaaccaataaacatgcatgtatgaacgtgcagggagtaaatgtatttcacctagcttttagagcaggtttaatagtatcgccggctacaagctataaatgtgtaccatgtcatcttatagttagagagtacaataataaactgttgatacgttaaacaagtaatatctttattaattttttaatcacctcaatctctttcttctttacccttccctctctcactccgctgcaacactgacaaaaagcaatgcacagacgtctaggagctcgtgtgcgctggcgactaatttaccgtccgctcgcaccctctttcctcccttctctcgcccatatcatcatcaaatctgacgtgtagctcatatcactggctcaatctaccttattaaacctgctcttatgtggggaatatttcggatatacatcacttgtacttagttgcgaaaagcctaattcccgaacacgcgtgggcacctcacgaatgcgcccagacaatggattggtgatagtggcaggggcaaagtgagacgaaagagagggggaggagatcaactgccggggccacagtgcatgctttggtgcctttcgatgctcgcgaggctggcggttgcagtggaggaggtgagaacaccaaaggggagagaagggagttcgccagagaaaggccatctttgacacatcccgctcctatcgctgaacttgtacgctcgttcacggtcaagtttggagaatactaagatggagagagagagagagagagctggagattagggtaatgggatgctgggctgtcagtatgcgtttgtaacccataaatgctcgcctattagccccacccacttagttgtatggagttttgttcaaactctaaaaaacttcagtcttctacgataattaattactccggtgcacgtaggtcaattaggcgtacagtcaccggtgtgtatgctcttttgggaaaaaaaaacattttcctaacttgtggctaattgcacgtgcagtttatcatcaagttttacttaagtccatacggcttgctagcatgtcatttggcgttaattatacctaccacacatgcagcatgccacattgcctctgtcagaagaaaatgtagtagtagcttcgagacaacaaagacgacagttttttctccacaacaatctcgaggtcaaatcttgattaattatgctaattaacgcgatccggatatacaatctgcagatatattacttaattacactaatgatgaaacgctaattgcctttttttttctccaccaagttgatgaaatgatcgatcacctgtcttaccattaccttaccgaaagtccctttatgagatagagacgctaattaaatatagttttccatgagaaaaatgctgtcactgatcaattatgcttagagaaacagtaaccataataataaataaattcattccctgctgtagcaaggaggcacgtgacgcaagcatcaacgtcagaccgctggcccattatccgatctaagcccacgggccccaggctcgaaatatccggcccatatacttacatgggccgggatctgaaacaaacatcaggcctaactacgtaatgggcccagatttaggcctcctaacgaggccttgatgggctaagcgccatcatgggcctccgctttttttcgaagcccacggcgaattcccttcccagcgccgccgtagccgcctctgcgtcggggtttgcgcgggaaaaaccgaggaatttcccgccggttcgcgccggccgcggttcatcattctttggcctctccgaaacctagatcccaaatcgacccaagccatggccgccgccgccgtcgccgacgaggtcaccgaggcgatggagcaagtcgaaggggagcgtgaggaggccgacgcggtcgctgatgaggccgccgaggtgatggagcaagccgaaggggagcgggaggaagccatcgatgcggtcgccggcgaggccggcgaggtgatgaaggaagtcgtcgaaggggagcgggaggaggcgaatgccatggccgatgaggccgatgaggcgatggagccggaaggggagcgggaggaggaggcagacgccgtcgccgacgaggccaccgagccgatggagcaagtcgaaggggagggggaggatggcgacgccgccgcgcaacggccggcgctgccgctggggagggtgaagcggatcatccgggtggaccgtgacatcaagaaggtgaccaacgaggcggcgctgctcatcgccgcggccacggagctcttcgtcggctccctcgccgcgggcgcccacagggccgcctcccggcgcggccggcgcgcggtgcgtgccgtgcacgtgcgggccgccgcgcgcgagcaccgccccaccgccgacttcctcctcgactgcctccccgccgccgaggaggcggcgcctgctcgcgcggctgccgccggtcccagccgcggcggcggaagaggagaggcaaagccgttgccacgtgggacccgccgcatcgacgcgttcttccagaagaccacctagtggtgttccctctctgtatgtgtctaatgcatccgctgctctaaatgtttggagaaaaatttcactcgcagatgaaactatgaatttttatcatttcgttagtcaagctcgtttccaatgtcttgcaatgatttggtatgacctgctcaaatcttgattccggttgccgtgaattttgcgatgcagtttcggtaggaattggtctttgtaagatgatctagctaatatatttctaggtcctggttcaaacacatgattctcaaaagaatatataatgctaatactaagattgcgacttaccttagtttcagtgatcctctgtgattcacctctctgatagattacacttattctgcaaacagtttattgttttggtcttcatgcagtgattcggtaattatatgctgacgctgtgacgcatactgtgataagaaacacaaaacaaggttgtccttagctactttgtcgctggttaggatgccgagccgtgttggtttcatctgaggaagtagcttgattccctcttgccatggaacatgttagcatcacaaaatttgcatgagtggaaccccacacttttgaaagaatcccacactttttgggtgtttacctgggaaacaagtaaggccttagtttttacaccagttttagaaacattctgctctctttcttgttcttatttgttctcaaaaaatcatgttcattttacctgtctaaacaggataaggatcagaatcagcatattaggatggttatttatgtgtaaccactaattccatatgaattgatgaataataaaattgttcttttattgcataaattcagaaatgtcaacacactgcttgcctgatgagtgacaataatctcatatcaacagataatacaaattcgttagagattttctgctggacagaactactcctggtaaaagactaataatatgattttcagatttttggcatctataacatatgaatgttgtgagtccctaaactttagggcactgacttctgatgccacaaggcatcaatgcacataggcagcttctttatatctgcacaacgaagctatgcaggaaatccaaaggtgaagcttaggctcatttgctgcatgcacctcttccctcagcagctcataacgctgcacaaccatgggccccctttggaccttcattctgctatatcctgagatcttcctagctatcatctgcttcttctggttttcactcttccgtcccatcaggcagcgccagaagagcaacctcccagtgaactggcctgtttttggtatgcttccattcctcgtgcagaatctgcactatatccatgacaaagtcgcagatgtgctccgcgaggcggggtgcaccttcatggtcagtggcccgtggttcctcaacatgaacttcttgattacctgtgacccagccacggtcaaccattgcttcaatgccaacttcaaaaactacccgaaaggcagtgagtttgctgaaatgtttgacattctaggtgatggactccttgtagcagactctgaatcatgggagtatcagcgacgcatggcaatgtacatatttgctgcccgtacctttcggtcctttgcgatgtccaccatcacgaggaagactggcagtgtcttgttaccctaccttgatcacatggctaagtttggctcagaggttgagctggagggtgtcttcatgaggttctcactagatgtgacatactctactgtgtttgcagctgaccttgactgcttgtcagtgtcttccccaatccctgtgtttggccaagctacgaaggaagctgaggaggcagtgctgttcaggcacgttataccaccaagcgtgtggaagctcttgaggctgctcaatgtcgggaccgagaagaagctgaccaatgcaaaggtggtgatcgatcaattcatctatgaggagattgccaaacggaaggcgcaggcaagcgatgggctccagggagacatcctgtccatgtacatgaaatggtccattcatgaaagtgcgcacaagcagaaggatgagcggttcctccgtgacacggcagtgggtttcatctttgctgggaaagatctcattgctgtcacactgacttggttcttctacatgatgtgcaagcacccacatgtcgaggcgcggatcctccaagagctcaagggccttcaaagctccacctggcccggggacctccatgtcttcgagtgggacacgctccggtctgccatctacctccaagccgcactccttgagacactaaggtgacacatctttgatctccccattctcccccaatctcactaacaattaatctccctctcttcatcttctgacattctgaccaactattacattgcttgaattgtgttccaggctcttccccgcaaccccgttcgaggagaaggaggcgctcgttgacgatgttctccctaacggtaccaaggtgagccggaacacgaggatcatcttctcgctgtacgccatggggaggatagaagggatctggggcaaggactgcatggagtttaagccggagcggtgggtgtcgaagagcgggcgccttcgccacgagccaagctacaagttcctgtccttcaacaccgggcccaggagctgcctcgggaaggaactcagcctcagcaacatgaagatcatcgttgcctccatcatccacaacttcaaggttgagctggtcgagggccatgaggtgatgccgcagagctctgtcatacttcacacgcagaacggcatgatggtcaggctcaagagaagggatgcagcttgataaccatgctgtcagcttagctatcctgctttcttgtgttatgtatatctgcatgagactagatgtctatatgcagagttgatgagatggaattattattagaaagtgtaaaatgtctggttggattagtgtcagaattgtaaccatgtgaaaggaacaaaaatgttgtggtgattggtatatgattgtgtgatggtctttgggttgatttattcaagtatttgtgaagaacagtgtacttaacatatcagttaagacttgagagtaagtatcgggtgattattattatctggtgaccacgtctgtatgtgatgggctttacaaacctgcatacgagaataggataattcttgtttcgttttcatgaccagttcacaagtaaaccattagactgcagaggctccatcatttcttcacttttaaaagaaacatttggctgggcccacttatatttttcgtgtaaactcagaatcgtcaagcgaattgtattggttcagctcatcgaaaagtttgatggtctcattgtcgccgagtagttggtgaaagatgccttcagcttgtggtgaaatgtgacctctggatgttttttggtgtttttgcaaatatttatccaaactataattttatttttgaaatggtctagaacaaaggaacaaaaaaaaaaacagaagtagcacatcgctgttcagtttcaaaaattgtactacaaagtaagttcaccaaaagacttcaatagcacgtttaccagagactgcaaaactggtctgctttcttaatggaaatgacgacttcagacataggtaaaccttagtgacatatatataagtgaagtaaataatatttctttgaggccattaggcaaactttcttaatcacaagaaaactcttttggtataccagcaaggcctaatgaatcatatatagagtacaggagtaccttatctgtgggcagttttaacttgttgcactagaagagaacttttggttggagaaaccagaagtttgcctaatggtggcaaaatgatcagcacaaatggtagcactactgacaatagtggattgtatgatcctcttttccaaccctgtctgaccagaaactaatggccagctaatcttgatgtgatcagtattcagtggtaacccttttatgtctactagaacgaacttgctatacattacatcaatttggttcaagcaaagaaaataaatcacatacttcctccagacacaaaaagagtgccatatttaaattcatgcagttaacataagttaactttaatcataatgattattcagaaatatgaaaatgacacgtgcaagtttattataacaaaatatctcataatatcacacttatatcgtaacacttttctatgtatttatagaaaggagaattaaatggtcaaagtcataatttgtgactagagggagtaacattcgggaaactattctaatccctcgagggaatgttccctcgtttgctcaaaaaccatctaaacggttatgaaaaattctggaaaaatttgaaaacattcatacaacacatatatacaactccacaaaatcttaagtccaaactcaactcacacgtcgagatataaaaaagacaaattcagcgtatgaatagtagcgtactgtttatatctaaatttgtcttttttgtttctcgatgtgtagatcgaatttaaacatgaattttggtggactagtaggtatcattatactctacattatcaattttttttagaatttttcacaactattttcatcgaatttggaagaaaaaggtatacgaggggatatcccctcgagggattagaatccacactcgtaacattctgtttttttatttttccaaagtaattgcaatacctacatgttcataggtggttgcatttaggtcaatgttgatggtgaatccaatataatacttcctccattttttttatatttaacatcgttgatttttttacttacgtttggccattgttctcattcaaaattttatacaaatatgtaaaatcataaatcatgcttaaagtactcgtaataacaaaacaaatatcaacaaataaatgatgattagataagttcatcgaataagataaatagtcaaacttagatccaaaagttaacggtgttaaacattttaagaaaagggaggaagtttttttttttttgaaaagggtagggactagggaggaagtaattgatgtggaagaaaagataactcatttgttttcttgattgaaatgaggtggcattgcctacttgccgtgcaccatatgactcctccctcctcatcactccctttcacctaatgacctaaacccaaaccctccacaatttttatcatctatataaccacacgaaactccatccatggcggcgagcgagctcacaagtccacagagacacacctcaccagcttgatcaagagctagccaagccaaatggagctcctgccatggcttctcggcttcgtggtcaagtacccggagatcatggcgtccgccgcttgcttcttgctgctcttctgcaggtttaggaggaggagcaagcggattccgacgaactggccggtggtcggcgcgctcccggcgatcgtggcgaacgccgggcgcgtccacgactgggtgacggagttccttcgcgcggcggcgatgtcgcacgtcgtcgagggaccgtggggctcgccgggggacgtgctcatcaccgccgacccggcgaacgtggcgcacatgttcacggcgaacttcggcaactaccccaagggggaggagttcgccgccatgttcgacgtgctcggcggcggcatcttcaacgccgacggcgagtcgtggtcgttccagcggcggaaggcgcacgcgctgctgtcggacgcgcggttccgcgccgccgtggcggcgagcacgtcgcggaagctcggcggcgggctcgtgccgctgctcgacggggtcgccgcgtcgggcgccgccgtggacctgcaggacgtgttcatgcgcctcacgttcgacctcacggcgatgttcgtgttcggcgtcgaccccggctgcctcgccgccgacttccccaccgtccccttcgccgcggccatggacgacgccgaggaggtgctcttctaccgccacgttgcgcccgtgccatggctaaggctccagagctacctcaagatcgggcactacaagaagatggccaaggctcgggaggtgctcgacgcgtccatcgccgagctcatcgctctccggcgagagcgcaaggcggccgacgccaacgccaccggcgacgccgacctgctcacggcgtacctggcatgccaggacgagatcggcatggacggcgccgcgtttgacgcgttcctgcgcgacacgacgctgaacctcatggtcgccggccgcgacacgacgagctcggccctgacatggttcttctggctgctctccaaccaccccggcgtcgaggccaggatcctcgccgagctccgcgcgcacccgccgtcacccaccggcgccgagctgaagcggctggtctacctgcacgcggcgctgtcggagtcgctccggctgtacccgccggtgccgttcgagcacaaggcggcggcgaggccggacacgctgccgagcggcgccgccgtggggccgacgcggcgggtgatcgtgtcgctctactccatggggaggatggaggcggtgtgggggaagggctgcgaggagttcaggccggagcggtggctgacgccggcggggaggttccggcacgagcgctcgtgcaagttcgccgcgttcaacgtcggcccgcgcacgtgcctcggccgcgacctcgcgttcgcgcagatgaaggccgtcgtcgccgccgtcgtgccgcggttccgtgtcgccgccgccgcggcgccgccgcggcccaagctgtccatcatcctccacatgagggatggactgaaggtgaaggtgcacaggagacaagaggattgaaccaacttcctttggacactttggaacgaaccatacagttcgaggtttcgtattgatatagcagaaaaacattgtttggtttcatattgatatagcagaaaaaatattgtttagatatgggtgctctgcaatctacaagagctattagggcatacatgcactgatgatactgtgctccattgattaattaattcgtgtatgctaattaatacaggtggtgatcgatggtacattacgttatatataggggaataagagacattagtcacagtgattataaatttacatggttagttgagcgagtggtctgtgatctgatgtgatgtacataaattctattttaaatttaaaggaattttacacatgaaatttctgtgaaattcatgcgttcaaagaggccctaaagctggtgcagtgatggatgcatgtgtagtatgcaaaaccatttttcctccttacgtaaatctatgactactgtctatatgctagataaataaacaactggtaaagatagaatatgtgctcatgtgcacgaagacatgcctatgtaacttacaagaagaagaaaaaaaagaaacaagaacacatacatatgtgcaatgtgtcactcccccgtttcgtgcatcatgtatgatctgttgcaattgtggtgtgtgaatattaactttgatgtgaagatgcatttcattcccccaagaacatatgcatttcatgagaggttgatttagtcagtaaatgaaggtttagtactggtcaatctgttttgtctcaattcaagatcaggaagggtgtagagcagagtacaagtggattatactcaacaaaaaagaaaaaaaaggtccacgtgattcaagtcagtataattttacagtggattttatcatcatgtcacaagattcagatcatgcatttggatgggagaaagaataaactctagacattaattttacatgccatttgatatctgaatatctggtcgtgacacgcaaaattggggcaggatgctgcaggggtgtataattgttccatagaaattttgacagcttgtgtaaaaatgaagccgggcgagctcagagttagtgacagcagtaacaataataataatgaacattaatacagtataaccaaaaggtagcagcagacgaagctactaccgtgtttcgatcaagtacaacgttgtggtatatgatgggttaaaattggctgcaatcactaaaatcacatgtccatcctgaatgtctcaagtctctcaatcgaggatcctccagccctgttttcgcaagcttcagatgtcatttgtatacacagattatcagcattgtggtgagggtgatgattgtcgcggttgtgaagatagccgcctacacatgtggaatggattgaagacattagagaagaatcactgtaactaaaatgctcgggtaatataccagaacaaaatgcaaaagacttatgaattgcgtagattagctgccatgccatttaataatatctcttgcatcatacaaacaatactgttcatatatagtatataccagaacaaaatgcaaaagacttatggcatatatagtcatatgggcccttaagaaaaaaatagggtacatctgaccatacctcattttctttttctatataccaaacaggcaagccccagaatgattacataattaattacagttcaacgcatcacaaaactattagtaatacatactcttaacatgggactccagatcaacacaattacatcaaccaccaaggagtttgatgtcctatacagaagaatcatggacttctttcaggaaaccgttttgatccctggattcttgctataagtaattgtagtgaactagtattataataatatgttcagggttatcgtgaaaggaatactaaccgcaaccgccgatgcagcaagaccagggcgctctcggggatctttgttgtagtacttacagcagtaaagagttgctgcatagtaccagatcaacggacacaagaaacctaaaaggaaactgcaacaagaagatatctgatactgccacatgaagaattttagtttggaaatttgaaccaaagttgatttgggcagcagagaatactcacgaggaccatcctataccacaaccaaagcaaggaagtcgtctttcaaacattgccagccgtgggttttcttcatctctgagcaatgtatacttgccaagacagccctgacaatggcaaaattgatccgagcctgctgcaagatggaaaaataggattaagctaacagaagaaatattctcaacaaaacaaagataacgccactgcatttatgatttatgttaaagctctaaatgtttgagtcaaagtataacttggaagttggaactacagtagtttatgtcatcaatgtttatatactgcaagtaagccagtatcatgacataatctcctactaaaaaaacatgtttctcaaaatgtcagattcaaggattttgtgtatagtacaaaagtgaaatgcttcccacatgtcttaagagatctagcaaggaaaagctaagcttaacttcagaaaagaatgagagagagagagagagagagagagagagagagagagagttggaaacagttaccttcccccatttaatttagagcagttcagcaaagaagcacccagtaatcttaatgcaatatctccgttgcagattcctctgtgccgtagcaagaatcagtcataacaacatgaagataaggacatcaatgatgcaggttgtctagaatggtcatgttgctgtactggagagaaaacaatatgtatcagaattctgctcaagcacacataagtagttgataaaatactttgtgcaattgcaatttgaaaaaagaaataccaaaaaaagaggaaatagcaactactgacaacaagtgccatgtctaaatttctgaacatgcacacaacacacaaatgatgaatatggtgaaaccgcaattagcattagaaagttttaactctagaaatcaatttccaagttgtaatccccatactcccaacccagaagggaaaaaaaacaactccaaaacccccaacttttaaaaatgtgggaacaatcaaaccatatgcttgagatatacccacaaagccatcggcggccgcttacagcagagtacaccctcatcttgcacgcctccgaagaagcaggagccgtgatcaacacgagcatcttgtcctgctccaccccacacagtgacgagtctagggcacgacgaaggcgcgctcctaaaccgtgggctcggggctccggccagaccggaggttcagaatgtgctgtcctaagatacgtagaagcaaatacaatccagaggcatcaaatcctgatatagctctctacctcctcagataactccggtcagtaatttcgtcgaacacttcgcgttcatcgtccgtactccctcatcgcattggcagcaaaaccaacaagaactgaccgtcctcacacagtcccaccaaaaaatcaacaacccagattcgagtattccacccacccagatcatccttccaatcgaagttgcaggaaatcaagaacggacaacacaaccatccaccaaccaagatccaagaaaccgcaagagcaagctagaaaaattcctgcagaagaatgaactcaccggagcaagacgaagcatgcgccgccgccgatcggaacagaggtggaagcaagatttgtgcgttcttggatgggcaacagagagcagcagagccctagcggtgggattccccttggttgagtggaagaaactggagaaagcgcgaggccgttttgtcctcttgctttccccttcttccccctctcaatcgatcgagagcaacagacaaatcactcccaattttttttaaaagaattgaaaaaaaattcaagagcgcacgacagttcacgtctcgcctcctcgatttctttctttacttcgtcgctcgcttcccttccaaggggagatttctctggttcccctctctggtttggtgacgtgtgatagactagtactgtgccgtttggacttgcttgtattgatcttgtccgtccatggcgttcagcatcgaccatctacgtctgagattccacgccacgcacgtgtccgcgctcccaacctaaagaccgcagagccaaataaaagatacggattcttcgtcagaaattgcacaggcatcaattagggcgggagctgaggcacggggcgagcgacgtgttgagagaggcgtgaccccgtgcaaggcggtggcggtcaccggcgaggccaccaccacgagatatgtcgctgcccccaaagcggatctggcgagctcgataaggcgacggctatggcagcggatgaggaagaggaggtggcgcctaacctcgtttttgtcaccattcagctgccgccgagctcgtcgtcgtccccgctcaaaaccacgcaacagcttgacggagagggagaggagcttatcggtgtccagccaaaggaggaagaccgccggttggaggaggaggaggggggaggggtcgccgccgatctcgccgtctcccgcggtccaagccgtcaagcttgtcggtgcaccggccaggagagtagggccgtcggtcgggggagaaaacaaggggagcgccgcccggaaggagaggggatctgccgccggtagggagactgacggagatgggtagatggcgagagagagagaacgggtgaaggggattttttttattatttttttgattctaggggttcaacacaaattctagaaatatgagaactgaacaaaaataatttcacggctaaaatataaaatcaaagtcattcctatagccactgcactgtgagaaatataaattttggatccgtgactctagcctacaaagcacttcgaggcggacgggtctaatccttgaacgttcgcatctcgcgaacaatttaataggttttgtaattatcgttctaatgactgtttatgttcgcatacagtattttattgtttcggttaagcgaccaaccaatcacttttccctattatcagattagattttatttcttgaaaaaaatccggtgatgcttagatttttttattggtacatgcaaatataattcataatataaagtttataaataaaaaagtctaaaatataaagtgtatatacataaagtaagattatatacataaagtctatatatagaaagtttatacacataaaatctatatataaaaagtttatatatataaagcatacttgtagagaggtccatgaaaatactacatataaaaagtttccattagaatagctttaaaaatgactataaagaaaaaaagtaatttgaagaaaaaaagaatggaaaaacagaaaattgatacatacctctacaggagaattaacgtaaaaataaggacaacgggaattgaaaagaatcacataaaaaggaaaaactggaaattaggaacaaaaacggtatcgtagcgatacaccgcaccggcctgcggaaaatctaatgggtgaccgcgatcgggtagcgatcactacccctccaccctctctccctccacgtttcctttttttttttttttgcaccgtattacttttctattttagtaaatttatgcatctaaagtgtatacacctaaagtttatatagacccaaagtttataaatcaaaattttatatatccgattcaaatttaaatttgaattcaaatatttttatatatagtatttctatacatctaaagtttatacacctaaagtttatagacccaaagtttataaatcaaaagtttatatacccgattcaaatttgaatttgaaatatattcgattcaaatttgaatttaaattcaaatatttttttatatatagtatttagatacatctaaagtttatacacctaaagtttatagacccaaagtttataagtcaaaattttacatacccaattcaaatttgaatttgaatttgtatccgattcaaatttgaatttgaattatatccgattcaaatttgaatttgaattcaaatatttttatatatagtatttctatacatctaaagtttatacacctaaagtttatagacccaaagtttataagtcaaaagtatacatacccgattcaaatttgaatttgaattcaaatattagtttatagacccaaagtttataagtcaaaaatttacgtaaccgtttcaattataaatttaaatttaaatatttatggtgtagtaggaagagaaaaagggaaggaggaagcgacggtatagggaaggggcgggtgatcgctcgcgtcccccaccggtctgtcgctcattaccacgtgtctttgatcctccccagcctgatccgcttcttgtcttccgagtctcgcgcatgtttgcgtagtagacttcccgcttcgaggcttctcataagggtaatgtgtgctttttcatgaagaaatatgtctaattctcaatttctgatgaataaaaattccaaatgtaattgattaacttgccttagtacaaccaagatctgatcatgcctagccattccaaaatccaaggccgagtttagttccaaattttttctttaaacttccaactatttcatcacattaaaacttttctacacacacaaacttccaactttttcgttacatcgttccaatttcaaccaaactttcaattttggcgtgaactaaacacaccccaaattgctcaatcagtagtacgtcctagtgtatgtttagttcatgtcaaaattggaagtttgattgaaatcggaacgatgtgatggaaaagttgaaagtttgtgtgtgtagaaaagttttgatgtgatagaaaagttggaagtttgaagaaaaagttaggaaataaaccaggcccttgtacaaaagaacaagggagaatgcatcttcccgactggaaattcccaattgggtgtgtgataaatttttgaatggcttattcctggtttttaatgagcacccttcataaaatgttaaaggatatgttttgtgcaaaagttttatgtatataatgtttataaaaaataaataaatccattttcaaatttatataataattaatgtttgattaatcatgtgctaatgacttatctgtttcacttgctgaaaaaaacgctaccaaaccgctgatccaaacatgtcaaatacttatttgagaagctagagatgagaatataaaagctaaaattagcttctagccttctacttacttagggggtgttggccctctcccccaaacacccccttattcattttctaaattttgttactataggtggt

SEQ ID NO: 16422 - DNA, 3063 bp, Oryza sativa
taaaatccaattgaatctaattgtttcaggaagcttacaaattccgtgagaaaatgcaactgacaaaaactcgtcaaaacagggcgttccaccagggattggattgagcataacctgtattgatgcaaagaagccatcaaagaataacggcctcaaaataatcaattatatatccctgccacgatagactgagccaaaataaaaatgacaccggttcagatttggatgacattatatgggaacatggtgcaagtgctgggaagaacatgttgttatcttattgccatctaattacccattgagattattaaaacagtcagattatatcaaaataactctaggaagagaatttaagaggttgtcagcattctctattcaattcaagccgaagaacgtttgtcagctgaaagtaaaaagagaagtccgagagaagctaaaaaagaaaggagggtactcaccaaccatatacacgaggaaaaaaattactcacatctataatatgatgtactcttatttattaataatgtaataatattattaaaattgtatatatttcaacaaaaatttgtctttaacacagtacaaggtaaaactaaaaatttgtttttgaattattctgctattcaatctttttcttgttatctcattcttctctagtttcaataataacattactagctccacccaccaaattttgcagctgaacactgctacctagttaagtgcacacgttatgtaatatatattattgataatttttatgtgagttagtaataattactgttaatgtccgattttcagattcagagagaaattcggccgaccgcaatagttcgaaggaggaagggggtaattcgtactttttccttgaaattttaagaggctgtcaggcactgttgtttataggattacaatgtccttgacagcacaagcatattaagaaaactgaaactgccaatttaaaggtgccagtttagattttactacctagtataatcgttctggtgcagtcattagatcaacggagaaagatgatcatttgtccacatggcatcacatgaacatggcttgattctcttgtgaatagttgtcaccaaatgaagacatcagaaaacaatgtttaaaattcagacatccaatatcgtgctttaatcatcagaatggcaaacaacttcgacatttccacatcatttcaaggttggcatcacaattcaatagattgtttgatctaagcaagctgaagctcttctgcagaaatagataccaattcttattccaactaaaaagtaactagtcccaatttcatgcacaaaacaagacaatactaaaattcttctgctggtacaattcagcctttcacaaggcaaaaaaaaaaaaagaagaaaagaaaagaaaagaaagaaagaaacaaatcctaatgaaactgattgtctggttcttccattccatgtcatttctgccctcttgacacaatcttgtacttgcctgtcaattgttgctgcaacaataaacacaaacaaaaatctcaaatcgcttaattagtttctgcaaatttcaaccaaaccactcctgaaacgcagcagcaatgaaaatttcaaaaatgaaaaattgtgtaccttttcccagagcttggtgtgctccaagcagaagccggcgacgacgccgccgccgccgccgccggccttggcctcctggtactcgatgcagaggccggcgtcgaggccgcaggagacgtggaaccctaggccgcacctgggctgcgagcactcgagcgcgcagccgccgccgctctcgcagacgtagcacgccgtggcgaagcggtgcgcggggacgcgggagcagtcgacgccgtcgcggccgtcggggtcgcggaagaacacctccggcaccagcagcgcgcacgcgatgtgcgcccaccgcgcgtccgtcgtgcgcttcatcgcgccgcccctcgccgggcagaggcagcagcgtggcggcggcggcggcggcttgttgcccttgctcttcttggcggcggcggcggtgcatacggagcagaaccagtcgccgtcggggatgaacgatgcgagcgggttgtcgtagcaggaggcgtgcaccatgaggctccacccctcgcataacacgatggggtcccacgggtcgcgtcagtgctcccacacaccgcgcatggcacgccatccaccttctattccacctactcctccgccgccgcaacccatggcctcttgcgttggctctcgcgccactctctctccatcccaggagtcttcttcccgtgctgcttcgttgagatcaatcgctttgcaagctttctcgagtgcttcgacttcagattgcttcgcactaatagcactgcaggattgattgcattcctgatctttcgattctctgcaagtgtttgatctttgtttcttcgacacttgctccttgatttcttcatgattgataggcttctccggaatcttgggcttctcttgaatcttggatgcttcagctcttgcataatcatcttccacaccatttgccacgctcgaattggtggtggcgccacgtttattggatccttgaggcttggcttctttaacagcggcgacgcgagctccatccgactccttggatggaggcggcgatggcgggagaaacggcggcatcacgcgcttattgctcggtaggcaaaccgagaccggagcggcggtgtccttcggggacggcggcgcgcgggcgctcttcttggccgggatgctcggagaaacggcggcgtctctcggcggcggcagggtgttgacgagatccttgaacgggacgcggggagaagcgtcagtagccgccgccgccgccgtcgcgctgacgcgcttcttagcagggaccgggatgctcggagaaaccgccgccttctccggcgccggcgccggcggcggttgcggcgcgtgaacacgcttcctgaccgggaccgggatgctcggagaaatagcagccttatccgccgccgccggtggcagagtgtcgacgcgcttcgtagtcgggactgagggagaagcaccactatccggcggcggcggc

SEQ ID NO: 16423 - DNA, 1444 bp, Oryza sativa
gctttttaaccgggaggcacagagggaaaccgcccccctccaccgccgccgccgccgcataagcccgcttcttcgccgggaggcaaacggggacggccgccgccgccgccgccgccgcctccagcatcggcgggcacaaccgcttcctcgccggcaggcacggcgccatcccgagactggagccgccgacgtacttgaaccgcttggaaggcggcagatcacgcacgctcccgctgccgacggcgaactccatggacggaatcgagaccggagattttgctacacggggaagaagaagaggaggttcgcggcgggtgatttgggatcgaaacgaaccgggggtttaaatgactgaaaatttcgcggtcgaatcagcgagatggcgcgcgcgcagccgcgcagcgaagaatctgacgaaattttggctcggtgggaagcgaaatgtttgtaatttttgtttgaaatttcgaatttggggcgtgcgggctgcgggaaaattttgcgtttcgtttggatttcgcggcggcggcggtggcgccagcatttcgctcgattcgggccgtgggcttgggcctaattaggttgggccatgaaaccctaggtgggctcactttttttttcgccgatttataattataaaattattatcttctttttcgtctattgaaaaagacgagggcctagtagccatcgtcgatccccaagtctccgcggcggaggcgctcgcgtcgcgaccccgtcgccgccgccggcgatccgctccagccgaaccccgccgcaccgccgcggtagctgccgtcggcgaggtgcgtctcggcaccggactccaggaatcgtgctgctgctggaacgccgcgcccgctcagccggcggccgggcgtcccgcgtggctcgctggcatcgatcggggatccctcctacgggctcgccgtcgcggaggtttcaggggaccggcgcttggttggtaacttggtttcttttgattgtttaatttctctggttgtgatgtgtgctctagggtttaagccgagttactgggtcaggatgggtcaggatgatatatgttctgcttgttaggttcgatgtattgggtggatctagctacagaagataatcttcgatcttctgaaggggtggtatagagcacgaatcaaccccaactcatcatcatcaatggttctatagtagtgtttggtggttatcctattagtagtcctttataatgattggttggattgattcatgtgctcataattcgtgtatggatcataattttggctcttttcttttctgtaagaatcatgtgaaaatattgttaggcatctctaatataaggtgtttacgcatgggcgcttaaaataattaatcatcggacaattgaaggctcatcgaacatcaggattagtaccaattctctcacaggtggtaagaaagggctgcagga

SEQ ID NO: 16424 - DNA, 18266 bp, Oryza sativa
tatatgccatcattccgttatagcacttttcatatttgccactttaaattgctcaaaggtcgaccatcattagcatatgtaagaatttccagcaaaccccaaatatccttcttgctactcacagttgcgcttccacagtgctgtcacccatgcatgcctgctgcttacaagatcagcaaaataccaagcctctttacagtaggaaggatagaggagtgtgttggagatgtcatatccttgagcactttcagattgtgcttcaggtgacagaaacagagtggccagaaagagcagagctggggtggctcagatgatggcatcgctaactgtggatgtccatgatctagcttcctccttacttcactctttccagcttcccacagctaacactgcatggatcctgcttgcaccatcccaatgctatggctatgttgcatgacaaccagtagtcggttggtggagaacaagcaggatttcaatcttttaaaacatcatgaatagggaaattgacagaatggcaagaatgaaatttggtttaacggaatgatggcacaaatgagaagccgaaagaggcataaataaatgtgcagtggggcagcctatatttcttcctttctatcctttgactaatggattgctcaaaaaaaatttgttatcccctttcccctatttaatcatttcgaccttttggcgcatttactgactctacaaatcaacaggacacgctctttcctcatcaatctgctgacgttttgaaatattggaatgcttctgtcgtcgaatttggttatctacagcatctgaattggttataacttataacttataagtggcatgtctgcgaaggttccaaggtactattatcacttagcagagttactgcagtgcatgcataatcacttggtgaaatacttaaactgtgttttaatttatagccagccagcatggttatagggcattcatgttttcattcatggtttagcactgcttttgtttaatctctacttgtgaagtaagaaagataaaattgttgggtgatataacattgtgatgggttgataaagttgccttcgtcaaacaatacttctttacgtctggcctgtagggcatcatctaacttgcttcacaaatttgaccataaggattaggcttttcataactgaaattggttgtctttcttacttctgttctcttgaccacatcccagaattaaatgaacatggcatctcatacgtttccactaggcatcatatacttatttttagatttacctatcaaaaacacatgttatgcaaaatacaggttatgcaacttcataatcctgtttaagcattttcgagtacttgctgcagaaagtttatgtttttactgttttgatgcatgatgtgatcatgccgataatctgacatacagatttgctttaggcgcctagaagctaattccgttgggatggcagattgggctggtcttcagactgatatccttggtgtaattgtaaagaagcttgccgtccctgactatctgagattccgtgctgtatgcacatcttggaaccatctctgtagggatgtattcaactgtccaaggatagacccatggctgatgctccctacaaatgcgcttaatgattctaaatttttgtgtgtacctgaaaggaagaaccaaaccattcgtctcccgagcactgttacaatctttggctccacctggattcctgttggttcttcccatggttggctcatcttttacagcccatctcatggaaccatgcagctggttaatcccattagtggcatgcagttcaatcttcccccaatcggacgaagggccttctccaaggccatgttgcttgacatgaatgacacaaacttcactgttgctgtcatcttacgtgaccagaaaggatataaggtaacgcgtaaaggaagcaacagctggtcatcagtggaatcaaagcatgatctagtggatatcttcaagcacaggagacagctttacaccgttgatatatatggcacagttcagttgtgggcagaaccgccccgttcatggccagatgaagatgccccgcaggtgaatgacccgtatcataacctcattcactatccgcatcaacatggaaagcttaactgtttggtggagtccccagctggtgatctaatgagggtgaagcggcaatcaaatgataagtttgtggtctggattctggacaaggggacattttcctgggagaaggttgataacatcggggactttgcgctgtttgtcagctactacagctcggtctgttaccgggcgaaggatcatctcaacctgaagtcgaattgtgtctacttcattgactcctacagcaacctgtgcgcattcaacctggagaacaggacgaaggagctcgtcgaagctcttgagcccgcccatgcccacggtcatccagagcctcacgctgtccggcgcaggccggaaggacagaggtacatgtggttaatcccttcgctgagataaaccaatggaggatgaaagctacggtacacatccccgttgtctctgaacttactacagtatatgtgactgtcgctaatttcataaaagtattgggcatatctatagcacttctgtagataaatcaactgtctgaactttggacaactcgtggtttgtgattatcgtgtattttgtaatatatatatatatatatatatatatatatatattatataagttatccttgtccaaattgtttaaattatcatcacccggtcagaaattcagaattgtagatgtaaccgtgttcatgtattgcgggagggagggacgcggcgagagcgtcaggccgtgcactgcagcacgcggccgcgctgtttcgccgtgccttccgtgcaattgcagaggcgcgctcgtctcgcttgctcgcctcgctatatgaggctcgaacgctcgcgtcgagctcaagagcgaccaagaatcacctgactacactcactgacaccaacgctgctgccgccgccgccgtcgaagccgatcacgagctctcccgttccggcgagcagcggcgcgttctcgccgccgccgttcatggagccttcgaccgcgcagggaacatcggtggcgccggtgccatggcagaggctgggccaagagccgcgccagcgggacgggcggtggcgcgcacggtgcgcgctccagctcgccgccttcgccggcgcgaccgccgccttcgccgccgtggcgtaccgcgtgcgccaccggccccgcgacatcgcgttcctggccgtcacctactggctcgtcgcgctgctgctttgcctcgtcgagaagctcgaggccctgcggctcgacgcgtccccgccggcgagggagaccgagctgcggcgcgtcaggctcggcgtgtgggcggtcgccgtgacgctgggcaacacggtggcgtggcgcgtctgcgacgcgatgccgttcctggcgctgaagctgggcgtgtggggcgtcacgctggtggtactgggcttcgcctactacttcgtcttccgttccaaagccggcgagtgccacgacgaggagcacggccatccctcaagctgacgccggcggcagccggccgccgccggagaaagctttccgcgagttgcactggaggtctgaacttggtaggatatagtactacagaaattattgaacgtgaaggatgaaataattcttctaaacatttctaaaaattgaaatgaaatgttttgtttgattgaaatttgtaacgctactaaataatactataatgtttaggccgtcaaagcccaacgtaggtccccatagtttcgcttattcgtgaaataaacaaaacggcatatttgcaaacgaaaaataatttatgaataaaatttttgtatacgtgtttttagcgatctaaaatcaatggttgaaaaataaactttgattaaaaatttaaattttgactgataagcataagtgaaaagatggggccatgtttccctagaagaaagaaattgtaagattatccatttggaaaaaaatatgtattgacagttttcggaagctgtataaccatcgttgtctctctgcaaaagcaattgagacatggtgtctgctgatggcgatgtctcgctctcatgtactttctccgtctaaaaaaaatctaacctaaacacaaatgggacattacatagtacaacgaatgagcatgtccagattcattgtaagatggaacattacatagtacaataaatttgggcatgctcattcgttgtactatgtaatgtcccatccgtatttaggataggcttttttttacggaaggaatagtatctattttttaggaactgaaaccaaatgaattgattctactatcatattccttttcccacaatccagcttcagaggagcgagccaaactgccaaaaaggtacaaacaacgcgtcaacgcgtaatatttgcgtaagttcgttgatagatttgaatttaagaagagcacaaagcagtagctataaacattgacaaaacattcagaaattcagaaaagtcagtcccatctagagtagtacatgtcaagaacagtaaagttcctcctggcattttcgccttcaatttgacaaaacctcatcctagttgttggattattagttgaaaccacatgcagactatcctgaaaaaaaaaccatgagtaggcgagtagcagatcagtataccatagatttttcgtgaccatcacgcgtggtactgtctctacgtgtacgccaagcagatcacccggaattactcttgagttcccgcttgtgtgaataagacgacttaatcatgccggtactttttttttacccacaggttaagtcatgcccacagagactcattaatcacaaaagctataattgtatactacaaggaatgtgtttgttttcctctagaatcaaacgctccacgaacagttcatattgtactttagattcaagctgtagttgtaaaattcaaagagcgaactagaagctaaaagtttagaaaatcagtttttacgtattcttagaagttagctaccaactaatttctcagaatcttaaactcgcaaaacagactataattctcctatcggtttaaaaaaaaggagaaatgacaaaaagtcttcaaagaaaaatttttaaaagtgatttacatttcaaaaccctgatggtattatgaaagtaattttataatttaatttacatttttgctttttatgacatataatttaaatttataaggtattgatgctaaacgttttattcgacctatccccactacgctatttttaatacagaagattaagaaaaaagagagaaaaaactatgatgcctctttaaaagtggtagggataaaatttggtgaaagttaataaagaggtaattgggtgccataaatcttttccggattagtacgctgattctcatctaattcctactacatgacttgacctgctggtcaatcatatttatcgatcctttacattttcaattttttttccccagtgaaacatattctcgatctttgcacgacaatttcctcgcaaatttttttgcagagaagacgtcaagcaagagggtagtatatataacacaccttgttcattgtggatcaataacgatcgggcggaactaagcccgcccctgaacctgaacaaaagcctatcgtcgtacaaagtcgtaatacatattatccgagtgtgacgtgtccaatggacgatgacctgtcgaagaaacctcagcgggagcaggacggcgacaacgcgctgctcccgtgcgtcatcgcgggcttcctcgtcgccggccacgtcgccgcgtgcacctaccgcgcggcggcggaaccgcgtgacctcgccttcgtcgccgccgcgtacaccatgctcgcgctgctcctctactgcgtcggcaggttcgaggcgctcgccgccgacggctcctctccggccgccgccgtggcgagggagcggctgaggctgcccgtctgggcgctctcgacggcgctgaccgtcctcttctcgtcgcgcgtcgcgccgatgatgccgccgccgctgaacgcgctcgtcgtggccatgtcggtggtcgtcaccgtcggtggcttctgcttgctgttcctcggcaatgcaggggaagacgacgacgacgaggacgaggcagcttctgatcaggatgaggaagtctgattcaaccacattttcgaactgtcctttgtaattacaggaagaaacgatcgaataatcaatatcaacgtttgacaaccgtgtgtgtataagaatctgaacaactaattaagttcgcgttgcagtagctgtttgctagtagtttctatgtgtaaatttttttctagtttaggcgtgcaagcactttggttactgcggtagaaagttatttacatatgtataaaggctgttttccccctctgaaatcaaacgaaattttatggtagaccacttcatcgtgccgctgtgaatcttaggagtaacttttagttttacatatttcccttctcctctttaagcaaagacttgcacgcctagattccgattatctagaaaattgtctcccgcctatcacaacatcatagaatctaagtaattcaaaatttgatcaacaaagtaactatataaaaggtacatatttccctcgtaactttaatatttgctagacaagcctgaaatagttataccccctctgttctctataagcatttctagaattcaaaattatacaacataaacattttgggtcagtcaccctgatacacggaaatccatactttcaaatcatacaaatttatattgtggtataaattttagatcatagtataaatttgaaacagatggagtaatacatttgatacattttaagaaggtttcatacatttgatctaaacattaaaaatatatatcgatgctttttattatataattccacttgaaacatgtcagaacaatacgttttcgtgaggacctatcatgtccgagtgaaggaaacatgacacggagagatggacgacacaagcttgctgacgtcataccaaatcggtgttgtgacgttgtcaacctgtttgctgaactgaaggtttgctgttcgcctagcgagaaggtttgttgttcgattgaaggggagtaatacaacataggagtagcatttttgtggcactaatttcaacaaatggattttcgtcctagatttgacacgggtgtttgcatttacggctaattattctttcagtggtaggcgacgtacccgccgacagcgaggcgcctgtggtgacttcgtcaatctcaaaatatgccggtccagtcttccggaggtgctcatagggatagggtgtgcgtgtgtacgttcgtaggggtgagtgtgtgcacgttatgagcgcctgcgtttgtactgtgtttctcaaaaaaaaaaagaatcagaactagaaatgtttatatcatgatacaaattttaaactctagaaatatctacacttcagaaatggaaggactaatacatttcataaggtattcacacatttgttctaagtactaaaaagatgtatcaatgttttattattttttagatttcgacttgagtcatgttcagaataatactcccttcgtcctaggttgagtttcgtatataaaagttaatttattttaaaatgaaagtagtatgttttcatgaagaaatatcatgtctgagtgaaagaaccaaggtttaaattcatgtatagaaaattgtttatttgaagacggagagaatacgttttcttgaagacgtatcatgtccgagcgaaaggaacaggccgtgcatgtcacgatgagagatggatggcgcaagcttgctgatgtcgtaacagatcggcgctgtgactttgtcaacccgtttgttgaactgaataagcagacgaattgcacaatgcacatgtcacatgcttatgctcccacagagaaggcacgcagattgctaaaatgcagccttgtaaaatactacaagtcttcaagagtcaagaccatctttcgtttacttcactttgttgggacactagacttggtcggatcaggatttatgactcgggtcatgtctttgcctatgcatttcccatacccatagctttcaggttccaaccaaacggcttttagttgatctaataagttctccctttttctcttttccgtcaggcatcagctatataaacagagatccaacgtaagtgctaggaggactcgagtctcctctatccctttggatcaccattgataaaatgagagggacggaagaataaggagagaaggaagagtagggggttgaaggagatgagtcccctttaatcatattctatatctgcctaactgagggcatgttctaaagtgcgatagatgatgaatgatgagtcggtgactgaaaacttagtttatggcaactatttagagtacaaacgcttcaattcaatactagaaaactaccaccttcagtagtttgactattcaatatccatcttattaaaaatttagtataaatatgaaaaagtatatgtcatacctaaaatatttttaataataaaataagtcacaacaaagtaaacaatacttttaggatcaaatgtcaaccacgtcaaatattttaatcggaggagtaaaaactttatttagaaaaaatattgctccctccatccaaaaatatgagcatttctattcgttttcgtggtaaggaagtatatggaattgagtgatgtgagattgtggttggttgaaaagagaaagtaggtgtagggactaaaagaagttaattataattaattgtgataagaggatagataaaaaaataattactacattttaagataaattaaactctagaaatagatacattatcgggatggagggaacagtgtttagaagcggctgtgtttggagtagccgattggaagaaaatcggtaatttttcgtgcacgcattcctgaactgttaaaaggtacatcgttttgccaaaaaaagaagtaaactataagaaagttgttttaaaataaaaccgtattaatcatatgcatgtaactcaacttgttttacatatcctctcaatcctctattttcccgtccttccaaacacattcttagggcctattttttggaagaaaaatcaaatgatctggatttcctaaggattaactcctataagtataagtatcattcggttcataggaatgtaggtccggaaaaaccaaaggaacattttctttcctaaaagttgcagagagaagagaaaacataggaaattttccatccatccaagtctcttgaaaattcctatggattgaagtgtgtaagcattcttattctttcaattatttctattctattggtggaatttctcccaaaggacattctcttgtgactacatgtgggctcacagcccagtcatagccccataggttgtccacgaggcccattggatgatagctggattgagagccgtcggatcgaatccaacggatcagattgagtccaggaagagagacacgcgggtttgcacgggcgagctcgccgtctctctcgccgccaccgtcgcctgcttcgctcgcgagagaggagccatggctggagcctcgccgtcggcgcgcgccgaggtggtcgtcccgccggaatgggcggcggctaccgccaccgccgccgccgcctcctccgagcccgcgccaccggtcgtcgtcgtctgcgggcccaagaacgccggcaagtccaccttctcccgcctcctcctcaactcgctgctccccaggtaaaaaccccactctaccccccaaagccctagctctgcttcgtcggcgaggagctttgttcgctgacttggagtggtgctccgctccggtgagtgtttgtaggtatgggagggtggggtatctggacacggatgtcgggcagccggagttctcgccgccgggatgcctctcgttccacgtcgtcgacgaagctctcacaggtgacgagatgagatggcatctgtgtgcggggatttgagtgttaaactggagatgtttctcttgagtgattggttaattgggtggtttgagtttctcacagacgtgttgttggcttttgtgcagatttgctcaacccaactctgcgtgagtgtgaaaggtgcgtgattttcccccttttgtgactgtatgaattgcgaagtttgctgttccttgcggagtggtcataccgcttgattgcttcggtttagtaatcttcccttattgtgttcttgttttgagccgaacaacattattattcctattcaatgctgcaataagttcaagaagttacttagtgaaaccatttgctattttccttgctaggcagttttttagactgtggatgtaaagttcttccttgggtatttcgaaactattatgttcagacaactttttacctaacgccagtgtttcttttctttaaaaaaaatccaccaggtgttgcttcttcggtgatatttcttcaaagcgagatccagaaacatatctgaattgtctatttcatttgtatgactattttgttgaaaaatatcgatctggtgccagtgaacctctacctttaattgtcaacactcctggatgggtgaaaggtatatattatgaattggtcttttatgacaggatgccacacgtttttttttagtttgttcactaggccctcctttatttgttttacataggtgctggttttgatatgctggtagagatgctaaggtatatctgccccacaattgttgttcagatacgcatctctgcgcagagcaagaatctccctgatggaatgttttggttagattgtgggcaaacaggaccaaacatgatcaatattgatgctccatttcatgatgctttgaatagatcgtgagtaacatttcatttgtctcagtttgaagttcaagttgatgtcaaaagatatttccaatcgattagttgaagcccagtgaaatagcctccttaatactttgatgaatatttttatccattgtatgcttgtaggttagagcataaactgtgggtcttgtatgacttgattgctactgaaacttgaattggcaaacagtaatgaaattatcatccaaagcattcaggaatctacgagttctcttctgtgtggaatggggaaaaatagtaccacaattagcgcctcttttctgcctatcaatctcttctccatgcaataagagattagggatccatctacctgaattgataatgaaagaatgcttcaagttctttttgttaaaatgtgcatacgttggtaattatgatagtgcatttcaaatcatctgaagctattaactaaattatatgctatttgcttggtgcaaaaatagcaatgaacgttcttttcctgcagtgctctaatttcacactactctgatgtacccgtttcaagtaccacacctgctgcaattgtcgaattaatacttgcagtcatgtattctacacatagtagcagcaactgctttaatgcatggcaattggcaagtactaatgttgtttatgtatttactaggttgttaatccagaaagattcttatggaatgcgtgagcgccggcttatagagtacttcaagcaatgttttccaagtgacatatcactgacaacaaataaggagcttgcctatggcctaacttcacttccaccctatgaagtatcaatttcagatgttatggttatacatcttcattgccaggtcttttggctccacaattcttttttttttctttcgaattataagctgaggttggaattatgtatgtgagatctcaaatctaggtctttgtatgccctgaatggtaacaagaatccactcacgcttattattttgtccctgttcaggtacctcctagtgaggtatggcatagtctaaatgctaccatagttggtttggccattagctgtggcacgatcgaggcaggccgttcaatcccttggtgtgctggtcttggtacttcctcgctcttctcacatgcatattctcattactatgcatattctatgatttttcagcaacctagtcatgtttcattacacccatgatcaattagtgtagatattgcaaattattacgacaatggcatccagcccttatattgaacttggtcacttgtctgaactttcttatccaggtattatcagaggcatcgatgtgcaaagaggcattttatatgtaataactcctgttcctctagagcatcttcaaagagttgatcttttgcttcagggactcattgagatcccaaagtctcttctgcaggtgacatttccgttttcttccatgtcccctgcttggtttaacgagtgtagaatccatccgtagtatccatgcacagagattcagtaggacaacccttggttccaatatataagcttgtccagatgcatagccagaaatgcttacattttggaatggagtacatgtgtagtcgcatttggaaatgttgcttgatactcaattttctccttggccctaactttgttctgctgcatctgaaacgcctcatgtttgtaacgagagagaagcaaatttgcttccccattactaattaatttgcctgcgcaggtccgaggatgcgtctcaccatacatgccaacgaatgtgctgcacaggatttcggagagggacataaacacctgagttgacgtcgaacgcccttctcctttgccaccaccgttcggggagatgatcctgaacctgttcagaacagagcagagcagttctgacccacagatggagacttgtaacctgtgcagtactgccatgcttgtttgtagcccttgctggtggaaacgatgatatatcattatctgcaattcgttggagacatcggaaaatcaaaattttgaccttttcttgtcctctgcaaaaattgaccgtcaaaatttagtaatgtcaaatattggcgcatgttagattaccaaaatttcgtagtgttggaatgtgtaggtgtagccttatcaaatgttcacatagggttgggttggtttgagatctaaattgaccttttcaatttttggcaatgccaaaatttagcaagttgtggcatgactaattttgggaaggcaatgttgtgtttggattgaagttaaaataagttaactattgaaatggcctaagaaaaggcctattttcttaggcatgttaagatttggcttcaaactaaatagacaataaatactattgaaattgacaaatattggtaagccgtatttagacctcaaaccaaaccagcccatagttcttactccctccgtcccaaaataagtgtagttttgtactattcatgttcaacgtttgaccgttcgtcttatttgaaaattttttaaaatttttttatgattagtatttttattgctattagatgataaaacatgaatagtactttatgtgtgactaaatattttcaaatttttcacaattttttcaaataagacggactgttaaacgttgggcacggatatccacggctgcacttattttggaacggaggtagtatttggttcggttgccttaacaaaattatcaaaatttgatagtgccaaaaggtatttagaccaacaggacatctgcatcttcggtaccaaacatcaaaggaacaatcacactgcttatgcatacagaccatggcaaaacgatctcacacgtactactagtctactgcccgctccaccccagctcactcaagaacatttgcatatccacaaacgcagatccaaaaatacagaataacttgcctgttcgtttaatctctcggcccaaaaactcggaactcggcttagaacgaggatttaagggaaatttgaagggattaaacgaacaacgcataatttgcaggcgagacaagagatttcaaaagatgcagagtatatttattcagataagcagcagaacatccccatttccattaccaaacatcaaaccatccatcatcatcacatcgcatacggcatacagaccaccatgtcctcacattctcacgtagcaaacgataaagatgaacactctactcatactactagtcacaactcactcaactcaagcttcgattctttgatccacgcagcgacgcagatgcagagagatgcggaatctcatcacgcgaccttgacctcgatggtcttgggcttcttgggctccggcggcgggagcttctcgacggtgacggtgagcacgccgtcctggcacacggcggagatcttgtcgacgtcggcgttgtcggggagcacgaacttgcgcatgaacttgcccatccgccgctccatccgcaggtacttgcacgactcctccttctcctcctccccgccgccgcgccgccgctccccgctgatcaccagcagcctctcctcctccacctgcaccttgatgtcggaggacttgagcccaggcatgtccaccacgaacgcgtacgccccgggcagatccttcacgtcggcgggggtcgccgccatggcgcgggcgtcgcgcacgtacgcacgcgtcgggccaccggtcgcgccctgcttcccggcggcgccgccctcgccgtcggggatgtcgagcaggtgctgcagcgccgtcatcagcggcgtctccagcccgaacatggcgctctccatctctcgatcgcctcttcttcttcttcttcttcttcttcttctacctcggatcgcgctggggtttgtggcttctcgatcttgtcgcttgattgctcggtgggaggaggggtttaaataggggtgacgtgggggtggagtctggaagggagtggaaggttcggaaaggtggtggaatgggcgcggcgaggcgggggcggaagggcgtttgcgacgagaaagatctagagaggtggatattttcggagcgaggggggagcgggtttgggtgggggggccgtacggttggttcgagtgggacccacttgtcatagggtggtgtttgacaggtttcctcctttattatttttcttttttcctttgagaggtttgccttgttcgctccttttctgctgcgatctctggattctggaagcttctcaagtcttcggcttacattttctttgagtggagcgaaggtgctacacttataccccggtttaacttttcgactagaaaatcagcgcgccaaaaggcgcgctgttaatttatatcctgtacatgtaacaggaaaacggtataattttacatgagttagtttattttcaataaaagtttaattttccaaaatgatcttttaatggattttagtattttctttaaaaatgatgagatggatcaaagtagattagtaatttatatttgtcattaatttggatgtgttgtttcactctgacaaatgattttatatatgctacttcctccgtcccaaaaatataacaacttatagcatttataatttgtcccaaaatataacaacttctccaccaacattctcttctcaaccaatcataacccttcactatttaatttttctacctaccttcacttcttctccaatcacaatactcccccatttaatcataccaactttcttagggtgtgtttaggtggtggagaagttgggaagttgaaagaaatttggtagtttggagaaaaaattggtagtttatgtgtgtagaaaagttttcgatgtgatgtgatgaaaagttgggaatgtgggtggaactaaacacggccttaataactgtgtcgaactctaaaaatgcttatattctaatacatgaggattagggagaaaaaacaatctaatagttttattcttaaaattgcagcgaatttataaaacctgaaagttttgcaaataaatccacaaaatttatagtattagtggaaaatgattttaagaaaaaatatgaggcttataatgtttgatcgaatcgtttatattatttctatcaattaatttttctattttttaggagtattttatagacatacgtgatatcgatgtagtaagatatacttgcttccattcaatgtacgtgatatcatactcctaataatttcacaaaactatttgtgtttctttcttttttaactcttttcttcttcgtatgcctgctcctgcacgtgtgatactgtgattagccgctggcaaggcctgagcatgcgtgagtgcctagctagatgccagcccgtgcgtgcaccgatagcacttcgacctttaccttttctttcaagcggtgcgtcctatggatttatctagaactagcagggatcccgcggcgttgccgcggacgccaaaaagcaaacatcaataaaaatatctatcacaacaattactcaaacattaaaagaaatctatcacattaatctcaatttcaggtgatggaatattgaattgattacatggtgtatgaatagatactatggaaaatattggtatatgaagatatttattggtgtaacttttattgatgtcagcttaaatcaatcataggtatatgagcacatggtacaatttgatagccaaaagtaagatagaccaaaccttctatacaggcaacgttgccactagcagcttcattgattcagtcaccaatttctttcttccaaaccaaagtggctgggcagaatcacagacaacccctaataagatacaaaacaaaaccaaatgtattctaatgttaccaatagactgatttgctaaaactgtaagtttgtaatccaagggagtaagaccatgggcatatctgtggtgacgcaagatgaaaacatatcatattaacgtaaaccaacctctttctttgccacctaagaagttagagcaatgcaggtaccttcgttgaacctgtagaaaacaaaagaaaaaacaaaaatcatttagaagtgaatgttcagtacatgccaaaacagcgcgagacttttttgtgttacgtattgcatagatataactcagaaaatggtggtaatgaactgctaggaaaaaaacaactctattttatatgttatgtcacacttctcacttgctacctccgtccctaaaagatgaaagcaacttgtaggttgatcactaatgcatctggagatggtccagtttcacataatgatgtgtgacatttttatctgtaaagagagacaaaaatcacttgcaaataagaatggtaaatcacatgtatcagaagccaacaggccaggggaagaattaatttcttgctaaggaaaaaacaatacatacagtcgtaaacaatattaacttaaactgaaaatcaataaaatttgtaataacatattatcaatataattgcccgatataagcagggatcaactttgaattaacccgtacaaccactgcacttaattccaaatagcacctgtatataaacaaatatgacaatctagtttgatccattaagggatatccaaacaacctataagcagcaacccgtacaatgcgtgttccatatccaaactgattgatttgcaccatggaacggttgcaagccagataacggtcaattcattcctgaagatcatatactgaaagctgaaatgttctgaaaatgaaaaccatgcaaaagaaggatggacatcgatcagatatcgtatgcatgagaatgtatagaagcaaagaatttcagagataatatttttaccatgtttgttgggaacagctatatattggttggttggtattaaaataggcaacaacttgtgcatgcactgtaaagcaatctgaaagtacaataagcagtcacagtctcacagagacaaatctgtaatgctactgattagagaagcagggaaagctgtagcaaattaaaagatcgaagcatagatttggcatcgcagatcgatgaatgagaataaacatatgttttggacgaaaactgattggtaccttggttgggtggtcaatgctcatcaactgaatgcatgtctaataggtgtaactgctgcaacaataatcagtggcgaagccaagatttagagatggagggtgccatctacgagacatggcaactcacttaaggtttagtgaacagtgattttgtagcgttgatgtatgatcggtaactcgatatcatacatattatagcgattagctacaagagagaacaagaacccatatatcatgatttgccaatttaaaattcagtaatatttttaatatatggatgattgaacagtttgtttcattaattggagtcttgcaatcacttctaaaatgataaatcatttagctaagtcatttcataagtcctatatatatatagctaggcaggtgtgtcgtgtcctatatagttagtctcatcctgcaactaatgatataattaatagctagattata

SEQ ID NO: 16425 - DNA, 6841 bp, Oryza sativa
cagaacaggggaaagggaatagacactacacggaagaaaacatatagaaaaacacataccgctaaatcttggtcagaaccaccggtggtccaaatcctcttttcaaggcctagaagtattgcagccgtcatggctcgatgtagcatcctcccgagcctggccgatagggagatctgggatgcaacggcctccttggtggagataatacaagcacaggggcataggcatggtcgcctgggtagcgcgcctgagcaggtcggccttgtgcactgcaggcgaaggtgccgtggtgtgaggagggacgcactgggggcgattcaatcaaagcagcgctcccgtgagctggagatccaagcaaaacaaccagagaagtcgccgaggggcttacagagcgattcgaggccgagaaaaccctagagggagagggtgagacggggtgccgcgcgggggtggaaagacggtggtggtctccggggagaagcgacggcggccgtggatggcctcgccgggaagcgacgacggcgagcaacgggagctgcgtggccgagctcgagacaaaaggggaacggcggcggcgtcgtaggtgacgacgcggtcaagactcgagagaatggggaatcggcaggttcgtggctggtcctcctcttcctgtcgtgagtgactgggtggtgggctcaatcggcctggcccgatacgatgcaagcgcgtggctgggcaggagatcggacggtgctgattgttggggcgacgtggccgcgtgggcgaatgaatagtgaacagtaccgacgtgaggtttataggattttatatgactaggggtgaacgttggatagaagggaatgtgctagtgctgttctgaacctcttgcgcatacattaacatgttttatctaatctaataaacatgattaaatttagcgtttgcttttacagtagtagaaatatgaaattgaacaatggttagtctgaggaatcataagcctatgatctagctggagtcttctccggtttaagctaccaattgaaacatattaattgatgcctgataaacatatcaattgatgaacaatgctggagttctatctcataaatcaacaaacagaaaagcaacttaattgaatcacttgcaccaatctataacttccatgtatacatgaataaacatgcatcattggtatacgtgagcagggataaacatgcggattgtataggaactgcaagaaattttaccatatgtgcaaaaacagggaaggtaagagatagagtaactaagcaaaccgtattatgtcctagcagtggtggtcagcttgcaccaatgggcaaacctagtctttgaggtaggttaagcctaggaggagggaaatgttggttggtaagcttacttccactccctcgctatgcacaaaacagattgacataatgtaccactaagcataaatgaggcaaagcatcaccattgtacgtagtgagtggcccactgaggaaacatccaattagtgcatatatcgacaaatatttaaagaaaaaacaactaaaaaatgtttctagttttacctgtccttcaaattcttcagaggttgtctcacagtgcgtactgatgaattgtaaaccaaccaggtaaaactgaaaataagcaaggaaacaaatcaatcatagtaagtaagtgaatggtaaagctccttgacttttaacaatctaaaaataaataaatcttgagtgtaaggtgagacagtggacaggaagaaaaggcaaggcaatctaggaattgttgaagaatgccaagacatgattatcattttgtatcagcaaccatgacatgtacaatccaacaaaatgtctgacaataattcatattggcaaaatataaattacagcatattgccaaatatatttctgcccataaacagccagatcaagtgttagataaaaaagtgaactttgaaactgatatgtttgaatcaaagtagatatatatcaagcagttgaataggtcagtgggtctgatagcaaagagaaacaatagcatctagctatcctcattcatatgtaacaccgtgaataactgaccatgcatctcagttttttttatcatctcagatttttgtcagttggtaataactgagcatgtattgttttttaaatggaagttgcatgtagcatagtcatttctgaacgtaagcttaacagaaccaataggtatcctataatgctatacatgagtaaacatactgtagtaactggtttttagagaaaactactggcatatggacaagactggcaagtgatggatccgcacctgtaaatctttcagtcaaagaagcaacgtcttccagactggcatcacttgccaatgaaacctgagaccaacagaagatattaaaaatgaaaatacatcaccaacaatgaggttgttaagacaccaataatctaaggagttcacagctggcaaaacccgtgattaaaaatatcaacagaagacaaaatggcaaatgagagctcacctctctagagtgaacctccagaatttccaaacactcatgccatccaggaaaatcacataagacaaatcttccaggccacaagagtgcaacatcaattgattgtggcttactgcacataaggaagaagaaaccattaaaaaataaaggaaaacaaacaagctattttagttccaatcttattctcaccagtaaaaattcagtcttcatagcatttcattccatgctaactatttcttgacgatttgcgactggtcattgcagtccatttaaaattgtttggcatgctgcaccaactacatcttcttatgctttgagagctaaccttgttgcagcaaatacaaatactccagtcaagctttctacaccatctaggatatttatatacacatcaagtcataagccacaatacaacatttgtctgaattacaacaattcaacacaaccaaccattgtctgagtataggtcataccgttcagacaaatgctgggtggtagcacaaatgttggggaaggatgccttggatcccttcatacgaagcaactgggtggaactctcgaagcaattgaagaactcgcagagcatctcgtagctgaccaagtaaaccacccacaaacaccaactgaaagttagcagcagtaaaaattagcatctcaatagatcaaatttaatggtgggtatggagactatattcactaaaggagcgagatctgcaattaggtatcagaataattgtctgaaactaagaaaaattgcagaattcaattgaaccagatccaaatggtggagcctggacctttacctctccggcagcttggccttgcgcttgacggggctccggacggatgtgggaccaacatcgagctgccgttccacggcctcgagctcgtcctcatctggcgccagcgacgccgcccccctctccgaccactgccgcagctcgagcgccgcccgccggaccccccttgacagagaacaccacgccgccgctgctgccatgcgccttccgcaccgccgccgacggctgctccggcctatccggcgtccagatgtgccctgccgccgctgcaaccttccgcgtcggcttctccggcgtcaagaactggtcggccaacgcagccgccgccttccccatcttctgtggggtggcgataccggccgccgtcttggccctcttcgatggcggcggcggcgactgttaccaagtgcattacatgtattccctttttgttaccatgagccctaagccgcctaatcgccggcgtccaccgatccggaaatgaagaggatggagagggagagggagagggagagggagagaggggcggctgccggctccccctcgcctcagaggggccggatctgccggcgaggaggccggagtcaccggatccggcggtcccggcctcctcgttggcgtatgcggcggagggagcgagagtatggcgacggcagtggcccgcgtgccgggcggcggctagcacggcagcagagagtgcgaggaggaggtcgtcacctgcaggaagaagagaatgaggggggcggccattgcttgggcaggagagagagcggagcgagaggaggagaggaggaagacgaatggtggcggctagggtttggggaagggggttagggttttttctattttacgaaaacgcccctcatcttatacttttcagagcgcggtacgattttccgatttttctcttcttcgtatagaatatttttgtttacagaggtcctgtaagtaagaacgcataacgttaaaactaagggatagggacctgtaacaaattatcaagtaaatgaagggcttttttgcaaaatggccagcgatgacgcggaggcaggagctctcgcgaaatccctactccttccagcgcgcgctgacgtgtcgcgccccggccgcgtccacgccagcgcaaaacgctgaggagcgagcagccgggggtcacttttaatactttagactaggggcgagagcgcgcttcgcgcgctgctcttgtggagctggaagtttttttcatcatttaaatgtataggaatatagatagtgtagtgtattttaaagagaaaatcccttatatacccctgaaatttttcctaatcccttctatacccctgaattttgcttacttccttatatacccccaaaatttgattttgatcccttgcatacccctcccgttagttgaccgtgtattttctataaaaatgaccattttacccttggatgaacaaagaaattcataaattacattattaaaaatataaaagcttctcgcatgagactattatagttatgagtttgttgtgcgatgcattatttatcccaaaaaaatatttttagataatgaaataaaaaaaatacgtatttatttttttaaaaaaagatcataaaaatgaggagcattcatataaagataggtataccaatgttcacaacattttttttatgaatgctcctgataaaaaaatccattgtcctattaaaatttcaaataaaaattttaattttttacatttattttattttcaaaatttatgtcaaaattttctgcactaattatttagtctcattagttttataaaatgcacacgatgtgcactcaaacaaaattttcaattatttttgaagcttatatttaaacctaaagcatcaagggcaaaaaagacatttgcaaccaaacgtaacagtaaaatgatggaaaatgtaacggtaggggcatggaagggatcaaattgaaatttcaggggtatagaaggggtcgggtaaattttaggggtatgaaagggatttagtgagttttcagggatacacagggaatttactctattttaaaaatctttccatgccgtaggattgagacaatggagtttgcttgtcagaataatttgtgctatttatcatgtagtgtattgtatggttcgatatagctatagtagaaaataaaaggtttgcgtataatggtgtctttgacatgaaggagaaatgtttaggtagtacgcagccataactatattggttccatataagtagtagttgttcgaacaacatttcatagcacagaaggtggcaaggaaggtaaacataacattacttatttacaatgataatcatgacctaggggtcatgaacaaaagggcttgcttcttagcctctctaggcttgcagctaacttgttgcttctacacttctagcttgggtggttcgttctgtacatatacacaaaagacttgctgatggactacatatatccgtctcattcactgtaggaatgaatgatgagtttagaaatttagtgaagtttactaaagaattaatgcgtatgtgtggagaggtgagctgagttattcagaattaacctgtcagtgggtttcttctgggtactatccttgaacaattttttggcaattgtggtggtttctgtaggtctacctctgttcattataaggacatgtcaaatacaatgtgtgcgagaaatgtctattactgtaactttgaactgaaagctttacagacctttttttgggtgtgctctttggcgccagtgaaggatctgcctgtggagactcatctggagattcagcggtgacctttgccttgtagaagaagcacttttttttcagaaattgatggattaggttatgaaaagaaagagcatgaataccttatccgaagtatcacggggaacaattgtagttaaagatgcactttgtgagatcttctcttcatgatgagtgccaatttttgccttgcatagttggtcaataggtcagagtgtatctccaattatttaggaaaatttgtttatagcagaggaagtgcaagagtaggtattaagaaggataccttagtatcagtagaggtctttgcagtgtgagatggcatagagtagcctgagacaataatgctttttttggtaaatactaaggagcttgatttgctagttggtgtctcatctgttgcagcagcaggagtgtattttgttggtgttgaagtgccctgtgctggtatgatggctaattgcgattcggtgcttgtttcacttggtgttggtgctgtctggagagaactgcttgagcttgccgatacaattgctgatgctggctgtgaagtacttggcgacataagcagcggtggttgatttgctggaccagaggatataacactattaacctggagagtttcttcgcttctgttaatatcctttgtgaagctgacattccatagaaaaccattgtcaacaagtgctaagatttcccttggaatgaattcactgtccggtggatttttttcgatcagagattccactggccttcgtatgatgcgttgcgcagtt

SEQ ID NO: 16426 - DNA, 1801 bp, Oryza sativa
tttttaacagaagctcaggtgtcaggttttccaattgaagttgtcattgaagtggtattgtttcttattttggaaagtagacattttgattatagttcatggggaaaaaaactatattcatttgttctctctggttttgtgttcaggcagccaaagagataagggattcaagattgagaactcatatactaacaattctgaagaacatgatgtcagctagaaggaaatcctctagtaatgtatcttcaggaagtgattcctctttctttgctgttgatggtgacaactctatggaacttttctctgttcttgctgtctgtgaaaaacaaaagaatcctggggaggccctcctgaataaagcaaaacaaatgcagtggtctttattggctatgattgcttcttgtttttcagatgtgactcctctctcatgcttaagtgtttggcttgacattacagcttcaaggtagcacattgagcatgtcatctgtagaaattctgttatctaattttgcaagcttcattactatcactggtgtgtaatattattgcattggcatttatgtctgtcatcagggagatgtcattaatcaaggtggatgatatttcctcgaaaatagcaaaaaatgtgggatccgctgttgaggccacaaataaattaccaagcatgagtaggaatgttgaatatcgttacaacaggaagaatccaaaacgaaggcgattcctagaggcttctcaagaaagcttcacatcaggtttctcatcatgtggaccaagccctactgcaactcctaattttccaaattttgatgttcagcagaaaatactgaagcccatatctgaagagactaaaattccagttgatattgatgaaagatttgcatctttgtcaagtatggtagcagtgctttgtgaacagcagttgttcctaccattgcttagagcttttgaaatgtttctgccttcgtgctcccttctccccttcattcgatctcttcaggttggtatatattcattttttgaaagtactggtttattcaatttaacataatcatttgcactatctttttaatttaacattatcatttgtgccatctttttaatttaacatgatcatttgtcctatctttttaaggcattttgtcaaatgcgtctgtccgaggcttctgcacatttggcatcattttctgcaagactgaaagacgaaacatcccatgctcaattaaactcttccaaagaagagtcagctatggcaggatgggtagctgttactgttgtaaaagccgcagatgcagtactcctgacatgtgcatcaatttatgagaagagatgtttgctacagctccttgcagtggttgatttttctgatggtggctcctcagcagcttactttcgccgaggttattggaaaataattttggctgaaccttctgtatgcaaagatggtgatacctacaagtggaatgattccatggatgatgcttccctcttagcatcattagaaaaggatggtcgatgggaggaagcacgaacttgggcaagacaactggagtcgagtgatgtagcttgggagtctacttttgatcatgtgacagaatcacaggtatttggtttgtaccttcatctgttacattaccaagtgtgcccttatgacttttatgctgatatgaattttttctgtgtgtgtaggcagaagctatggttgctgaatggaaggagttcctctgggatatcccacaagaacgtgcagctttgtggagccactgtcaatcgcttttcatgaaatattctttacctcctttac

SEQ ID NO: 16427 - DNA, 12427 bp, Oryza sativa
caagagcaaggcgaagatcaaagacaaatacgctacttagacgggttgccaaggatagtgttgaaagtagcataaatgattctggtgataattctaactcctttaatagctcaaagattgctggacaagcaagaagtttactgtcagaagaggagtttgcaaagatgaaagtgtctttatccggttgggagcaaaatgttaggcctgttgatatggagaaggctgttctctccttactggaatttggacaaataactgctgccacgcaacttcaacaaaagctgtctccatcgtatgttcctgaggaacttgtccttgttgatattgctttaagagttgccaataacagcagtaatggagagatcagtttatcatgctttgacccagaagctctttcaatacttcagtcactaggaagcaatacgactgatccatcagaggtctgtttttttccattgtacttatttctttcagaactttctattagactattacgaacattaaataacaggattgattgtttgcatgactaattgaactgtaatgatgaaattacagtaataaatattttgctcgcagtgcaaaacacaacaaaagagttagcacagaaattggtattgaatgctactgttggtattatctcagattcattcattttatgagtacaatagtgctccggtattaatgatcacatggttactgccttttccatggtcagaattacaggctatcattgtctcttgaaagttttggtaataaatgtttgagtggtgcacggtccacaaattacaacaagttgttctttcttttatgtcaggttatggagaaactagccatgaaatgtggcgagggtcgtggacgagctcttgtcaggagaatagcagcagttgttcaaactgcaaaagtactgggactcccattttctgaagcatttgagaaacagccaattgaacttcttcagttgctttctctgaaagctcaggattcttttgatgaagctaaatttctggtggagacacacaccatgcctgcatctagcattgcaagaattcttgctgattcctttctaaaggtacaccaactacaccatcctttaaacacacttcattttggaggaacagcaaaggcattctatatattgtctaatgtgcttttaatatttggcaggggcttttagctgcacatcgtggaggttatctggattcccaaaaggaagaaggccctgcacccctgttgtggaggtctagtgacttcttgaagtgggcaaagctatgtccatcagaaccagaaattggccatgctttgatgcgtttggttatgactggccatgaagtaccacatgcttgcgaggttgtatgatcttctaagttaccaagacaatactgatttgtatacatgcaaatgccatcttctaagaaatataacttatccaaacagtgttatgcaaagttcatgtttgacccttgatatattatcaaggtataatatttaattagtgtcagtatgattatgccataaatttgttaatttcaaaaaaaaaacatgcacatcagttttattccactcataaagtgactaacttatggaactcaagtaacatgcactcaacttgatgaggtgtcggtgtttaaagtggtggcttatggaattatggaacaaatcagcttaataaaaaccagttgatttggagtattgggatttcagtccttttttggttcgtgcttcttgtggcctatgggtaacaagtatctattactcttgcgcataaccttatttatttcactgcagtattggaagaaacaagttataattgtataagatctgaaactcactgactcacctgtatttgctttaaactggccagtgctggctagtgccctgttgattgtgaaagaatttgctagtttccacattctttgcatcatatattagtaggtttatactgagccactttttaagccattgcttatatagagtgaagtgaagaaccaatttcctcatttgaaaactagaagttatccatctttgtcagtcttgcgttgtatttagttcagtattcctagtgttgttaactataagttactgacatttgactgtggcctgtgggttgcttgaaagtaatcaaatttgcagaatactgatatgcatgagccttcgttggtattgatatgtttgtgttatcttatgtaaacttaatgtatccaggctacttagctaccatcagattgactatggtttggtttgaattttactgttgtatgctgttcccttgccgtctctgaactttcctttcaaatgttttgcaggttgaactcctaatactgtcctaccacttctacatgtcttcttcttgtctcgatggagtggatgttctagtcacatttgcagctaatagagtggagtcgtatgtgtcagagggggatttttcttgtttagctcgcttgatcactggagtgagcaattttcattccttgagcttcattctttccatccttatagaaaatggacaattggagttgttacttcaaaagtactctgcaactgactcagccactggggcacctgcatcagttagagggtttaggatggctgttatcacctcactgaaacattttatcccaagtgatgacgacgctctttctctggtatatatctctctctctctctccctctctctctggaaattttggtttctgaaatgtattgatgtctgagacacgttcttttaccatccaattagtctgcatacaatcaaacaaccgacataatgtgtgatccaatctaggtccaaagccaagtagtgcatggcctgaaaggagttcatttatcacaaaggagcatcactgtggatatatctgatgacctaatgctttgtcaaagcttaaaactgctgattgagcacataccatgccatcttcgcttttgtgcatacagaaaatgtgctaacaacagcttgttttaatctgctagagattatctagttgggaaatatatgaggtttgttagtaaactagagatagagatcagattagtttccgttatattcaacattagtttcttggatgtcaagtcagtccatcctatatataaagcgaccccatttatcatattatcaatcaagcaatgaatctaaagttagtcaaataaacctcagaacatctcttagctcgacagggaagccctgtcagcgcaatttgacgacgagtgccctatcctctgtctaactatcttcatgcccttatcctagccagttcataagttctatctgttgattgagcacattcaatgccatctatgcattagtatgtacagaaaattcattgagcaattttagcttatttagcatctacatgaagaataaaagaaaacctgagactttagtttccttcatagttagtcgatcctgacagcttcacttttacaatgacaagacatacctcctggctgtttctttacattcttacaacctctgtatactatgcaggtatataagcactttgacatgaagcatgaggctgcttctctccttgagtcacgtgcagaacaatacatgaacagctggttatctcgatatgacaaagaaaggaggaatgatgagctccttgaggctatgcatcaccttgttgagatggctgaggttctttcaacaattgatgctggccaaaggacacaccgggcgtgtgcgcgagcttctctcctatcacttcagatccgtatacctgaccttctgtggattggtctttcggaaaccaatgctcggcggattttcgtagaacaatctaggttccaagaggccctcattgttgctgaagcatacaacataaatcagccgatggaatgggctccagttttttggaaccaaatgctgaaaccagatctaattgagcaatttgtggctgagtttgtgttggtgctgcccctgcagccaccaatgctactcgagcttgcaagattttaccgggcggaggttgcagccaggggggaccagtcacacttctcggtctggctttcgcccggaggcttgcctgcagagtgggtgaaacatcttggcagatcgttcaggagccttctccgtcgaacgagggatatgaggctgaggctgcagttggcaactcttgcaacgggatttagtgacgttcttgacgcatgcaatagtgttttggacaaggttccggagaacgctggccctctaatcctgaggaagggccatggtggtacatacctccctctcatgtaaatccttccattttgatccatcttgttcaactttcggcagactgaatcttacaggagttcagtatatagtgaggtgagaatttttcccgtcctttctttgggcctgcgttcagcattctagttttttgatacatatggatgaagccatgggagatattcggtttgtatatatacaagcattctgagtggataagatgaacatagccgattgagagtgagtttttgcggcttcagtcggtggaagttttcgtgtgggttgtagcgccgtactcgtggtgcctgatgtctgtagtttgttgtaaattccattgacccaaccatgaaattttgtacaattttcttcacgtcacttatgcttcacaagatactcattgatatgctggttgtctggatctgaatccatcgaactgccatgaaatctgaatccttcaggaccaattgtgagttcagagttctggcagttttgagccccctagtcctgcttgagaagatatgcacttgatcagattgtgcctttgatattcttgataagattgtgctatttgattgagattgtactgttcattcccaacaaccctggcggcgatcgtccaacgccggatggataattcttctcacgtggattccaacaatccatgccacacgagacttggacttcttgctaagaaaaagaaatatagcattccagtaggccataaggaaatattcaagcctaggacggccccaatttcgtctgccaccaccaaccaaaccaaactcctcacgagcgtcgccggcgaggcgaagcagccgtagaaaaacccaagatcagcgagttgcgtccatctctcgccgtctccctcagctgctcagctttgatatgatagctcaagggcgatacgtttagtatggtcgccggcagcaaggagctcgcggcggcgatggccccggtgacccggccgcgctggtcagtgctgccggcgccgcctcgtcgcctccggtggccgcccccgccgcccgccggaatcgccgccgtctgcttcggctaccgacgtactgtaactcacctctcgcctcctctacaactctactagtacttcactgttatacgtggtgatggagagtgcgtacgagtggttaggaacagcttaatatttttcagttttccagctaatctttgtttagatttttcttttccatttgtcttctataattacttttccccgttctggaataattggcagtaacagtaataaaacttaaaactctataaagttataaaaaatactttccatttttccatcttgcttgtctctttttaaaaaatacttaaaattatgtcataattattaaaatatctgatgtcgaaaaatattacaatacggttttcattcatcacaatataattatttaaaagtaatttgtggttaaagtgagatgatcgtaagtattattgcgactattattaacaaccggcggtactataaatcaaattaggacaatgttattcatcacagtaacaattgatcaccccattctctaccatttgtgtagttttcccaaatcgaagttcaattatgcaaacatgcatttgctctgcttatatttataagccaaaatttaaatagaacttagttttgagtttgattttttttctaattgtactttactttacatcatttactaagtacatgtactttttaataaacaattcggataagtatacgagtgagcgcaacaatgcttccataattctaggggatgctttgcttcaaccatttggtcgaagcccaaaagtgagtaatgaaagcttcatttctctacttcccacgtgtcaccctgacgtgcactgctggcagctgacgtggcactcccgtaattatatatattttcccctggaagcttcctgccctgcccctccttttcccacgaatcccgattccgatccgattccgcggcgcactgtcaatcccattcccattcccattcccattccctccccccgaaacgaaaacgaagcaaaaacgtctcaacctctccgcctccgcagatcgcctccgcgccgcgccgccgccgacaatggtcgccgtcgacccgccgccgcgggaggccgcggccgccccgcccgccatgaagcggagcgcgagcttcgaccgcgtcccggaggaggcgcgccgcatcctgcaccgcctcgccggggagctctggggcggcgacgtcgaccccgccgcgctcgccgtgtcccagctcaagggcgccatgaccaacgaggtgttccggatcacctggcccggcggcggcggcggcgagggcgagggcgagggcgaccaccgcaaggtgctcgtccgcatctacggccagggcgtcgaggtcttcttcgaccgcgccgacgaggtccgcaccttcgagtgcatgtcccgccacggccagggcccccgcctcctcggccgcttccccaacggccgcatcgaggagttcatcaacgcgagggtacgcactctctctctctctctctctctctctctctctctctctctctctctctctctctctctctctcccccatcactcctctgctcccaatggcaatggctcattctcctcgtgttctgctcagacgctctccgcggcggatctgcgcgacgcggagatatcctcgctgatcgccaagaagcttcgtgaattccacgatctcgacatgcctggacccaagaacgtgtcactgtggcagaggctgaggtacgcatccccttcactatttctttatctccattaatggcgagaaccacgagcaatccccccttccagaggctaatttcactgtgcttcatgaatcaggaggtggcttgaggaagctcgtggcaggtgctcgcccgaggaggctaggcagttcagtttggagaagctaggtgatgagatcgcaatgctggacattgcattgtcaggggttgatcagagagtaggattttgccacaatgatctgcaatatggcaacattatgatatatgaagaaaccagacaagtgaccttaattgtaagcgactcagtatctccttttacaaatgctccgaaatcaggcgaacagctctgatgcttgatttaaacataaatttgcatctgggttgcataattgaactagtatgaagcatatgatgttggtaattcttggaatgggagcaattgcttaggtcatattctgttaatattttgctgtaaataactgctgtcttgggatctcttttatccttcaggactacgagtatgcgagttttaatcctgtggcatttgacattgctaatcacttctgtgagatgtctgctgattatcattcagccacacctcatgtgctggacttcacaaaataccctggtcagtactgatgatagccatatctgttaagttctacctgcgcgcatggctgtgtgcatttcactgagaaaaaaatcggcttgtttgacacctctgcatatttcaggcattgacgaacaacgcagatttgttcaaacgtacctcagctcttcaggtaagcaggatgcaccttggcaccgttggcccgatgaaagaaaagggaaaataatgcactttgggactgaatgaatactgatgctgcattttctgtaatgtgccatgagtgattttaatcttgattgttccttctgtttatcaggtgagaacccatcagatgcggaagttgaacatttacttggcctgattgcaaaatacagtcttgcaagccatatcttctggggtctttggggaataatctcagtaagctctcttaacacagcggccacgccaatggcaaatgtgtatagataatctatttagtgatcttacaaagctggttggtatctgtttcttgtctccaggggcatgtgaacaagaacatcgacttcgagtaccaggagtatgcaaggcagcggttcgatcagtactggaagacaaaagatcaaacgctgggatccaaatccaactagttgatcacacagacacacagagcattcttctttcatgtcttgtgatccttttcttttatatagctttgtctagtcttgtgaattctcaattgtgtgtgtctgtagcagcagcagcgtagctgccaagtttttactgtaaaaatctttcggctccttgcaaacatgtccttcgtttccgtatcatgcgattggagtagggcagtaggctgggtgatttttctcggaggagattttctccggtgccatgtgtgcagcggcggcggcagcgcgcctttgcagagtctccacgcactgcaactgctgctgccgtcgtcaggctcgccggccactcccactctcatcgccgatagcacggagcttctgaatctttctatggatctgaattgaaacgaacaaaatgcaaggtgccgaaacgaaatcgctggtcctagattctgcagaattgatgtctttatctgtaagaaagattcagttgaatggcaacaagggcaccagtggtctagtggtctagtggtagaatagtaacggcccaactattcattcttcaaagcccacacagaaaacttcgcctccatccatggacttagctccttactctatatgggccgaataattcggcccataaactctctcctcatctcctccccaccctaggccaatacatccgcgcgccgccgactcctcctcttgccccccctctcgccgcgccgccgccgcctctgcccgtcagacacacctcccccctcctcgaggacaagggactctcctctctcgccggcggcggccgtcggcgacgacgtactagtactccacccccactcagctgtactgacgcggcttgtgtggatccgagcttggattggtcgattccttctgttctcgtgagtcggtctttgccctcgcggttcgttttgctctgccttttttttaggttgctatctgtatattatgtgaacaatggcgcaccgaagttcactcagattcttgactgttttttgttgtttgctgttgctgttgccgctgttgaaggtaaccatggccagtgccaagcccgccgctgaacagaaggctatggaagggggcgagcaggaggctctggatgaaatggagaagaaggtgcacaagtactcgcgggggaaggctgcttaccttggggtgagactgctgctaaactacttcttcttcaaaaatctgcgtccctgtttgattcacatgtgtatgtgtggtttatgttgggtttatcagactcttcgcgacaagaaattgaaagggcagctcgccgcaagagagaagctctatggacactccgccaaagccgccgttcagaccgagaaggtgcggttgttgattcttgtaatgaatgtttctgggagcatatgcaacacaatgggagaattgagaatctgtcgtttgttgatctttatttttgcttccaattttgcagtggctcttgcctaccgagggcggctatttagagcctgatgatgatggtctggagaagacgtacagatatcagcaaacttcgctccgggaggacgtggatcttttgagttcaagaaagccatttgatatgatcttaccttgtaagtgtctaaatctgttttttttgttctttgaagctgtgatatcataggcggcttgttaaatcaagccctaattttttcccctgctacattagatcttgataaatgaaaacccctatctcaagaaaccatcatcttgcttaatttatccattactaattttggtttaaaaaaaactaaaaagaagtgtagaaggaacaccattagtgttttcaattgaattattttatttccaatacacttattttgtagccactataaaactttccctgttcctcttctgtaaattcccccttcttcacttcttctaattgtggcaggggtacactgttctatttatctggatgaatgctgatttttttttgtttaaatatatataaccatagcatttatttatcttcatttctgtatcatcatgtaacaatgtatcttttttggaataattgctagatagcacttttcatctacttgctgctattaacttttcggatgacaaccaacaagttatgagggattgactagctcttctcttatgatgcagtacttggcccttatactctaggatacacgggaaatggccggtatatggtagtaggtggacgaaaaggtcatgtcgctatgatggatatgttgaatttggaactcgtcaaggagtttcaggtcattttttcagaactcaagacttttcccagcatgcattttttttccttatatgagtcatattttttacgtcttcctactggtatttctatccatgcgtttatggcactttctgttgtagtagaggtttctggttatgaaagaacagaaccatctttatcctggtcaaattcctaccatgtcccctattctttcaagttcttttccctggctatagtaatcaacatgactgtttttaatttgcacaggtgagggaaactgtgcgcgatgtggcattcttacataatgagcaactctatgctgtcgcccagaaaaagtaatttccttaatatactcaatctttgcaatatttttccaatgctcataacataggtcaacatgttccatattctggtcttgagtcttgacaaagatgtagacaaactgagaggtcaatgaagcaaaaagtgcaagaatcaacctaggctgactatataaacaaactgagaggtcaatgaagcaaaaaatgcaagaatcaacctagtctgactatataaacaaactgagaggtcaatgaagcaaacagtgcaagaatcaaactaggctgattgctcagaggctcagagctttaaagtttaaacacacataagtacttctagcacattatggtttggtttgtggatcaattaggctatagaataatgcaagatttcctgtatgattcgttataaaaatttgctggagtggtataattctatgctacttccgtgaacaagaagcctaatttctggcagttttttgaactgctagtacatagattgaggatgagcaaattgagcaatgtgcggtaggctggggtagaattgccttctgagttctgattgccctactggagtataagtcattgatctgtccctggaaatgatgatcattcctgtacatggcagggaacctttgtttttttttttggccagcccagaggtggagccacaccaaaatttggtttttaaaatattttctatattttactttttttttcactagcgtgtaatacatagcttatctccacagttttccacgtctatttttgatgaaatttgtgggcataactccaaatattgtcaaacattttatgttacctttccatgtaatttttagacttcctcatgtgatattcttttaacaggtacccctacatatataatcgacatggcacagaaattcactgcttaaaggtaattatgatgtaaacacattggctttctgaatgaatgtgcctagctattgatgattttgagaaattgttagttttgttgttgtttcacatgttttcagttaacatgcaggaaagttaaaactttatagctatttaatttttactttatgtatgtctatgctttgatgtggtatactggtatctctcaaagttcagtaaagatttgaatgtatatcttatcttgtttaggattctgaatgttttgtgtccacaggaacatggtaaatcgttgaagctccaatttctggaaaagcactttctcttgtcatcaataaacagctttgggcagctccattaccaagatataagcactggtgagatggttgcaaattacaggacaggtctgggacgtactgatgttatgcggctaaatccttacaatgctgttattggccttgggcatgctggtggcaaagttaccatgtggaagccaaccagtgtgaaaccccttgtcacaatgctgtgccatagtggccctgtgacagccattgcatttgacaggggtggtcatcttatggcaacagcaggtgttgacaggaaggtcaagatttgggatctcaggaagtatgaggttataaattcttatgctgcacgtgcacaatccctggatttcagccagaaaggtttgttggcctgcagcaatggatctcaagtagagatattcagggataccgggggacaggattataaaatttatatgaaacatagaatggtaaagggataccagattgggaagg

SEQ ID NO: 16428 - DNA, 6235 bp, Oryza sativa
ttaacaagctccagccagagacgataatgcttaatccgaacatgatagctaccgtaagaccttcaaggaagaaagagaagaagaccaagaaggagattgaggaggagatggaagacgccgtagaggctgccaagagcatcgagttcaagaagaagaccaagggtaggagcaaagccagcaagcgggccaagaagagggaggaagaagttttgaaagccaaaaggccgttcctggagcaacacaaggaaaacgatgggaggcctgacaagaaacagcgggtcagcgaggagattgagctgccaaaggccttgcagcggttcgcaaagagtaggcagtgacaatggagcacagaattttctttttctttttgtttgctgcaacctcatatttatcactagtgtgcattgtatcgtgtagctggcaaatgtcatatctgcttccttgtgaaccataggcttttgcacatgaggcaatggtgcacagaagtaagcacccaaattttgttctgaatcttttgtgatatgttggtcaaaatgtgcatgtgaccccaacggtgtagccgtcggctgttggtgccttgttaatgtcagtgctgaagtatagagtagcactacatttacagcagtattacgtgctgagattcagttcctctggtgaccactctggggaatgctattgcttaatcatcattctggagcacggttgcataaatgcatagctactcgttcagttgtatttgcagcttgcgttttgtacaagggagcatgttggctgatggtgtttctctgtttatcactacagcaataggcatcactacctgatagttaccgaaacctttagatatttgaaagcaacacaacaaatctgtatcctgcaataaggagcaaatgcaagttatcaaactatatgaaattaccagtcagttttatttcatcaagggcgccagtggtctagtggtagaatagtaccctgccacggtacagaccctggttcgattccttgctggtgcattttttcagtattttttgcctttcatatgctgttgttaaataaattttacctttccctattgtttgcctttcatatgctgttgttaaataaattttacctttccctacactgatgttaaattgatgagattttgtttttgcgagaaaaaaaatacatgagcttacacttttcatatactgtcgttatataatttttacctttccctacactgatgttaaattgatgagatttgtttttgcgaggaaaaaaaaatacatgagcttacacgaacgtttctccgggtttactcagtatgaagcaaaatggcaaatgcaccagtggattgtgagcttgagaaagaagagaatccttcacggccatgggcgattagccgattacagtgtttacacatggagcgctacaactacaagttatccttgcagaaaccgatcctctctcgccctcaaaaaccggcgaggtggtccggcacggcgacgacggtgccggcctccacctcggcgtccgtgagcgtcagcgccctctgcagcttcctgctgctgaacacctccacctccgccgcgtacgtcgccaccaccggccggtggtccgacatcgtcagctccgccctcccgtagctcatcagcttcacccccttcccgaacgacagtatcctatcacacctgatcgatcatacacatcatccaaaattcataaacaaacaaacaaacagaaaatcgcactctcatcgcagcattacacacgcaaaatgtgcgaatttgagcaaaagaaaattgtaaaatgctgctatgtttttttatcattttaatcaaacttaaaaaaagggagaatagctactttagtccctaaagtttctctgtagaatcagtttagtccctaaccttttaaatggtccaaagaaatccttaaattttatcataaggcatagaatactccttgggtccaccaaaatcatcatatggatatgccatgtcatcattcatgcaaaatctatgacgaattgtccaatttacccttacgtatataatagaaaaataaatataagggtgaattagacatagccataggaaaaaaatactcttttttttcacccttttgaggtatatttttgctcttacatataccatgtatttttttttaactttttccttttgttttttattttcctatgcgtaagggtaaattggacaaatcatatagattttgcatgaatgatgacatggcatgtccatgtggcgattttggtgggaccaaggactatatcagtccacatgataaatttaaaggacttgtttggacaatataaaatattaaggactaaaatgatccaggagcgaaactttaaggaccatattagctattctcccttaaaaaaattaacttaagaaaatgttaaaacgacttataatatgaaatagagtgacgtgcattttgcagtgagcagctgcacgaacgtaccacgccggcgttctcctgccgccgcgctggtcgtcgccgatgtacttggccgagttgagctcgtacttgtacgtcggcgcgaactccagcaccccttccgtccacccgtcgaacgcccgacccttccttagctctcgcttcagctgatttattattcagacataataatcagagagattcagatcaaacagcaagattcagatgtgccacacagaaactttagggcccgatcgattgactatgagctaattataagctaaaatggtttattagcgacgaaaacaaaatttatagataaaacttttatacatgtagaattagtcacttaaaacccaatgctagaagaaactatttaaaatattttataatcaactttaaaattaagttttagaattgaactttttgttgtaacagacgattctatatagggcaaacgatgaggctctcatgctaattattcttgttcttcagatgtgtacctgatctttctctgccagctgagtccaatccatcgtcgaaatcagctcgtgtgctctctcgtacgcgacgtcgatgcgataattcagatcacccaaccaaaaaatcctcctgcagaaaatcacaattgacattcaaattcagatcagatatgatttggatgcactttgaatctttttttaaaaaaatgcggattagtagcttcttactcatggtcatagatgtttctcggcatgccgacgccggcgaagtgcgtccggcggtggatctcctgcacgtcggcgttccgcttgtggaggtcggcgggcttctcgccggcggcgaggtgggtgcacacgaagcagaacatggtctggtacaccgacatgctcaccgacacggcgcccttgttgccgatgtagcccatggcgccgacgccgacggtggacacccccacgttgtggacgcacctcctcagcccgcgcctcacccacaccgtcaggaagacgcccaccatctgcttgctcacgatcctcacgtacggcgaacgcctcttgcgcgccgcggcgaggtccatgacgaggtcggcgatcatggcgaggtcgtcgttcgactggtcggcggcggcggcggcgcgagacggcctgaatgagttgtaggttcggaaggatcttgacgatggcatggtggtactcgccgtcgccgtggcgtgcttggcgagcaggtccagcggctgctccggccatgccaggccgaccctgtccgacctgctcagtgtcttgagaagcgtccgctgctgatgctcgtcgccggagtcgtccatggcggcggcggcgtcggcggcggcagtgaaatggttcagcctggtcagcctcctcggggtggcggcgacgttctgctgctcggactccgccggcgagctgaagagcgagtcgtcatcggtgttggtgtccgtgtccgtatcggtgccagggaagagctcgtcgtcatcggtggcggcggcggcggccgtcgcgtccccgcgcgacggcgagggagggtggctgtagcacttgtaccggggccgactactcgccggcggccgcgcccgccgcagcgcgctgcggatgagctcctcccacgcctgcgccggccgggcgtcctccgcgccgaacacgttgccggcgttcagcggcaccacttcttggaacccgagcacgtagacgtcggcgggctcgccggcgccggcgccgagccagtcggcgatgtcgaggtcgccgggggggaccttgccggcggcgttccaggtgccgacgcagagcttgagctccttggtgttgatgtactgcgcgcgcagcgtctccgagtttcgccgccgcagcctgtacggcgcgccgccctccacattctcatctgggcatttttacaaatggttagggtgtgatgagcaactctgtacaactttttttttctccttatttttgtttgagacctcctttgaaattgagggatttttgaaggattaattttttaatcatggaataaaacattcgggtctttactcaatgagttacaaccaattattataaggttcacacaaaaataaactcgcacagtgagtatgtaaccaaagtaacaaaaccaaaatcagatacaaactaataaaaaccaaacaagataaagacctcacaacattttgaaggatttatattctattctgtaaaatccatgcgtttcaaaagagccttgagcttgaaaaaaacgccaattctgcaatggaagtttttctttaaaaaaaagagcaatggtggaatgtaacattttctcaaaaataattttttaattcagtttcctaatgttattttttggagtacaaaatgttgatttgtttggattccacattttcattggccagacaacacagagtttgtactagtagcttcttttcccttctagaaattgaaccttttttttactgccaagaagattttgggacaaaacccaactttggtactgtcagttgaatggatcccaaaatccaaaaagaaaaggtgccactttgagcaattgtaggtaagccattgttgtgattggagacaagatttgatggaagcttggtgcaaagcactaaacaacagcactatcactctgaagactctgaacagtccaaagctgcacttttctcctccccatcttttttaggataagagcaacacgcaaacatgggaatgtcatcaaaccgtcacatagacataagactcaccggcgagatcgccgtcggcccgccgccgctcctcgccgccgtcgcagccgcagttctctgcttgaaaccgaaccaatcagaaggaggaaaaaatgtgactcctgactggtaactaaattctcctcaagaacacttaaattcagatggataatttgatctgagaagaggttttttgtttttcagaaacagtatgtaccttgctcatcaacgtcgctcccgtcgtcgtcgtcttcctcgtcggcgttgaactccgaatccttgctcttgaggttgagccatttcttcagcacaaccttgggccaagaagcctacaaaaacacacaaccaattcaccaaattagccaaaattatccctgttaattaagctgccagatgaatcaccaagaacaacctgttctgaactgaaccaagcattcacctacctctcctggcttccgctgattcttctgcaccaccatcttactcctcgtgcctcaaacacaccaaaaattcagacaaaacggactagaaatccaaatctacactgcttctgtttctctctgaatcttctctccttccctctccaattctgaatcactgaatcttgatcagtctctgctcctgttctttctcgcacctttcttggatgcgttcttcaatggcctgagctagctaggtgcctgaaaatggaggggcctcttgcacgagcacccgtgagttgagcagtgatatgtttgttagatagataggcaggacaagagaacggagcacatggtggtttttaagctctgaaacaaacgcattgccatctgatggcgccaagcaaaccacaagaatagaatagaataatagaatataatattatcaatgggaaaaatgtgggcatccgacaaagcaggttgcctcccggctgcctcatttcgcctgttcactttgatgccattttcaaccttaccaaattttggtaaagttgtcaaaaagtggttacatttatttttctgtcaaattttggtatctatataagaaatcctataaaaattctggcggcaactataccaaaattttggcattagtaaggttttttttcatcaa

SEQ ID NO: 16429 - DNA, 552 bp, Oryza sativa
tgctgaacttttaattgaagcttcgcttattatatgggatgaggctccgatgacacataggcgatgttttgaagcgttggatcggactttacgtgatatcctttctcaaacgtgtgctacaaattctattataccttttggaggaaaacccgtcgttctaggtggtgatttcagacagaattgccagttgttcctaaaggttcccgccatgctatagtcaatgcatcaatctcaaattcagatctatggaaacatgtaacagttttaacgatgaatataaatatgaggctacttaacacaaacctagagcaaaagcaaaaagatgagctgcatgcctttagtaagtgggttttagctattggtaatggcacaatacctatgaccacgaaggaaggtgaaagctatccatcatggatcgaaattcctcatgacttacttattataactgatggtgataaaatatctgctattgtgaatgaagtgtattgtgatttttttgcatcatacatgaatcctgaatacttagcttctcgtgcaattgtttgtcctaac

SEQ ID NO: 16430 - DNA, 719 bp, Oryza sativa
ttcctgcagccctgctgcctgtgatgatccggggatttgtcaatcaggacgtgtgggaagcattagctgagctaagccatttttatagggtactttgtgctaaagaggtcgatccaactcaaatgcttcagatggaaaaaaaatatcccaattctaatatgcaaactcgagaaattattcccaccaggcttctttaattatatggagcatctaatcatacatctgccataccaatcaagagtaggaggtcctgtaaagtatcgttggatgtatataattgagaggtaactaaaattccacatgttgtcaatttaaagtcatattttatcttaggtgacaaactaacatgtcatgttatgtagatttattaaaaaactgaagcaaaaggttcgcaacaaggctcgtgttgaagggtcaatagtggaggcttatcttgtagaggagatctcgcacttcacatcactgttcttacctgatctcattgctagctcacgcaatcgtccacatcggtatgctcaagttggccctgctagtgaaagcaaccttagcctgttccaagttcaagggtggaagaccggtagaggaatttctcgaactttaacttttgaagaacaaaagaaagcaatgatatacatatacacaaacatgagtgaaatggatggatttgttgagtaagtattctaaatttgtaaataagatattaattctgctataaaatg

SEQ ID NO: 16431 - DNA, 3376 bp, Oryza sativa
gtgattgctacaacttggaatcactacaaagcagacaaggactcaaatgggagaagcaaagctgatgtggttgaagaaggtttttgggtattattatatttcttctctatttgttactcctactatcttctcattactgttttaaacatatgcagacaatttcgttttaaaataatatgtagacagcagacttgtcataaaaaaaatgtcctgcaggatagtatatcgtttatggctgtataggttcctctttcaaagtttctgcatttttgtatgcatgcaagatttagctaaaacatgttctaaggtttggtgcttctatatttgtcttgtttcagctaaggttcaaacatcaaccaagccaagatcaggcgcgtgctgcaaaagtgcatgttcgtaagtgttgcggtgtgttgttgggatggcttaagtattatgctcgaattcaagccataatggatcactgtcgtaaggttgaaggagtgcagatctgtgacaagagagcagggctaagatacctctccaaggaagaatacttggcacagcaacctgagtggtgtgatcaaatggcttgggatgcaatggctactgtttgggttgatcctgaatggatcgaaaaatctaaaacaaaccgagccaaccgcaagacccctaaatttaagcctcatagaggaggatccaactctattgctacagtacgacaaaaactggtaacttttaaacttttattcatgttatgatggtgggttttttatgcattaaacactgataccttgattatgaagtccaaaaaatttgggagagaagtatctgcaattgaggcatgggttcatacacacaggggatcaaatcctgaagatactaacacactgaacacagaagaagccactttatgcttggtaattttctgaaattttcaatagtttccacatttacagtctaatattttaaaaactgatggttacctggacaggagcgatataaaaccaaggcaacggagttgaatggtccaaactttgattggatgaactcccctgttgactcaagggccttatatgaatgttcttgcggtagaccacatggaaaatgggaaacatttaatgggatggttgatgatagcgaggctatggctaagatcaagagaagatctacatcttcaacagctaacaagcgtcgacgacaagaagaagatgaccatgaaagagcaaggctgatcaaggatgctcgtatagcaaaggaatatgcacaacgagtgctggagtggagtagtggccaagacagctacaacaacactataaaacttattcttgaggtgcaatctgtcatatacctattatttttattagcataattctaaagcattagtttttaattttgtgtgctaaatatttgaattgtagagtgttatccagcatactggaatgcctctacctgttgcaattccacatccaccgccgccgccgccaccacctacatacggagtttatcattctgcagatcaatctacggtgaatgtatgtggtcatgtttctattaatattgcagatgtgtcctagagatagattttttttaccttgcaatatccagcaatttcaatgtcattttagtggcgtttactatacatatgcaaccattcaagtgtagcagtgtcatatttatcaatctatctatctatctatctattatatactaaaagtccattaaacttcctataaacgctcccaagccgccatgtggcgctctaataaatacgagaaatccaaaaaattataagaaaaaaagcaaaacatccgacctttaatttttacttaagatggtggaccattattcttcaccattagatcttaccttaaaaaaaatatcctaaaacccaatccataatctcctcccacccctaacccaccacctctcaggtggctctcaagtacgtacgagacctcctctcccctgacgtacgtacgtacatacgtctcttcctctcctgtacttccttttgtcttgccattttccattcaatctaccaattttctacctagcaaaattcaatatgtaaataaaagtaaattctctaaatgattataatttttacattatattttatttatctacattggccatgtttggatatacaagaatatatcttttggaaaaaaatcctatcttttacatgaaaaataaaaagtaattaaatattaaattaataacatatatatgatcttcgctcctctctccttgctcactttctcctccctattttgtagctagcaactcattatataaataaaaagagtaaatttcataatactatatctatctatctatctatctatcatatactctttccgtcccagaatataggatgggtctcatcctatcttaggttgttacattctaggacagaggcagtactaaaagtctattaaactttctacaaatgctcctaagccacaacatggcgctctaataaattagaaaaatccaagaaattctgagagaaaagcaaaacatccgagatgaaccaccacacctaagacagctaaggtgatttaccaaggtcatcacgagtgtcgcagcaatactgatttgccaaggtgaagatgaatcaaatcatcagtgtataatgtttgttttgttaataacacttcaattttaatttgaatttaatttattaaacatgatttcttaacaaaataagtctactttgtttctcgataactggatggataattactcatagggatgaattaaatattttgttgtataaaactaacaaatagcttataaaaattatcaaagaatatcgttgaaaaacaatcgtagagaaatacttttttgaaatttgaagcgtagcatatactgtctggttaatattccaatcttataaatttcttgaacacagcttacgatacatgcccgcgtatacgcgcgggctacctttctagttgatactaatagtgtaatgtctcagtggtctttatgctcatcgtctagtttattctatacttgctactgcaaatcaatgttttgttcaataccatttgttacaattacatgaaaaccattaaattttatccattgtgctttcaaatttctgtgttggataggctcgtagcagtggctcagttgttggagctggagaagacactggtagagaaaccatctttggtcggtcgacccatatccacaatagtcccggttccattaaaaaccgggactaaaaatgatttttagtcccggttaataagaggaagatctttagtcccggttgttgttaccaaccgggactaaagatcttcctcttattaaccgggactaaaaatcatttttagtcccggtttttaatggaaccgggactattgtggatatgggtcgaccg

SEQ ID NO: 16432 - DNA, 19944 bp, Oryza sativa
cgggactaaagattgatttttagtcccggttatttgaatcgggactaaagatagcgatctttagtcccggattcgtagtcccggttgaaaaaccgggactacagggtggttacgaaccgggactaaaaagcatttctccaccagtgagagaatcatgctgggactgcaactgttggagccggagaagagaatcatggtgggattgcagctagagaggagaataatggtggtattgcagttggcgaagataatccagaagaaactttggctagaatttctctaggcatgtttggagggcatattaatgcatctggcagtgcaggtggaaaatactctcctcctttggaagagcttggcccattttgattttagaatgtttggaagaattgcactgaagtgtgaaccttgatgcactcatgcaagtgttgaatgcagcttctttgttcttggatagttttgtttcatattagctagctgcaagccctctattttggaacctgatggaggctatgacttcttatgtattgaatttctatgaaactatgactctattttccatgaatttggttacgtggcatgtgacttatcaaagtaatggttattcatggaaaatttgtgtgagcttgggttgatttggtttctcagattagtgatctacattacccatttaattatttcaaatttgagtggattgcctatttaatttaatattcagatattgcatataaacgaatatccctattaaactattataacattttgaagggaaataattgtgatatggcacaaataagaaatttatattaaacaaatagatccctacagttttagaaacctaggggaagttactttacatactggatacaatgccatgtcagccaagttccctaccatttcaaatcctagggatcctttttgttccctgcgcttttacaattgaaatcgtagggcacatctagttcccggcgaataatttcccatggaagttttccctacgaaaaggcctagggaacttgtttccctactagtttcagctcattccctactagaaaaaacaataggggacatggtgagttctagtagtggtatctagaaccgttagaagaaattattttaaatgatctagagttatttctttttggtattttaaacttattagtgtgaaattcgttaatgacaatgagtttttaaatattatcttgtatttttatggtgaatgggggccttcattttttgttccacactggaccaccaaaaagtcagggccggccctttatgctacgaattttgcccatcagatttatttgatagtttatagggaaaagtattttgaacattcacactttgaaaaaggataaatgtctacattaactttttttcatccactatcttttacaattaattaagtattacctcaacaccatcaactttcctattcgctttactattcgtcttttctaaaaatacttgtgcgagtaggtaaatatgtaaggcaagtttaaggtactattttacttttcttaaataagtaattgaataaatattgttgattaaagttttaggaaaaatcaatattgtcctacatttaaagttggagactgctatatctttaggcttgcagtacgtgctccattaatattgcaataataggagttgaaaaatcacatcctttgcttctagagccaaaatatcacagttcctaaacacattgaggtagtcccctgtcgtataatcgaaaaggggaaaacccctaaattcaacccaatgtcgaggttaattacgaagggcagtatttgaaagtgtatggtttactagaaaaaaaaatgcccgtgcgttgcgacgggtgaaggttattttaattttattgttgttatatgatctagttaatgtgggagttcacttggacatatatatatattttagaaaatcatgagctgcaattagaagtccgatcatattaagttagcatgcgagttttttaaagagaattcttatacgactcttattatattttcaaaagcgaacgaacttaaaaccgactcaaatacagatatgtatttccgaaagcgatcaaacttaaaaaccgactaatacacggatgacttaccaaagtactggtaaaaacatcttcaatttttataatagtagagattagacatcatcctcttttaaaatagtttcattgttattttttagacttttgaaagttaaagacataaaaagaatttcttttcaaggaaaagaatttgatatccacatgcaaactacctgtggcttacccacgttgtgtttcttggggtcttatgacccaaaaagattattcaatcctagttaaattataccgtattatctagatgatttgtatatattaaaccctcggtaatttttttccaggttaattgccgccatatacagcacatccttagaattatcaatggggctactacataatataaaaatatggtgatgagattaatcacaacaaattaatactccatatatatatattattctacgctagaagtatcaaattttcatgcttgcacgtgacagaggaaagaacattcgggtagcttgtgcgtgtggttcgatcaatgctggagagcgacacatacatcggcacgtacactgctaatctggccgttttgtctacttgctggatgaattaattggagtaatattttttttcaccaaaaaattaagaaggggataattctgtactccctccgtaacataaccatgagtttccgtgtcaaactttaatcgttcatcgtgtcaaactttaatcgttcatcttatttgattttaaaaaactagaaagaataagtcacgcataaagtactatttatgttttataatctaataacaataaaaatactaattataaaaaaatttaaataaaacgaacgatcaaagttgaacatagaaacttacggttgcacttattctggggcggagtagtacttaattgctcttcttccggtaactgtggcagcagacatgagagattgagacattgactgatgatggaggtgtgcttgcatgtggggtgcacgcgtcaccggtgacgtacggctgcttgggtgagaaattaatcgcttggtccacaccatatgaggtgaaaaaaacaagggttagatatggttttttaagattgagcaaccactcccttttccccataaaatccaatctaatattagatatgatacatcctagtacaacgaatctggacgtgtctatgtctagattcactgtactaaaatgtgttgttatatccggttctagattcggtttttatgagacgaagtaagtactatttacggtgatggtgatctaggatgtagccatgtatgcatgtatggtttatattttggaacaattgttcacaaccatgggttaatttttgacatttaattatgtagcaagtttgtaacatctagtgatgcaaatcatagtatctgagatataatttttactctttttaaaaaattaaaaacttacgtgtatcagtacattagaaaatagaaatctcataatcaactattggaaattaaagagttgataatattgttagttttagattttttttttgttttgatctcttagtgaaaaagattgcacgtaaatattttccttgaaacaacttagtggtatatatactggcccttatattcataaacaacctccattatttacaatcatgctttgccaacgaatggaattaggatccagagtaatgttgataatttgcctgaattgcaagtttcagattgtgctacagctacatataccgacctagatacatgcatgtcaggcacatacgtacaaccacggacttacaatacctctcacctattcatttcctgtcctcttcaccaagttggttagtcaggaccacggcaaaagatctcatcggatatccatccacgcacatatcacctctcgcgaagtcgcagtaccgtatccagaaaattaacaaccatacacgaaaacctcccgaacacgcacacggcatacacaacatcaagcaccggccggtagtgagcgagccctgcgtacccgtgtgcgcgtagcgaaaatgccgctgccgcaggtggatggatggagagaattggaggagattgcaacgtgacaagagcaacgggacggtgtaccagctgcagctagctgcccgtatttaacgcgcaaaggcaggcaaaataggcaaaatggcaaaccgatcgctttggcggcgagtgagtggcagcaagccaggacagctagctagctaagcagagtggcaaatggacaccaaaaagaaggcaaaaagttagctagctccatcaagcctgctaagctccatcagcctcccgttttgttcggatctccggtatccctcaacccaggttttgcagtagctttcggatggatatatatatatatatgtacttggagagggtgaagatttcatgagtttgtttctcaaatttgtgtttttatagtataacattcttatatacatacccgtgtatcatggtaaactaaactagtattatacggtctagctatttgaacagctgtttggactcatccgtgtgcatggggtaagaagtggacgcactactcgttatacggtatgccgattatactagtcacaatcatgacgggattcgtctactctttagaatttttctaggtccattgttatcacatatatgccgacgacctattttactttggtcgtcttcaccactcatgtgtattatatttaatttagaactcatattttaaaatacatgacctatttaattttgttagaataaacctttgatcctaatattttatttatttgacaaaaaatataatcatataaaaatagtttcaaaattgaatataataatatcaattttatttaaaaaaatattattatatagtaattgttgataaatcatataacaaaataaaatatactttatattttaaaatgaagggagaatttactccacatttagatcgactagtggttattgtggcatataacatgtcgacaaatatttatttagagtatcctagctaattcatttagcatataacttttatagtgttgtgttggaacctaccagaatgtccatgaatgaaactaaaataactgggaaggtgatcgagcgattggtttggccgaacgtttcccacgatcacaagatcgataaagtttgttcattttttttcaagctttataggtggtgacggcagtgtgcactttagtttttctcccccgttgtttggttaattttgtgtggttcaacgtgccatatacgtgtttcttcacaacttgtcacgtactatgatgataaatatgtgtttttttaattaacttttattaatttccgtgcatgtggatatatgtggataaggaggaagccacaaaggcatagatgatcgagcatatctgatggaggcgatgcttccttttttttctattttttctgcttgagtgcttttttttttgtactgtaaaaagagtagtgcataatttaaagcagagccccaaaagttaggtacatcaacctttcacaaaatccatgataaaaccgtgaaatttacagccgtcatcatcatgaacgtcttgtcctacagggattccttttgtgtgaagatggttatacttctctgttccaaaataaataaattgaggtgggacatatcgtggaaggttacgccctatgcaattaatctagattggtttatttttggacggaaggagtatataaatgtttttcaaactttttgggtgcaaccttataataaggtcttttaatatatttttagattgtgcttatttcctacgatgatatttattggtagtacgatatatgtagtactacttagtaatattatatcaccagtaaacgtatcctaatcatttatgtattttactgacagtaaaaacaactaaactcccttaaatgtacaatatttgagttgatagtataaagagctaccactcattggatgaggaaaaaaaaaggtcaatagtaccatttctactacctaaagagaccaccataaaagtatactattttcttttttctattttatattataagtcatttgattttttttcttagtcaaatttttaaaattttatcaggtttaattaaaaaaataatttttagatttaatgaaactaatatgatatttttagatattgctagatttttctataaacttaaacaaacttaactaacttttaactttttaaaaaataaaacgacttcttagatatgaaacgtaggaagtggtacctaaaacgttcgtgatcaaaccttataggacgacagcgacggcgaggctaccctccctccccccccccccaccccacacacacacacatattacttacattgtggcgtgttacttatttcccatgtgataaataaaaccgatgaagcagcagagtgcacgatatgatatggcagagcactagccagttcacatccctcctccactcggtggtggcgccgcccctcgccgctgccatggtactgtacgagtgggagccacgcgggccggccgcggtcgcaatcaccgggccgaccaccgatgacgacgacgatcgatcggaaggaagctaccacgacgcatcatcaaccgtgctgcggatgcaacgcgcggcggcggcggcggcgcaaaaaaccttggccggctgccgaaccaaccgggaagctagcgggacaaatttatcgagcctaattaatccatgattagcctatgtaatgttacagtaaacattctcttattatggattaattaggcttaaaaattttgtctcgtaaattagctttcatttgtatattaattagttttgtaagtagtatatatttaatactctaaattagtgtctaaataaatacagagactaaagttaaatccctgataagatatatatatatactagtactattaatctagataaaatgtacgtatattaaaatttatagtactataatgtgtcatttcaatattatgttggagattgcaagtattggtttttttcaggtatattggccctgtttggatccaagggatattttttagccctccctcgaattgctcaaatagccaaaaaagatctaaaagggtgagctatttgagggctatttggaaataacccacccaagaggtgctaatcggggctatttcaggtggggccactgaaaaagtatcttttctccctatctctccatgggaaggtacattaaacaccaaataactcttaaaataacccttggatccaaacaacttaggactattttattagagtactatgctcttgtgctaaaaaatagctctcaaaataactatggacaagttctccaaacaggggcattgtctaggtcggataacttttaactaatttggacgagctaccatgaaaaacaaaaccaatgcgtagctttcaattccattaatactaataaagtgaaacgttatctcatttctatccatgtctataacatgtaccaccataatactgtacaatactaattttttctttgaaaaatggactggctcactcgtttgccattgtagccttgtgctcgatggttacggagacaacataagaccatgttcgatgtccctatatatggtcatatgttctgataaggatatattgacacaatatacttttttaaaaaatattgacataatatgcacatatagagtgataaggatatatttagcttcagagaaatccatatcaagtactccattcgtttcacaatgtaagtcattctaacatttatcacgttcatattgatactaatgaatctagacatataaatctacatggattcattagcatcaatatgaatgtgggaaatgttagaatgacttatatggtaaaacggaggaagtacaaaactaatagaatcagagtaatgagtggtagaataaaagatgacaaagatgtggaaaaagaaatgcacatatcttttgatgtaatggtaataaagtgaatatgtatatgtcgtaccatgttgttttcgtcaacaatgcaagctcaagcactgcaaattaaatatcatactccataataaacaattaatcacatacatcagcagtaaacttccagcattgaagcaacatattataaaaacagtttacccactcgatttttccaacctctttgggtacattcttttctcccccttgttgacaaagtctctaaccctcatctagtaaacctgaaattgacagacattaatttctactatcaaataaatacgcactcaagctccagctctcctgaagctgccatccaatcaaacaattttaactctatataaaatgagagtgaaactaggtgaaacgctatcacaaaataaactaaaaagatagagctagatttagactgctcacctacttcataactctactctaaaactcaacttatcaagttaaatttagaaactggacctccatcaatcaccattagcgcactcccattaattaatacgaaaagccacgtgtcaccatcaccaaaaatttaaggccgttttggattgaagccaaaacgcgccctaccaaaattttggtaacttcaaatagtaaacatgctagtttcgattgaagccaaacaatcagtagtgtctatacttaatttatttggtcacattctagaaacttcttcactttactactcaactttggctttatattggtatcaaaccaaacatgggctagcctactttaccctaccaaaaaatattgctagtgccaaaatttacctacattctgatactaccaatgaattggtataggctcttacacccaccacccgttaaccactaccctacccgacacgccgccggtgcaatacccccacgtcagcgcacgtcccggccccacctgtcagccaccatcggagcatgggccccaccacccccaccaccccgggtaaggttgccagcccggacagcgggatagctacgtgtagtgtaccgcgtgacgtatcacactcgcagtatatatttttgctacgtgtacccgagaagggcgggagggtgggggccccactgacaggtgggccccgcaacggcgaccttggtcgttactactacaaagaagtcgtttccctctccttttctctctctctctcatcatcatcgtcttcttcgttgtgggcgtagccaatttcgttcgccattttctccttccattttctcggcgaggaggagggggaagagctaggatgccggcgtggtggaagagggggaaggggaagaaggggaaagggggatcggcggcggcgggggaggaggaggaggggaggaggaaggcggggagcttcgacgaggcgctcctagccgggaagcagagtcgggaggagaaggaggtggtggtggtcgggcacccgctgccgcggccggcgtcgctgccggcgccgtcggcggcgtcctcgtccgcggccgggtccgcctcggcgtccagcgccggcagctcctcgctcggctcgtcggcggcgtccgacgagccgccggatctcgggacttacaggtgaggaggaggaggagtggtttggtttggtttggtccggtggtttgcaattcgttcgtatttggtaggtgggtgggtgggtggttggctggttaattagttcatcgaggcgctaaatcaaatcaagttgttgttcttctcctttttctctttaaattttattgctgaattcggcgtgaagttttcgtttctggttgctagtaataattttgcgcgcttgcttcggttcatctgccgaattgtttcggtgggtttggtgggaaattgagttcgtggacttcatgaatctcatctgtttggaggaggggatcaagatttgatttgcgaggttctttgcttcatacttttttttggtgttctactttttgggtggaattggagctgtacctcttgatgcttatctggtttgttttttttccttttcatccaggtatgcttgctagtggcgttggctctttcgtcccctggaaagtagcaccacttgtgctctaattaacccaattaattatttgtttttgggcaaaaattatttcgattcgagatggattctactgccccgttgactaattgtcttcgtcaggatcttctgctaattgtttgattttgtaatatcagttgatcttccttgatccgtctcttcgctgtatcatttgggaatttttccgggcttgctttctttggttcacttttgattttagaagatatgatttttttaataaaaaaaccatttccgtttagtgacagatagtttatgtgatcagctctttaaattagtggtttttttggtgtgtgctggctatttgtcaaagattatgtgggtttttgggggcaattcgaattgtatgttttgattgaaataatcaaagaacatttttgggtccccagtccctgtatataggagtcgatgattgcttaagaataattggtgacttgctacgaatgtgggatagtacgaagtacattatttctaacccaattattgtttcgagatatggtagctttaggatggtgaattttgctgctgtcaagtgattgctccattcataacttttcatttgaactgaagcttgttcatgtctgattcaatagggtgccagatgcaagctatgtgcttccaggcagaacgctggctattgattctcggagacaaaatcttgcggttgaagaaggacgctttttcgcaaacaaccagggtttggagcatcccaggttgtctgaaacttcagtttctccaaggaaagaatcttaccttcacaatttggatctttcaaacgatcgaactgcgtattgccatggtcggaaatcaacggagattgtgttcagtacaagagtgccaatctctccccctggctcaaaaggccaaattccctgtccgacctcccctgtgcaatcaagagcattcgggcaatgcccaggatcccccactgctcggcaggatgattcacgaagctcaagctcacctcaccctcttcctcgtcctccgggctccccatgctcatcatcacgtgtcgtcagttcacagtggaagaagggcaagttgttaggcagtggtacatttgggcaagtataccaaggatttaacaggtacttgcttttgaaagcatttactgtattttcatccttacggagatgaatatttcttttctacaatgcatactgaatcgctattcaaaaatgtatttaatgcagtgaaggtggccaaatgtgtgcaattaaagaggtcaaggttatttctgatgattctaactcgaaagagtgtctcaggcagctacatcaggtaatattcatcttgtcaacaaatagcatctgtcagcagatatttaaactttacatctttcgtactaatactacttcctatgggcaggaaattgtgcttctgagtcagttgtcacatccaaatattgtgcagtactatggcagtgatctggtaaatatagaactcatgatgattttatgatcttgtcttgagcatgtagttgcatcataagttaaacgaagacatacaatcattcaatcattacgaactctgaaattaggtgatggcaacagttagattaattgttagtattattttccagtcataaaccactgttctgaatttgttaagagggaaacactgtggtatatattgtatgaaaatctgattttaatttgctattttatatatttttgcctgagtatgcttcattattcaatacagtctagtgagacgctttcagtctatctcgagtatgtttctgggggctctatccataagttgcttcaagagtatggtgcatttggggaggcagtccttcggaattacacagcacaaattctttctggccttgcatatttgcatgggcggaatacagtgcataggtatgatacttgatataatggtattttgtttttgtggaaccacatgttgctcttagttctaatctatgaaacatcacttttctcacagggatatcaaaggggccaacatacttgtagatcctaatggtgacatcaaacttgctgattttgggatggccaagcatgtaagtacaacatagtgttaattatctgataattcaaggattttaatggatctattattttcctatatgatattgttttgttgactagttattgtatttatacagatatcagcgcacacatctatcaagtccttcaaaggaagcccttactggatggcgcctgaggtaatgcaacagaagttgaaaaaacttctgtactctgccattttaagttggttgcttatcattttctgttgttttctcatagaattttaattttcctcaggttattatgaataccaatggctacagtctttcggtcgatatttggagccttggctgcaccattattgagatggcaaccgcaagacctccttggattcagtatgaaggggtaagcaagtgttatgaatttttcatggtatagtgcccaacttccattggaaccatgctaagctttttgtaactgattcacaggtggctgcaatatttaaaattggcaacagcaaagacatacccgatattccagatcatctttcttttgaggcaaagaactttttgaaactttgcttgcagcgtgaccctgcagcccgccctactgctgctcagctaatggagcatccttttgtcaaggacctagttgcaaacagaagcttcaggtctggcatgacaagggacacgtttccaacttcctttgatggaaaaggcgccatggtactactacacacaatctatgtgctaatcaaacagtgtccatttgtaattcattttcatttgtgaaatctatttgtgatttacaccttagttagttgcaagatatgaacaaatatgaaggaaaagaaataagaacagaaattaactgtcgtatctgtatcttcaagttagaattttgtgtcttaccattaatgtttatatcgtttcaggtacagacaagcaacagaagcttatctcctctacgagatccagacctgacgatgagaaacttacaagtaccaacatctgccattccttcgatttcaactcgcaggatctctgccatgtatgttgtccttttttttttctttcaaaaccagcataaattacatctcttgcattgtctaacagagcgtatttggtgcagcaacccatccaatgtgcgtatgaacatgtccctgcccgtgtcaccttgctctagcccattacggcagtaccggcagtcgaatcggagttgcatgccgtcgcctcctcatccagcctattcagctggagcagctaactacagccctatcaacaatgcactctacccaaaaagaccaagcaaccatgttccagatccatggctcgaaatctctcaactgaaagcaccaccatttgattctccaagaagattgtagaaaacccaaacacactttgtatacaggaatgaaagatgttccataagttagaagaccaaagggggttcctttttttctgtttcaccctttctgtatgtatctttttcccctcaggatgcagttgcatcgccattgtacaaatgcacaaaatgagttcagtgaaaagaagtagcattccagatttcacctgttcttgttgtgtcttttcccatatgatcaattttggtcccgatatgaattcccactgtccagatgcatctttgatatgatgtattttggtctgaattaccactttggctggatacatctttgctgtagaggctggattgaattctatcataaaaaatcgaattcccatccatcttcagaacttgatgatttttcaaagattttgtctccaatatgatcaattttggtctgaattcccactttggctggctggatacatatttgctgtagaggctggattgaattctattatagaaaaaagaattctcactaatattcagaagttatatatgattttacaaagatgtttgcaaaactgaaaattcatggaagctgtatctgatgaacatggaacacatcccctctgtaagtcacttccttctcttcaacacccaaaccccagatatgcccttgcagcttcagtaaaccctttgcatcatctccatggcctttcttggccatggcaccgcccttgccattgccattggcatgatcgccattgtcagcatgagccgcctcccagacgaaccggaacacgccgatggcgcggctcagctgcttgacggcgttcctgatcgccggttcatcgccgtcgatcaggaacttggcggcgtggacggtgaccctcttcccccccttgccagagaggcgcttgccggcgtgcacctcgacgtcccggacattgccgtagaggtagaagaggagcaaggtgtagaggcatttggacgaatggcctaggctcttggagagcttcttctgcaccaggcagtcttgccggcgagcctccttgaaggcgatgtccctctcgacgaagacgttgcgtatctggtagagcccctccttcatcgcggcgaccttgtcggcgtggccggcgagccgcgcgtcggcgtccaggctcttggctaggtcggtgaacatgtcgagcacctcttgccatgtcttcgccggcggcggcggcggcgaatttgcaggtttgttgaaaggggtcgggcgcatccaggatggggacgacgaggtcgcctcgtcggcggtgtcggagaggaagtggacgcaggcggcggcgatctggtcggccatctgggtcgccggggatgggtggcccagcgcggccatgtcggcgcgcaggtcgcggagcacctcctccagcgcgccgcgccagatgtggtgctgcgtcagctgcgggcagatggcgaggcgcacgctcttcctcagctgcgccgacacgcctagcacgtcgcacacccgcgtcagcgagctcagcgacgtcgccttcaggggcggcgcgcgctgccccgcggcgaggtaccgcgccgccagcgcgtcgaactccgccacccggtcggcgacgcgccgcgcgtccgccacgacggaccccgtctccgcgtgccgcggacccccgccgtccccgcgctccacgccccgcagcgacccggcgagccggagcagcctggcgtacgcggcgcggtaccagcgccgcgacgggggcgtggcgtgctcctcctcctcgtcttcggtcggcccgggcacgaagtggatcccgcgtcggccgcccgcgagcacgcggaacgccgcatcggcgccgcgcagcgcgtgcttcaccctgccgcggcattccatcgaacacgttgtgcgcagccgcagagccctagacggcgcacgcagccgccttttctcccacaccgcgtgcgagctctccgctcagatggagaggtatgtgtcaaattttccttgaagggtttgatatattgtagtatttacaaataggtccctggtttggtagtgtcttaataaagttttaaacaaatcctaggacttatctgcataaaatcgtgccttctttctcgccgtttcatgctccatatctcgatttgttttcgcatggaaaggaatttagggacgcctatgtatgcttttgaccctaatcctgatgcgaggctttatatttctgggcagtttaatttgggatttggctgtatgattgagctggagatgtgattatggtgcggattaggtcaaaaaagttaccaatttgactgtttttcttgtgtttatgtgatcaaggatggccgaattgcacagtggaaatgcagaaccttatgatattatcttatctatttgttgagttggttttgaccagtgcagattctattgtgtggtcaccagaaattctatggagatcttcttttttttattgtagttgcaaatttgcaatgatgcttggattgattttgtgcgatctcatcaaacaaagcttagtagatttgattgataccttcaatctattggatgcagtactgttaattatgatggtatgcccgatcctcatttgctgttactttattgtgatttgtgacaaatgatcaatattcaccatggttgtttaatactttaattttcttgtacactttgtcagctgatggtgctggaacctggatagagccaaactactgaatcagtaaagcataaaccaaatattcaataacaatgcaaggtatatgctggttggcgcctcttaaatttgttgtgattttgtaatgatataaccattttatttgcgcatcatacattaattatcgaaataccgtgacactgagaaatagctgacaggattggaggcttggattcatttttccaaggtatttataatttctgcgcttcactgtttaaaaaaatgttctgcaaattatgaatgctgcttattcatgaagatggtactgagcttcctgaattttgtgcaagcatatgaaagcaccagtctagtactaatcagacattgctccattgtttgacacagcaagctggacaaaggacaaatgggaaatgaaacaaatatcaaaccttataactttatttcaactaggctctgatctataaccctactctgctagtctcatcaaccaaaagtcttcgtggatggaaaatccttccccaatcaaattcgctaaatgtattcttgtttttggaacaggcattggacctatgtacagagctatgtctcttagcatgtcatccactttgtacagccctgggatgtgggatggttgtatgaatgccttcctcaccaaatcatcaaagtaatcagtcgcaacattctctatgctatttttcatacaattttcactgacgacgacacagttgttcatccaatagcttatcaattcctcccttgtgaaggtccagcgagggtatgtacccaacaccccaaagcagcgttgcaggtgtttgggaagaagcttacaacccagaataaatggagtaacaaacctggaactggatgcgacgaactgctgacagcgattcagaacaatgtaccagtacttctcattgaggttttctcgaagcagtccactcacaacttttgcagctaaagggctgcacaccctcaatgtcacagcgatcttctttccaataacaagtaatttctggtattcttcagggtgtgcaccacccagggcattttccatgaacatgcagccgagatcttccattgccaggaaccctacaggtaagttttcatgcttattgatcttagttgccagatgttggtacatagtggtaatgatggccttgcttcctgctctacttttcatgaacagtgtatcgagtatgtcattcattcccctggggtagctagaagcaccatcaagaacaagtagaaatctctccattcttagcctttctgatcacacttgaaagattaatggttacgttagaactcaaaccaagcttcttgcacaatgactttaccaaggccatggctggactagtatattctctgcaattcacccatataatcattgagaaatggctcctcaccttgcgatcgtcgcatacgagccgcgcaatcgtggttttacctactcctttgacaccccaaatgggaagcacacaaccatctggagaggatgatccattcttgtctatgtgaagcaagaattcgatggcctgtttcctctcatcgactctgccaactaccctgtcatggatcgaaacaaagatgataaccggtcgatgatgtaacactgcttggtcattctgcaagctgagaagctgagtgaacttggggatcccagaagctactgcttctagcttcttgacagtggcagaaactttcatggtggattccttggatggaatcagctgcgatgctgcgatcttgatgcgtttgaaggagttactagaatcgatgatggagctcaccttgctggacatatctctccagttgcgcagtgtctgatcgcctcgacatgcggcgtcctcaagctcgcgtagccagcgtagtagccatgaattggtgatggcacaccccttggctgcctccagagcggtgtgaatttcgacgagaagctgccgcagacgatgagtctcctccttgacatgcttctgctcctgtgattctgaataaaagatactatttgttggatagtctctactatgaccactgaacataatacctctagtagatccaccatgtttgttccttgcaattatagaggaaactacacaaaaaaaatgagtttagtacatagccaaagtctgctagatgctgataactacaaagtgatggaagggatgagccccaatctttgatattagggaagcaaggaaatattgaataccaacagtataatagaaagggagatgtttcagttagtccaagaatgcttcatttttttcttttcttagcgaagatccctaaccgatttcgtgtattgatgacaagctgtctacttcagtatctcctctttaattaccaggaagtttccttggtgcctcttttgtcttgaggtctgaaaaacaaagacacaaattatttactattgccactgtctcgcctaattatcattgaccggttccacttcattcagaacatggccgaattgtttacacgatagatattcaattattcaggtccattctgtcattttctagtttgactccattgctagtgtgagcaaccgtcaaactatgaccattttattgttatatatattgcctcatggcctctctgtaaactgttcttcttcatgcaggttctgagaaatgcttgactatgaagatgggaatgtgctcattgactatttacattggtgtctgactcactatttgatctatcaatcatttcattaatatgtttgtgcgtttagagacattagttaagttgatgaatttagaatgaactgtttaactagtatgttaattgaaacattattaggataatccaagtgagtaaagagttactgctgtggcttgtgaaccgggtacatttttcatgacgtatttactgcgtccataacaagcattctaaatgcctaagggtctaaactatcagttggtaagtcctgaatccaagtgaactgcttagcaggatgcctgggacctactatgcaatagctttccttggctgttcacaagttaggcaattgacctgacagtttataccctgagcttgtttgaacctgtgtttgagtggaagtctccgactgtttatgctgaagcctcccatcgtttgctgttgtcaaattttgaatttaaaagttaattttggagttgattttggggtttttttcatcgtagtttcttactttcttttcctgaattagcttttaaatcactaagaacatatatataaaagttttatctaggaattattttttggttgctgataagttgttctacagattaacataacagaatgacagatctgtccgtccatgtttcaataatttaatgaaacctatccaggaatatatggagcatgtctctttctaaatgatttgttgtgtaccacaaattttagcgatgatgaattccacagtgggacattttcagcatgaaaaatccaatactcttagtggagggaaaaatgactttacggaacatttgactcaagtgtctgtcttccaagtaatacagcaattgcagactataactgtgagtgaacaccatctaatagtctaaaacggttaactagattcagctgagcagaacaaataaataaggattcctaactagtgggatctacacgcttttagcaatatttgtttggcaaaattatcatattcagattgcagaacaaccagccaatcaaacattctaatggatttttccttactaacatattgcctgagaattataacggaattttaattaaagaaaattatcattaacatgttattaccatctattaattggtgtatatatatttgttactcacatgtggacttttttagcttcacactggtttttgttttccataaaatatagagagttggtgaaatagctgatatgtgagccct

SEQ ID NO: 16433 - DNA, 1293 bp, Oryza sativa
tgtccacaataagcatcctaaagccccaatggtctaaaagatcaattggtaagtcctgaatcaaataattcagaggtaaacagttaactgcttggtgcttgcctggacctacagatcagacaaatggtggtcagaattctgatatggcactgcattgttcatgaatctttacttgggtgtttacactaaattaggtaattgaccagacagactatgccctgactgtgagcttgtttgaacctgtgtttgaggcctagtttagttcccaactttttcttcaaactttcaacttttccatcacatcaaaactttcctacacacacaaactttcaacttttccgtcacatcgttccaatttcaatcaaacttccaattttagcgtgaactaaacacacctggagtagtctactgttaccatgaacattgaacttgacgaaaaaaaaagtctacgaatgtttcgataattcaatgaaacctatccttaaatctagcaaacatgtctctttctggatgatttgttggggaacacaattttggggatgattaaattccacagtggggtcttttcaatgagaacattcattaagttaaatatgacttaattgaaacttctttttttgttttggtctcaagtgtctttcaagtactacagcagatgaagactgcaactgctagtgaacaccatcaatttggttaataagattcagttgagcagaacagacaaacaagctaggatcctgaattagttgggcagttgggcctacatgcttttacgaatatttgtttgacgaaaattatcagattcagattgctgaataacagtcaatccctagtggattctccataaaacccaaagttattatacatcaatggcaataaaaggaaacgtagtaaggttaattgcatacgttatttgtagattctgaatttctgcaatgttatggaaacttagctataagaaaaacgatgtgtctcgtaagatttcaagtgtatccatatattgtctaatggggaacctgaaattcatctgatggagtctgaaatttccttagatatgggtgcacttaagaaacttccttagatatttcgttatggggattctgaaactctgaatgtgatgaaaacaatttcctaggtcaggttctgcagttctgaatatactgcagtttacttgcagttatgcagtttaggaggcaatgcataactatctctctgttttttttttctgaaagtaggaatgcgtaactgtcaaactatttttcttaccggcattggtaatgttaacaggttctt

SEQ ID NO: 16434 - DNA, 1471 bp, Oryza sativa
ttacaccaagtgctagccactacaaactaaccaacctaggactaaaatttgttgataatttacacatgacaaattaaagtagtaatctgctagttcatgaaccaattaagcatggttaagtaagtcatgcatatggtacaaaatggtaggttatattgtaatcatcatagttgatttgatcaagctagtgaagattacgcgaaaaccatcaataaatacttgacacggtaacataacacgagcccatgatagagaatatatatataattcatgtctttcttgcactttcttaacagttcatgctattatatatgctagattttcaacatgcacgtgcaagttcataattataaacacgttcacaaaatgtgtttaatttcaggtgtagctgtgttgtactgcatctgacctggtcaggactattaattactcaggccagccatatacgactaactacacaaaagagatgaaatgttcagacacatgttttaactctagtcagttagcttatctgattgattaatcatccatccaatgagctcaattgctaccaagaagcttaagctagcaacccaatcttactagctaatgcccacatatttacactaatgaggagtaaaaataaatcagctgttctatacttaatcatgcatggttataattaatctttattttcttaagcatcctaatctctcggtagttgggacagatcgaatagcttatgcttagcttggtaaggatgaatacgaaagcatgtacttctgaagagttcgttttcttgtcattcccatctcttcttaggattggttgcaagtccctgtcagtgctggaaataaatctcatgccttttggacattaaccgattgatccaaccgtgcatgcacactagctaatgttttctaacacctacgtcatcatggaaccctaattgagcttgcagcatacgtgtgttaattagttctttcaacttaaaccaacctgctgatcgagtcaatgtgccgtttgacgatcacaatttgtagacgaatgttcatgttagtattcctaaattacacatgctattattctagatgatggataatatttttactaatttgtatctagcaatactttatccatccaaaagtcataaatattttctgtttttttttataaataagatggtcacatatttgtagtctcttcgtgcatccaaaacttaaatggagatattgcatttatattttgcaatgctagattaaattgttaatcgaaacccgagcaactatcttaatactaattggttacatacatgtatatagtttcttagtctttgttacatggttaatttcttcttagtcttggtggcaaaaagaaatatgccttggactttttttatagagggggtatatatatatatatatatatatatatatatatatatatatatatgtatgtaggctcataatatggacaaataatattcaattat

SEQ ID NO: 16435 - DNA, 3665 bp, Oryza sativa
gactcatgctagctactcatattctaaattataggagtattattattaaggttgaaatcaccaatgacctttgttggtctcattagccatcaaatggatggaaccttccaatgaaaatcaaactgggattctctgacaatatccagctaaaaggaagcatcaattaaggaagaggttagttggtgatttaattaactgctagatgtttaagttaaactatgtatgagtaatccagattgttgccagtaaactagggttagcatccaaccaactctaattattattaaattaatgttcataataatacaacagggtacgtggtacacctgtaagtcttaggatggatggaatatcatgatcccagcttgcctgttccatgtgagcataattccttcacccaactacatgcatgcatatattatatgtgtgcttgaaatacttcaaaaaactattagggctcataaacatggagctcgcttgatcctttttctactgaaaagaaaattaatcagctatatgttggctacagtggtagagcctattgggtataattttattactaaatctatggttttatataaattcaacgctaaatctgtattttggtgttgcactttttcgaatatagtttttgtgatagtttgattaaagtatatgtattttttaaaaaataatcaattccaaatgacatagtatagctctacatatgtaaaaaaacatgtcgggctgatatgtctcaacttaaagaataaatatcttgtaaatatccatactaaatgcatctaaaacatacatttagtgccattgaaagtactttcttgttagaattttaccatgttctacaaaatatatcaatatatcataatataaatttgtgactaaaattttatttctaagaccgcatctagtgcattatgacgtgtttttgtgaccataagtattcgacgcgcgagattgattggctactcagccctcatattaccattaaccacaacaaaacaccaacaaattaggatgagttctttcccccaagttcccaactcatttccctcgttttccgcgcgcacgcttttcaaactattaaatagtgcgtgttttgtaaaatatttctatacaaaaattgctttaaaaaatcatattaatctattttttaagttcttttatagctaatatatacttaattaatcatgcgttaatctatcgctctattaagcgtgcggaggggaggggttcccaaccagaacacagccttaatcaggccaccaacaagcaacatgtgccagctaggcttggaaatgaaacccccaaaagtacaccaaaaagggccccaccacaaaacacaaaaccggtactagctgggaagtgggaaattctatttaacagtccggatagacatccacccacaggagccatttgtatcttagttcttgtttttgtttttgactcttttgcattacttcctccaccctaaaataacaagttttacttcttgacatggctattaagacatggctattaagaaaagtgatagatgaggtataagctaggactataataaagacgagtgacaataagaatagtatggatagtttagtgataaaatatgtattttacaactacttgagataaactttgaaccctataagttattatattttgcgacggagcgcgtaccatgtggacattacaatggcaatacaataatagataaacattgtcaactgtcaaatcctccccttggcccttgggacccccatggccttaagctttgcaatcatgcaagatcactttggttttttccaacctagagagaagccaaagggatgaggagattctccatgattctaatttagatcgactatctccatgattctaatttatgaacatcctttcttcttccccttagtataggcggtccaaattggtgtgcctaaaatgcaggaacttcaaaggaaacaattttctttcatattaaaaaaatataacagatacaaaaaaaaaaccaccatgaatttgtgatgatttagtcggaaatggttctcagtcggtcgaaaattttccatatttaattaattattcagtgacgactataaaacctcaccgacaaaaaatagaaaaatcagattttgtatttggctaaaatcggaaacggtgccaccaccgtttcatctctacatgattggtttgcactcactagaacatctgtggagcctgtgctcagccagggtcagtgctaagtcagttggagatttggaatgaaatgcataagcatgaggtctttgccttgttggatgccggagcatggacagtggtccatccatggtcagagtctgtgccgttggcccgggagaaacggctgcacgcctttgacaatatgaggtgaccaattctccggtttgtgtggatcagatgatcaagtgatggtatatatactggagtataattcaattggcttgactatattcgaagtaacagattgataatgttatagattgatactccctccggtcatctttattagacgctgagagagctataagtataacttttccgtcgtcaaataaaagtgactgaaaggagtatagaactttttttagaaaaaaaaatttgtagattggcattgtaatcatatgagtggatgcaaatggagcaaaggaaggatgatgcagtgaattatgaagaataataataataataagacaaaagtagataagtaaatatgatatatttgaccagttgatcgatgcaagcagtaagcattttaattagttcatattttttttattaaagaagatcatatgtaggccccctccaaaggcaaacttctctagcatatctacagggtggcaaacaaaatcagatcctaaaatgtcaatttaaatgattgcaaatgaccagtttttcctactaaatgtatatactaactactagtcaatttggtcaaatttttgaaagtttgagtacacatatatggtttacatggatgggatatacaaagttctcatgggcagagacttgccttaaaaaacaacaaaatataatggcaaaatttgctataggacaaccaaaaaaacgtgtaattagctaggagacaccacaagaacgcgtttttgctatagggcaccgtaaaaaaactggtaattagctactggacaccctcgggattattttattataggaaaaagtacgaattacacccccgaactatcgtggtcgtccgaattacccccctgaaccacaaaactagacattcttcaccccctaactatgcaaaccggacgaattacccccctcggttcaatccacggtggttttggtctacgcggcgtaagcgtggcagtccagtcaacattgtatttataaaaaaaattgcgggacccacgtgtcatactcttcatccctctcttctctctctgtatgcctcacttttcctctctctctcacgggtgggtcggcggcggcgggcgaccacgggcggcgggcggggccgaagacggcagcgagcggcgggtgggcacgaggctggcgacaggcgggggcggaggaggaggcggggggcggcggtcgaggagccgaggccggcgatgggcggtggcggagaaggcagcgggcggcgggtgggcgctaggctagcgatgggcggggacggaagcggcagcgggcgg

SEQ ID NO: 16436 - DNA, 11553 bp, Oryza sativa
ccgccaccctcgcgcccacccgccgcccgtcgcgccgttcgcccccacccgcctccgccgacccacccgtgagatagagaggaaaagtgaggcatagattgagagagagaagagagagaggaagagtatgacatgtggatcccgcaaatttttttataaataaaatgttgactggactgccacgcgtacgacacgtagaccaaaaccaccatggattgaaccgagggggtaattcgtccggtttgcatagttgggggtaaagaatgtctggttttgtggttcaggggggtaattcggacgaccgcgatagttcgggggtgtaattcgtactttttcctttattatatccggaagaattggagagagaaacagctgtgtaagtacagatttaccctttgaatttttttctttttctttttcttttttcttccttatccttttctccctctctcgttctttctctctttctctctctgctctcaaccgtcgccttcaacctcgcccgcggccgccgccgctcctcctatgctcgcccaccgtcgccgctccgccctccgcgctcacttgctgtcaccgctcctcccaggctcgcctgccgttgccgctcctccttcgctcgcccactgtcgccggtgctactgctccatggcttcatgtccttcatgcccagcacggtgacgtagacatgaacgcgctcagccactcatcagtagccgacggcgaccattggcgcgaacgcggtgccgaacgagcagtcagcggcggcctgcgatgttagctaaataatgcaatcttgtgcatctagtttctgtagttgcattgcatatgattggctgtgttagaatctgtcagcagccgttttactttcagttagcatgtagctgttttctagctagtttttcggttggactgaattggatcgtgggatggcacggtcagtagtggatccagatcaatcgggtgttttttctgttatgcatgtaacaaactctgtaattgaggagaataattagaaaaccagaaaagcagcaaggtacttcgctgtgccaaaactctgctcgttctactctgttcttcagttaactattcatatattcgacaaaaggttcagagattgtgagagtgagagtttgatcctgtaaaaatgagaccgtgtgcttcacatccaccatcgtttcttctcctctcttgctctttgcttggtgatgagaatgtaagatgtgtttaagcccgtgattagtgaagactaactaaagaaaatgtttagcggcccacgttggattaacttgagccaaaggcaaactagtttttaatgattgtttctctctcctatttctctaaaaataatcccgccggtgtccaatagctaattaccagtttttacgatgccctacagcaaatacacgttcttacgatgtcccctagctaattacacgtttttcagatgtcctgtagcaaattttgccaaatataatttcatcggcctttcgtagtcaataaaaattcatggtcacataagtgtatttcggagaccaattaagttatcgtccaaagcaacaagtatttgtcaccaaagatagcattacttaatgaatcatagcatgtccttttgcgaagaacatatatacgtacctaaagcttattaacaaaagcaaaagtcatgcattcgatgagtccgtttatagataaaaggaaagacgagaataaatcccatttttccacaacatgtacttttttaagaaaattaaatatgatagcaaaattgagactaatccgcatctagtcatctaccccataaaaggagagatctccctgtcatatacagcactgctatacatacgattgtttttatacgacgtttgtacgatgaaacgtttctctcctaacttctaacgtttttttagcgatgaaacggatcgctcccctgttgagcccatatccaaagcccaagctctgacgtgctggtctgctctctcgttggcatgcttgcgtagccaaccaaagcaatcttctttctagttatatattaagcaattttcgttctaattatatcttatatagtaattgtacttagcgctcatttgttatgtggcaggtgaagcaaattactcatacatatatgttccttacaccttggacagggatagcatcaggggttgctagctggcgcgcgcgcgccagttgctcccggcccatcagccctatttttctttttttcgcgattttttttcgtttttcttttgcgatttttttcgcttttttttccctttttttattactttttttaatctttagcacacttatttttttaaaaaaatgttttgagttgaaagttttcaaatctcgatttgaaagtttttaaatatgagttgaaagttttcaaatcttgagtcgaaagttttcgaatcggagtcgaaagttttcaaatctgggatgaaagtttttaaatcttgagtcgaaagttttcatatttttttcaaatcttaacttaaaaaatttcaaatctgtacttgaaagttttcaaatcttgagttgaaagttttcaaatctcgagttgaaagtttttgaatctcgagttgaaaatttttaaatctgagttgaaagttttcaaatatgagttgaaagttttcaagtcgaagttgaaagttttcaaatcggagttgaaagttttcaagtcggagttgaaagtattcaaatctaggttgaaagtttacacatatatggaaaaattcggaaaaaagaaaaactaaccgtgtcttgccgcccattgggccgtgtgggctggcgcgtgcgcgccgccggtgcgtacgcgccaattaggattcatggatagcatcaaccatagttggaagtagaatctaatggccacaatcagaattggatgcagaaaaagtttatatatatatatatatatatatgaaccaatgttaaacaaggtttgcatatgtttagatacagagagactgtatagtgctgctcagcatattaattgatgtcacatggtaacgaagcagaacttctttcaaacatattccactcttttagtcatgagatagaaggacaaaaatatcttcttttcccttcagattagacagtaaatttagttagattgaatactacctggtagattattttaatataatctcaagtataatataatctcaagtcagatgctgcaaagaggttaattgggctttcgggcccataagcgctcctgccacgtgtgcgtgcgccgtgcgctcgcgttaggttcccctgccatccgcgtcgttatgtttgatcgtacaaaaatcggaagaaaaaaatcgtatgcgtagcattttccatgtcatatatatgtgcctagactcaagtggatagattcatgcccctattgcaagtcttttggagcacatatataacccagctcaataagttgatttttggcaggttcaaataagtccatgcgaatgggataacaacatcatgtggcccaccgaagtgagctttgcacgaacctgaagtccagagtatgacttcagcttttctatccaacaacaatatacatgggtgtactgtgtacaacgccatgcaggcttcacattctccttttgatttcagatttatccaatctcactagctacctcctatgtacttgtttccactttatatcgcagaaattgcttggttcttacaaacggaggaggactatatagaaataaaacatggtacgagaaacaaataacaaaaataaaagaaataaacatggtacgccaaagagaagtatccactatgcaatataaaatctactgaaatttgttagttttgaatcaatcaccaacatctatactatacgttggacattgcagaaaatagtccaatcctataatttgaactattgataagaaaaagataagcaaatgcgagattacatgagtaatagttgggtctttgaacggtccatgtttgataagaaaaatataagcaaattgaggttacataaatgctagttgggtcaaaaggaaatcctaagcttagcaaaagcaacctagaaaagaacaagaagaaaaatgaaaggactagaaagtgcaataagattcttgattaataaaaataaatcaaacttgaagattacgtggacaaattatccctaccaagttctccacataaacaattttgtcaaatttgaattggtcctagttgttgactagcatttaagtagctttaaacataaataattccaaaaagatagttcaaattcccgccaaaacaaagataataattcacattaaaaacacgtcgacggagaaaaaaattcctactatcctattaaataaacaaactgtttaaccccaacaaaaatgatctaatcacagaaccgcaaaatagctacttctgaatcattatcatcctcgtcagcatcagtgagctagagctgctaagaggaacatgaggacatgcatgaactcatacgcattggccaccccatagcatggagcacgcactcgttttgacttattttttaattaatttattattaatcaatcaattaaaacttcataccacacacaaacagaaaacattaccccaaaaaacccataaaaattaaaccgaaaaacgcccaaaccaaaaagataaaaaaaaaacccaacgccccctctctaatcaacccctcccctaaccttaccaccacccaaagccctacccgccccactcacacccacgtgggccccaccacccctggccccacgtgtcagcgagtggcagcgcccgtcacccccgcgttcgctgtgccttcccccttaatcaaatccagcggatatttttgacgtccgcaaggacaaagtctcgccattttctcctccgttttgttttttttttcgttttcttttttcttcctcgctttctctctctctctctcctcctctccctcttcttcttcttctctgccaaatcccatcgcgaaggcgagagagagagagagagagaagaaaaagtgaggggattaacaaactcgcgagtttttcttttttttttttgtttattgtgtgaatttggcccacgtcggcggcggcggcggaggagctaaaccctagccggaggtgaggtggtggtggtggtggtcgggaagtggcggcgccggtggtggggcgggggggcgatttggcgcgcgcggccgagctccggatcgccggatttgtgcgtgagcgcgtggagtttgtggcggtgtgctcgtgttgctgttggtggtgaggtgtgaggtgaggtggggtggtgtggcttctgctgctgctgctactgctgctgctggtgcttaattttgctcgggttcgtggggttgggaagcgagggatgcgatctgggaggtgttcgggagctcggtgttgcttaattccggtgctggtttgcggtggtgcgcgcgcggcttcttctcggggtggatttggtggtggttttttttgttgccctcgttgttgcgggtggatttcggggggagggagagtttgagggatgactgctcgttcttgctcaattccggtggatcttacggtggaaggatggcgagctgagtaaaggcgcgcgatatcttgctgcggtttgtgcggagcttcggagcactttgtcattgctggcaaggatgatgccgtcggggccgctcaacccgatgggtcccgggcagccggtgggcgccgccgcctcgctgctccggacgagctcaagcctgcttagtggtggtcagcaggggatgggcagtggcggaggcatgattccttcgcagtcgcccttctcatcccttgtgtcgccgcgcacgcagtttggtgctaatggcctgctgggaggtggctccaatgtttcctccctgctcaaccggccgtttgggaatggtggacatatgctcggtccggggttgatgccaggtggtggtgggattccaatgaataccctccagcagcagagaggagggcttgatggtgctggcgatttggttggcgtgggaggttctgatcctctctcgtttccttcatcgtcgcaagttagtttgggcaatcagctgggttcagataatctgcatcaaccaccgcaacatcagcaacaacaacagcagctggatgctatgcacgacttgcagcagcagcagcatcatcagcaactgccaatgtcttacaaccaacaacatttgccaccgcaaccaccacagcagccacaggctacagtgaagttggagaatggtggcagcacaggtggggtcaaattggaaccgcagatggggcagcctgaccagaacagctcagcccagatgatgcgccatgctagcaatgttaaaattgagcctcagcagttgcaagctctaagaagtttgagtgcggtgaagatggagcagccgacttcagacccatcagcattcctgcaacagcaacagcagcagcaacatttgctgcagctgacaaagcagaaccctcaagctgctgcggctgctcaactgaaccttttgcaacagcaacggatattgcaaatgcagcagcaacagcagcaacaacaacaacagattctaaagaatctgcctttgcagagaaaccaattacaacagcagcagctacttcgccaacagagtctaaacatgagaactccaggaaagtcggccccttatgagcccggaacctgcgcaaagagattgacccattacatgtatcatcaacagaacaggccacaggcaagtttttgggttattcctaacaagtaatttagtgttatgtgaaggccatgcgcttacagtttagtgtctctatttgttccttttggtgcaggataacaatattgagtactggagaaattttgtcaatgagtatttttctccaaatgctaaaaagaggtggtgtgtatctctctatggaagtggtcgccaaactactggagttttccctcaggtttgatgtgctgtttccgacttgccattttttaatctagaatatagattatcttgttcatatattttcttatgcaaggaagttctgttctattatttaattggcaggtgcagagtagtgacagtgcctcacattttaaatttcctttcaaattgttagttgaagttctctatatttgcccttgtaggatgtatggcattgtgagatatgcaatcggaagcctgggcgaggctttggtaagcattattttaatttgcacatgtttctttgtcaattctgtttttacatccacttatgccactacacctttacagagaccacagttgaggtgttaccacggttgtgccaaatcaaatatgccagtggtacattggaagaattactatatgtggacatgccacgtgaatcgcagaatgcctctggccagattgttttggactataccaaagctatccaggaaagtgtattcgagcaattgcgtgtggtacgcgaaggacatctaaggatagtttttaatccagatctcaaggtattatatttttaatttattatttgtctttttttttggttactggtgggcctttaaaattagttgtataataaatggtgccttttgaactaaagcatgtttccttttcttgaagatcgcgtcttgggagttttgtgctaggcgacacgaggaacttattccacggagatcaataataccacaggtatttagccctatagctatatagagatttttattcaagacaaatgtcttatttcaatattctgatttttgggcaaaatgggaaagggttcaatatattttgtgacgcttggtgtttctaagcaggttagtcaactgggcgcagttgtgcaaaaataccaaagcgctgttcaaaattcgacaaatctgtcaactcaagacatgcagaataattgcaactcgtaaggagattttctctgatgccctcaatactttccatgttcagtttattgcaaaatcattaatgctttatccaccttgctccgatatgcatatttttgtgttcttttgaaatttatcttatttgcaattgcaaagaagccgtgtctactagtgtaaatacttttattaactctatgctagcgtgagctgtcttccaaaatgggacgtagcctctgtctcattcttcgagttcagggccaagctgtacaaatagttaaatactagtattccgtagcctaaccatttagattttgtgtcatagcactagatagatttgcactatataatggatgtacatgaattttcagttagaagtcaaatggtagtgtgagggcatacacaatgtggaagaactccgatctggctcctctttgtatcctgccagttaccttatcttttgcattctggttcgatgtctatatcccccgtaagaaaattgacattatgccgttgtcaaagtgggtttcactggaatgccatcctgcaaatgggtttcgttaaaatgtcattctcaaatagggcaacacaccacaatgccatttcttccatttattctcaatcaaatgaattttgccctgtttttcttgatgagctgaccaaaatacgtcacgctcgttctctctctctgtctcgctgggctgtggctgccgtcagcaatgcggcgccattactgagctctggccaccccgcatcaggaaggatgggaccaacgccgttgtgcacccaccgcacgccaccgcactctcccgatgaggacagctggcggcagagctccatgaggatattcgcgcacgagcatgatgaggttggtggcgtgcaatggagctggaggaggccactgctgcttgaggaggctgcggtggcgctgaaggaggccgctggtgcgagagcttggggaggacaccggcatggaagctggaaaaggccggtggtacgggcggcgatgcaggagcttgagttgttctcctctgtttctgcctcaatccatggcaggtgcaatttcatcaattgaagttgcaaaagagggcaaaattaaacaaatgaattaaaaagggatgaaatggcattctagcaagtagctaccatttgagagtggcattttagcgaatcccacttaagagatggcatttcagtgaaacccacttttgaggatggcatgtattcaattttctcattgcctgcagacttgtctgttggcttgatgctgccaccagtaagcttgagaaagcggagcagcagcagcagcatgtgaagaggtgtcgagagtctgagaaatacataggatcatgagatcaggactttaggagaagatgaggcgaagaggatgatctcctgggttcacttgagagaagagatggctgttgatctggtttgggggcatgatttagggaaggagggagagggtggagatatgggcttgtagattgtgtgtctgagtggttactagtagtaggctgccctgagtaggtgcgaaaataattctccgagaccaagtctctgtttacaccgtcctcaaaacatgacaggtagacataactgccatctacaagtagttaattctagagtacgttagtgctttgagtagggtctaaacagagacctggtctaggattattgttgtagcgggacttttttcctttaacctgttctttttactggctataattggtatatgatggattttcactgaatataactactgctaattgctggctaggcacctgcctagtgtccaagtgcccccaaagtgccaaaacacagtgctgtgcaaatggcgtgaggcatatgtggttttctggtccactggttgagttcctcatggcacggtagttttgtactgtactctgtgatgtatgcagtcctgcatgtaattctctactgaactacacgcattcccccgaggtatttcgattaagacgcatccaaaactgtggccaaggaaggccacggaagaaggtcctacatgcatacagcctttctgcatgtagtagatggaaatttacttatttgaaacattctatggaaatttcatttatttctttttctaattggatctctgagacaaattatgcctgataagaaagttactattgaggagcacttacaatggtctagttagaaggcaagttagagcagcattattcaagtagcgtaacatgtggaattaacatattttgtgttacatattttgcatgtttgacatgtgcattaacccatataggcgaaatatctattaaaatatatagttgagactacagaatgagatgttttacaaatatacaacattcttttaatgccactgtagtgtgtgaaggcgttacgcaaaacaaaggtgtggggataaccactgaattttgaaggtttgcgacccagtgattttggataagtttagctcactgaccatcagccccctaaaaggttaagcttccaggggaacactggccatttattcacgtccatgttcatctcaggtctatgatgtggatggttaagtgatgttggatgtgtatacagaaaaaatatcagtgcaaagtattctggacctatgggtgtatggtattgttctagcaccatgtgttcttattctgttagggaagataaataatttatgtgttcttagatgccatgcatttattctccataaaagttgaccttaatccatttctgagataacaattacataaaaatgttgttgctatagaaggtagcattttagctagtaagggatcttggagacttggattacacacatgatactggatattacggtgacatgctcaagcaagatgtttcacatgtattctgtttatcatctgcttatctccttctgtagaggtcactatctattgacaaaaaatactattgttgttgttttttaagttacgaccaaatagttgggagtccttaaagaagaggtggtgatggagtgtgctctacaactttttcttcactttcagatctttcaagcgtgcacttgaaggatctttttgcatttgaggattcttttttgctttttttcactttagtgcttttggtatgtttgcttccgaacattattttgcttctttaataaattatatgtcacagaaaaacttatgagggtagaccaatttgtgccttttagggctcactttcctttttcactgttgtttatgtaccaagtctgttgattttgtttttctgtttgattcttttttgggataattgacatttgagtactgcaaattgtacttatttttcaatcttttactattaggtttgttgcatgtgcccgccaattggctaaagcactggaggtgcctttggtaaatgatctgggatacacaaaacgatatgtgcgctgccttcaggtacacttatacatggttctgtttttattcacctgttctgtatttctacatccaacaaatttagattattgtcatatgcaaaagttggtattttttacataggactattatcattctttgttgtgggcctttggcacctgttgccattctctatttcgttaaactaatttatctgacctattgttttgtcatccaaaacattgatacttccagattgctgaggtggtaaactgtatgaaagatttgattgattatagcaggcaaaatgggtctggaccaattggtacgccatttttatcttctgtttactatgcagtctcatctg

SEQ ID NO: 16437 - DNA, 8195 bp, Oryza sativa
acttttattgattttgttttgctgtttgattctttttttgagagaaacgacatttgagttctgcaaattgtacttatatttcaatcttttaccattaggtttgttgcatgtgcccgccaattggctaaagcactggaggtgccattggttaatgatctgggatacacaaaacgatatgtgcgctgccttcaggtacacttttacatgaatctgtttctatcatctgttctggatttctacatccaacaaatttagattattatcatatgcaaaagtcggcattttgtacataggactattattattctttgttgtgggcttgtggcacctgttgccatcctctacttcgttgaaactgttttatctgacctattattttgtcatctgaaacattggtacttccagattgcagaggtggtaaactgtatgaaagatttaattgattacagcagacaaaatggatctggaccaattggtacgtcgtttttatcttctgtttactgtgcagtctcatctgatctcatgtcatcttgtttagcattaagtaatcttcacatattatatgatcagttgtacttctacaactcctccgtttgttttcttttgattgtacgttctattcactattttttatgaagacaagtttccaggctgtacaatttttatccatttcccaaattcagtagtgtagttaacaaggaagtagagcatgcaatacatgctcagatgagtaacatgctgttattgatctgtcacaacttccaaccagcgactaataacatgtgtttcaattgagactgttggtagagggctggtttcctgcattttctagttgctttttcgccagatatttgtttcatttgtttttgtttattcaaccttcataacatacttggaatgaacttattctgagatacccttgctgatttttgtctctagccaaagaacatggtagtctgttgctagtgttaatttaacaccacactgctattatttgtttcagctagtttgcatagctttcctcggaggacttcatcaggggtcagccctcaccagtcacagcagcaacagcctgaagagcagcaatctataccgcagagttcaaaccaaagcggtcaaaatgctgctcccatgaccggtgtgcaggcttctgcctctgcaaatgcagatgtgacatcaaataattctctcagctgtgcaccctcaacgtctgcaccttcaccatccgttgttgggctcctccaaggttcaatgaactctagacaagatcatccaatgagcagtgctaatggtccatataccagtggaaacagtgctgcaattcccaaggtgaactcgacaacctcactgcagtcaaatccatctacctcttttccttcacccatgccaacaacatccaataacaacatgatgcctgcccctcagagcacaaaccaactcagctccccaaccacatcatcaaacctaccgccaatgcagccacctgctactcggcctcaggagcctgagccaaatgagtcccaaagctcggttcagagaatattgcaagatttgatgatgtcaccgcagatgaatggtattggccagcttgggaatgacatgaaaagaccgaacggacttacatctagtgttaacggagttaattgtttagttggtaatgctgttacaaataactcaggaatgggaggaatggggtttggggccatgggtgggctaggtccaaatcatgcagctagtggattgagaactgcaatggtgaacaatgcgatggcaatcagtggtaggatgggaatgaatcacagtgcacatgacctatcacagttgggccaactacagcagcaacagcaacatcaacagcagcagcagcagcagcaacatgacttaggaaaccaactgttgaatggacttagagcagcaaacagcttcaataaccttcagtatgactggaaaccatctcaataaagatagaacattacaagttcgacaacacggctgctctcattggcctcattgcttatgaagcatcagtaagagtgccaacacctcgaactgtgtcaaagcatttggcctttgcaataatgctgtcatggaaaaaggtcattcgcgacagcaagcatctgagcctgtcaactgtatgttgtaattgttcgtttagctgcttgtgtgttgtgcaactatggcattttgctgcttgcttcagttgtcttaccgaaagatagagttaaaaggattagagccttgcctgcacctgttgctatcctttgatggtacggtgttacttcttacccggaaaagaagttttacctccctttttttccatgtcagatgacatccgatatgtaatttatcgtcccctccaccttccgcccttagcaagcatatgttctgatatctttctttgcctggggattctctctttgtagccttacttgactttgtataagctgccataatttagtagtggaaaaaagtatcaggaatgttttcgtaggcttgtcgcgagatctgactggcaagaaaactggcattctttctttttgaaagatttcaaccattgtggtggagatttttcttgaaatattcaggttgacctgcatatgttgtccatcttgtttctgttgcagccatagagttgctcgttacaatgaaaccctgcataaggcaagggacttccatactgtcattacaatgaagattatctgtgtgtaaaatgcaagattggccaggccatgatgtatcttggctgatgggtttcaagtgctgatgaattttgctgacatgtagttgttgcacctcgtttggttaagataaaatgttgtcaagtacgtagtgaattaacaaagttataggcaacagtatcatcatgatcacagttataaaaaccgtgtttttgttgggggtttggacctgtgaatcctgcttatatatttatgacactggctgtacggccaatttttctagtagaaaacccactaaatcaataataaacaagagtttggtgggtttaagctacccagttttgctgatactattgatggtgtatcagcattcaagatacatcaagagctttcagaagagtttggtggatgtatgaccagttttgcaaatacccggttttaaagtttgatggtgtattttagacaaagcgaagagttaagggtcgtaaattgaaattatccctcaccacccaccacctcactggctaggcggaataagttcacttcatgaccctcaactgtgatcgaaatctaatccatgaccataaaccacaaaaccggatatcttgacccttaaactcctaaaaccggtgcaatttgactccctggacagttttgggaggcggttttgctgacatggcgccacgtggcacctacgtggcaatattgaccgagtcttcgttccacatggcgttgacgtggcatctacgtggcggtggaaataaaaaatatgcgtgggcccattagtcattcacacaaaaagaaatgtgggcccactgacatgtggggcccacatgtcagcccttcttcctccagcctctctctcccttctctctttctctccccttcttccccttcagcggacggcgggctgcgagaacgagcggtggcggcgcgcaattgagggccgtagcgacgacgacaggacgggcgagggcaggagcagcgagccgtgcagccaccgccaccttgacacatctccccgccgtcgcgccgccggcgctcgcggcgcccatccaccgtccacctgctgccgccgccgccgcatgcgccagagggaggcctagcacgctcgcggatccctcctcctcctcctcgcctcgcccgacgacgacgcggcttgcagcgatgcatcgcacgatacggccacgctgcctcgacccgacagcgtggccctccgcctctcatccgcctccttctccggtgacggcgcagcgcggcgctgaggctgggcggcgacgccctggaggcggcctgggcggcgttgggtggcccggccaggtggcgcacgacggaaggggaagaggcgacacggggaggtggccggctcggccgtgcacggaggcggcgcccgcgcagcagacttggctgtgcgtggcggcggcggttcagcgacgagctcgagctgggctcgggtgtggtgatgacgatggcttgggcggatgaagacggcggcgacggcggcttcgatggtggacgacgccaaggcaccgacattggcgaggtggagtcggggctccatgtcgccggcgtgaggagagaaagagagagaagggagagagggatgaggaaaaagggaaaagagaggatcacacgtgggccccacattccagtgggtcccacatttttttttgtgtgaatgataaatgggtcccacacatatttttaaaatttgagtgccacctaaccgccacgtcagcgccacgtggaaggaataccgggtcaataccgccatgtaggtgccacgtcaacgccacgtggaacaaagactcggtcaatattgccacgtatgtgccacgtggcgccatgtcagcaaaaccgcctcccaaaacctcccagggagtcagattgcaccggttttagaagtttgggggtcgagatatccggttttgtggtttagggtcatggattagatttcgatcacagttaagggtcacgaagtgaacttattccctggctaggctagctgcgaggatttgttgggccaggtcagcgaaacataggcccatcgatctggtagttgggccgtgtgcatattcagcatgctggcccacactgcacgcccaagcttggtaggtcaaagtagaagctggacctagagcttaggtcaacttattgttagtattgtatttataaggcatattttattttagttttacaaagtcaaaatattcttcaagacctcaacttggtaacccgtctgtgttgaaaggaataagaccaattcgtatgaacgatgccgaaaacttaggatgaaaatggtccaaaacggtattgcttttttattatttctacggaaacggttgattttttttcatatttataaacttaactcttcagtatcagctttaatattgtgacgttgacagaaattagaaaactaaaattttaaaagataatagtcgatagagatattatcattatattacttttctgtaaacaatatccgtacagtcgataaagaaattatccgtatggttggaaaatttctataccattttcacccccacccaaaagggtagagaactgggattttgcaagcacaatcatctggttcatgttcatacatattaaacaaattctgcctatcttaatcaacgccttttttttgcccaaatgaattgtccctgtcaactaaaatctggtaaattaataagtgctctgaaatattgcagcttactattcatcatttatagaaaagaagtaggactagcatttagtctcgtcatgcgggtcaatgaatttgggcttaatttgatctttgaacacatgggaccgagttgaatcttcagagaaagagaaacaagaatatatagcagttggaaaaatacggaggactaattcgtcagtcaagatcgttcttctgaacatggacttttttttaattaatatgctgttagttaatttggtagcagccggcgttgatcctctgaacaaattaacaaactgaacttcttaggattcctggaaaggagaaacgaaaaaaaaaaaagaaaaggcaaaagcaccatgcggtttcagttgatctgtcgctgttcttgaggtacacgtttgcatatatgttgtggtgtcagattattttattaaattaagaggaccacaaaagttaagaacccttactaactgctgctctctccatctaaaatactgttagctcgaagcttgttccacaaagaagctctctctaagatgggtttcactactttctaataatatttcaatttattttattattttagttatcgaatcaaaaggtatttcacccttctctttgttttcttctcctctactccatccattaaaaaaataactaacctcgtattagaaactatatccagatgtcacattctagtacgagattaattttttttctatggggagtacgtttcttctccgcattaacgaaagtcatgatagtcttttagtctcttatgtaatttaccttataactagctaaaacaacggtattttagagacggagagaatttagataacaaccttctcttttttttcttttgcttccatttgcttaccaggattgttgctgttgattattagctagctctctcctatttttgtgtgtttcgtagcaaacaatgcttgcctgatatgtgtgcatcagtacatgtgtggagcacatcattttcacttaattaatcatagatgtatgctatacttacagtatatattggtgcatgatgcatgtgcgtgtttactgtatttaagacaatcaatgaataatagctagatcataattgtgtgactgttgctcgaataactttcgtcctcgatcgactcatctaaaagaggcaagccttttgcaagacaccatagcccatttgtttcggttcatcttaatttttaacttcctccttcctataatatagcaatctaaaatcagatagtacgtatcttgctgctaagaatctggcttgattcgtaatactagattacgtcatatccaatcctatgttgctatattatgggaagtagggagtacttctttataattatatatgtacattttggtcagtctaatttccgttccttagtacatacaattagttcaaaatcgactattatgtttcagaaaaaaaaaatctatggtgtatttggcaaaactgaaagtaactatctctttgtgtggaaatgtatcaacctttttgaaccaaatcttcaaccttttgcaatcaaactatacaaaatacaaccgatgcttcacgttggggcttttctattggcccaagttctcaagatactttgcaactttacttggttagcaagggacaatagagttggcatgtggttttttattagctcacaattagagctaatgatctactccaacattagttttgtacctgtgtactactctacctaccaaccaacatatggccttaatttgcttttggcacaattgactcatgctactcatatatattctaaactatattattattaaggttgaaatcagcaatgacctttgttggtcgctagccatcaaatgaatggaaccttccaatgaagatcaaactggggattctgaatatatccaatgaaaaggatagcaatccatccattgatgcaatgaaggaagaggttagttggtgattatttaactagaggcttaagttaatctatgtacgagtaatccagattaattggtgacagtaacatagaggcttagcatccaaccaactctgattattattaaattacgattcataataatacaacaagagtacgtggtacacctgtaaggcttaggatggatggaatatcatgatctcagcttgcctgttccatgtgagcataattcctccacccaactacattcatgcacatattatatgtgtgcttgagaaatacttcaaaaaaatattagctagggctcataaacatggagctcacttgatccttttttctacagagaagaacattaatcagctacaggatggctcgatctggtggcagatcctatagttgtggacccataaaaattctagagcacaagcaaacttaactatatatagtatatttgctataaagtttttattttattttctttaactacatagaattttaatgaattattcgtcgacgagcctggatggccacccaggttcaccgggtgggtgtcgatggaagagccacctcctgagcaccatggttagctgctaaaaaccgctatggaaaattgtacatagcaagtaaaactttcatgcaatactcaatctttgagtaatttttagaaaaactacagacattttgactaaactatcacaaaaatatagaattcaagacggtgtatcatagaacggtagatttagcatcaaaattatcatgaaactacatatttaagtgaagcatcacaaaactataaacttaatactaaatttatcattaaactatatatttaagtggagcatggcaaaattataggatcaatttatcataaaaaatgcaatgtttataaaa

SEQ ID NO: 16438 - DNA, 475 bp, Oryza sativa
ttcatcacagattcacatctcacacaaaaatacatcacagattcacatctcaaaaaaaaaagaaaaaaaatccggccggcagccactgccgcctcccctcctcccctccgcgccggccggccagcgccgcgccggttcccgccgagcggccgcccaccgcagccgccgcctccgcgcggcctcccgcgccgccgcgccggccgcccaccgccgccgccgcacggccccccgtgctgccgcgccggccgccatgtaggccgcctccgcgccgtcccgtgcgtcgccgcctccgcgccggccgcctgcactgtggtgaaggaaaaaaggaaggagaggaggggagttagagataaggaaagagataagaagttagagaggaaaaaaagagatagagggaggagtttgttgtgtggacgagaaaagaggatcggtactatggattatatagtgtgttttgatttttattcccggttag

SEQ ID NO: 16439 - DNA, 283 bp, Oryza sativa
cgcgcgggggcggagccagtggcgggtggcggagggggcccaaggacgacggcggccggcgacggaggcggaggccgaccgggcgagcggggacgcacggtgggcggcgggctcctcctcctcgtcataggcgcgaggtggccgccggcgcgcgggggcagcggctcctcgcgtcgccgccgcctctcctcgtccgccgccgcgggtgggctcgcggcacgctctccaagccccttgcacgcgcgcacgcatgagggcggcaagaaggaggtcgttcgagcca

SEQ ID NO: 16440 - DNA, 6321 bp, Oryza sativa
  unsure (1)..(6321): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattactgttatgatgccaatatctacgatcatatcgaaagcttaattacggagtttcttaggacattattactgatcaacagaaggagatctcgcataattggagttgacaacactcaagagataaattaagagaaacctcagaaagagagaatatatataacagagagaaaagctcaacaatttgtatcatgagcagctaattaattaatcgattcacctcatataggaaattgaattttttaaaaaaacttatttggcaaagttgtaaggggggtttcattcatcctctccttaatcactagtggccatgcatgcatgtccctagctacccttttttcctgatctagtgcatgcatgcaattaagatgcgacgcctaattaattacgattgatcattaattaacaacaaatattaatctcagcttcttctctaacaacatatccattggataacactatcgatccatctccggctcgccgccgccggcgacggcggctacacgccgacgccgaggaagtcgaagtacggcacgcccttccgcttgtcgccgccgccgtcgacgtcgccgtggttctcatggccgccggcatccatcagttccagcgtctctctcatgggagtggaggagaaggtgatggtggacacaggctgcgccgccgccgccatggacgtcgtcgccggcagcagcgtaccatagctcgtaccgttaaacgacttgatcaagaacggcgccgccgccggagaagaagaagacgacgacgacctgttgatcatgccgaagccgaagcatagcgagctattgcgcgcgcctgatgacgcaccgccgccgctgaagtcgagctggctggcgtaggaggagaacggcggcgggtgggcggcggcggcggcggcgcgggcgaggaggcgggagcgctcgcgggagcggcgggcgcggacgacgtgccagtggttcttgacggcgttgtcggtgcggccggggaagtggcgggcgatgagggcccacttgttgccgtggtggcggtgcgccgccagcagccgctcctcctcctcctccgtgaagggccgcttgttgatccgcgggtccagctggttgaaccaccggagacgacagctcttccctgcagccaaatatatttattacaatttattattattattctccaattaaattcagcacagttattagtatttattattactgctattactagtagtttttttaatatataacgctgatgattttttatatgtgtgatcatttgttttattaaaaagttaaacttgatttattattataggttctttaagcatttagtccgaaaatgtttgtttaagcgcgagttatgatttttcatgtttgtataaaaattacattgtttttcattttaatcgagcacaattatttattattatactacctcccttcgttttttaatatatagcgctagtgatatttttatatgtttgatcatttgtgtttatcagtttttttattataactcattaaaggtcctttgagcattcagtcggaaaaaaattaaagtttgtttaagcatgcgatatgctttttaatatgtttgtataaaagttttgaataaaacgaatgattaaacatctattaaaaggtgaatagcgtcttatattaaaaaagataataactaattggtcaataataataataataataataataataataataataataataataataataataataatttgtttttacaataattaacaggtgataaagaaataaatatgttgactctgcttggagaatcacatagcaatgtttgcaaatgataaatatatggtcaacttggcttatattctgatggcatggtggagattaattagggaaaagcatgtgtacgtgtaggtgatcaactcttgacacacacatgcatgcatggttgggtcgtatgaactaccgagcgcatgctcatgctcatgcatgcaagcgtgttcatttcttctttttattatgttgttttttgttatttaattttttactactatgtatttaattaactgttgttaattttcaaatcaataaattaatagtatagttaaaaaaaatctctgaaagacgttttgggttaactaatttgattttgaagatggaaatgaaacaaacggacatcataattccaaacgtgacgaagtttgttctagtatccctggacatgcataaccagtttgataataacattacttataaatcgatgaaagaggatcccaaaacaaggaaagaggaatcacaacaaagataagtaataagcttgatcggaaaattgaaacagctagaatacatgcaaaacttccaacattaattagtaattcagattagacagacgatcaaattaaatggccagctggcctttagtaattactggaaaatattatccttttgataaaatatggttgcggtcttttttgggagtagtataaatggaagaaattaaccctcagctctaattaaccagacaactgtattcctctatctccaagataaatacgaaaaataattaattagaaaaactgaagcgctcgctcataaatatatacaagattaatacaaagaaccgtatggggagcatggctaatttctttcaaaaggttagattaaagtatatgcatcacagaaattttgcttacaaactaacacacaagcatgattggaggcaaatcaagaaaactatttttttgcacaactctctccgattaaatgaacaaattaacaacaattaatacacccacaaaaaataacatatgccaaccatagcatccaagatttcgatccgattcaaaccaaacaggcatgtacatatgcccccaaaattttgaacacaaaattaaatataatccccatctaccaatttctagacaaaagaaatataaatcctcatcttctctccatgagaaagaaccaaagaacaacgaaccaaataaatctaggtagatgaactagacctatagcattaatttctttgcaactatatatctagcaccagaaatgaaacaaactaatcaacaccatcaaagaaaaattaaccatcaccaaattaagagataaaaaaaatcaaaatcaatcaacacacaactatagtttaaccaacaacaccaacctgatctgccctccagcttctcggcgatggagttccagttctgagggccgtacttctccaccagctgccggagcttctcgtcttccccgggccgccagtggcctctcgggcacgccgacgacgacgacgacgccggcttcccggcgccgtccgacgtgttcgtcgtcgacgacgacgccatgatccttcacctagctagagatcgaatcgatcgagtagaaatcaagcaaaacttgactataacttgctagctagctatcttgcatatctatctttgtttttcagatcccaaaatgattttctcttgataagtgagaggagaggaggagagaggggatttttcttgggctaattattagctagcttaagtaagtagaattagaggggaaatgggagattgagtgagggagaaggggtatgggtagtgttaggatacccatacccatatatatatacaagagagagacacacacatgtttggggtagctagttagggtttggatgataggtccctctttagtttagtttagcatgacaagaaggtttgggcagcttaattgcaccctaatcaaaataactagcatataattgtatggcactacctatatctctttctttctaatctacattctatatataagtgtatgtatgtgtgtgtgtgttgttaattaagtatatctatatatatcgctctcaccaacttggattacctgtttggctattcgctgaagaccactgctctcacagctcccatcaaacacaaaccaatcccttgattacttctgccttgtacttcctctctaacttctccaacaatattctctctctatgcatgcagcaggagacatcatcatcgaaatattgttaattaacaacaaattaattaaagatgttatctaaccatgctcgtgtgttgtttacgtctttgtgcatatagggagaaaacgaaatcgtctctccgtggacatgtataagtaatgatcattggtaatatgtctgaaagaaacatttctacgcatcagattttcttattttatatatatatatatatatatatatatatatatatatatatatatatatatatatatatatatatatatataagatgaaatgtatggtcagtgatcaacatatatatatggcacgcaaatttaaaatattcatctgttgataaaattttacactacaaatgtatgcatatatataaatctatatatcacattacaaacagaaggacacaaggaggtgtatattaattgcaattattatttcaatgcaaatgtactttgatcttacctctgtgcaactgcgtgggaaattctattagattagttaaatattactcaaaactatacctccaaatgaacctaagtctatatatataaatctgcgtaactgcacaggaaattcaacaagattaattaattaattgttgatcagatttgtaaagttttttttacctcgctgcagcttttgttttttcctttttctacctcctggcataggcttgtctggacgagtgccttgcataacaaaaaaaactcttttccttctaatatattggcatgcaatcattttgcgtgttcgcggaaagattttcaatttttttagatcattcttaccctgtgtactttcaaatacaatcagtctcttcatttgcaaagatatatcaaatagaaacaagacctatatactttcaaatgaacttcaattagctctccacgattaaattgtgcgggacggattgcgacaacctatgttcgattaattgttggtactctcacacaacttgtaaagctctaaatacatgcttattgtccatgtcaaaaaaaaacatgcttattgcattgtatatatactgcaaatgcaaatcgatgatcatctcttgaattcgtcgcaaaagtttgttatggtcaacatctatgagcccatacattcccacaggaggtaaaccgttcgagctctgccattacagccacccaacagaagcagaaaccctagtaatggccaatgaggcagcgtacacagaggggtggttggcttggctgcatatacatatcctgatcgatcgaaaagcccaaatttgcagtcttttcagcatgggatgcaccgcagaaacaagggatgcattcaatcttccatgctgctctgttcattgtgtttgggagatttggagcaacacatgcatgtacaagggatgtgatcagagagcagttagttggcagtgtgatatatgtgtatatttatgcactggctgcattgtaattgatgagcttgatgtacacatgtaactacatgtgtgtgtctatatatatatatcgtgtatatataccctttctcgtggtttcataaaatctctctataatttttttaaaaaataagtatataataacatatgtactgcacaaaagatataccatttaatttcatttttatgagcttaatatagggtcattttgaggttatttaattgcttgagcatgccctctttgtataatttgcatttaatttgtctgcagctgttctcaacattgtcatccaaggtggtaactgattgatctatatcatgggattccatacttgattcccaaacagatgtcctcataataattcttgtcactttgtttagttttagagaggcatgcacatgtttatatgcaaccaaaaacaggaagctgtttaggctaagtaatgagccacaaccaaaagtctgttccaaaaggacaagtagggcccaggaacaatggacaaaatctacaagacaaaagcaaatggaggaaatttgatgcaaccaatattcaaaaaatacaagaaatctaaatttgcagtatgtatacataatccgtgtttcttcattttcattctgtaaaaagtaattttgctagctcttgctaaatagaccttcgaaggaaat

SEQ ID NO: 16441 - DNA, 700 bp, Oryza sativa
ccaccaaccggaaaaaaaatattttttagctacatgtgccataaacaagacatatttttttaaagattatgggaaagacagattattaaaaaaatttagttgtgtacacagaaatcaacatgtgccagctattattctatcaacaacttgtactaggcaaaacattacttcttattaaaaagagactcactgcaatcccaaagaataattatttaccaacttcatcagacccaagcatagagcaaataaaatatgacaatggagaacacagaaaatatttcagttttgctaaaaaaacagtaaatatttcagtggatgcatacttacttcaaggttcggttggtgcagagcttagattaatctgttgttgactatctactgtgtcttctcttctcttggatttcttcacctcttctttttggagaggcagcatgctgcagcctgcagaccagcgagaccttctcttccctcgtacgtgctgcctcctcctggatttgcttggggacctaagggattgcacaagaaacctgctactagttgttgatttggattttgcctatacgcttagtggatgggaggggatatggggatggtgaagagaggatttaggggtacagatcgagagtgatttttgggtggaaagtttagggatttgatggaggggagctgcgggaagcagggacaacctcaactgatggca

SEQ ID NO: 16442 - DNA, 15490 bp, Oryza sativa
ttcctggaatgatccggtaggggtatttttatttcccttggcctccccacacactagtagggaaacaattaaacggtagggaacatggagatttttagtagtgtacaaaatcagtgatgatagtgtcaataacaatctcatctcgcagcatcttctcaatgcacagaggagcctatcagacttggtaccatagtatatatattttggaggcccagtgcgagcccgcactgccccagggccggctctggtaacatactcagcatacacagcatacagctagcactactacagtcctcgagatcgagatggatcatcatcgtcgaataattaatcaaatcatgagatattctcgcaatctggttcggttgacctgatcttgcccaatcacaaagtttattattgagcacatcacgacaagtgagttgactcaaaaactatattttacatacatacacgcgattatcaaaagaacaagtatttttgcaactagttgcttgtcctccttttcttaattattcatattaattatgtccatccaaacaaggtatcatactcatatatatcttatatattcttcttagaagaataattaaggagcatctttaattttcaatttgtagttgacctcgtactaatgtgtacacctggactgttaggggtgtgtatacgtacaaccaactcaaagtagtccatttgaagtctaccgatcgaggaagatgtgtgtacaaaaagtcgtgtcaatttgtgcatatcaagctacaccttcgagtttaagccactataattaagctaattatttagttactttttgttaagcgagacagctaaatgattattcgatctctagcaacaagtggcacagttcctgatattttatatggacactttcaaagaactagcaacaggggactcgcatacatcgatgttgtactatatagctcggagcataatcgaaaaaaaaaacatatagaaggatatatatcactattccattttttgcttgaataaatttcaataaaaaagaacacttttagtagcgaaccatttgagaaatcaggaaatatacttagtaacaaatatgagttaccggacatgcatatggataaaatggtttagaaagttctggacgtattttcggaaatgaaaagtgtcggttggatttttttcaaaaagttttaaaaacgaaaacgaatttggatttttttttcttggaatcggaaataaattgtttttttatatatatagctgattagtttcagctttctctgctttagatgttcagacttatactaaatattgaggtggttagttgaatgaagatattttttaatagttcaatgctttagatctgtttttctttttcctaccgactatttttgttttagttcaatgctttagttcaatgcttttattagaccacatcatactacttacaattatagatgaatatagtttttgcttattggagttctcacaaaaagtaaagtgtaaaactagttgtattattattaattgataaaataatagaaatatcaatttattgttttagaaatatcgatttattgtttgaaaagctcatttagagttgttttcatatttcgataaatatttgttatcttattcgctacgtatttgtctagtcaatatattcaatgccatcttcataactgggtttttccaatttcgattctgattccaataaaaatatatggaaatggaaatagttgagatggtttccgcatgttttcaagctgttttcatcgcaagacctgcaaacgttttacattacaaataaggtttttgtttttcctatttaattgtatataaacccatgttctaagaaacaaactagtagaattaaacaaaatgtttctcaataaaaaaaaactaaaagcaaagtatgcacaatgaattaaattatgtatagagcttgattttaaaatgatctatatattcttgtcattttctttctcggttcttcaccatcactcgttttagctttcttggaggatgtatatacgcacagagagtcgacggctattacattagaaagatgatatacttctaattttctcttttcactctgcaacacatatatatgcagaaatacacatcaataagcactaataatatgacgtctacaatcacccgttactctcgcattataccgtcactagacatcgatctgtacccatcattatgaagccgaagctgcattattctaactatatatccacttgcatatatattattcctttaaattcctctccccctctctccttttgagtttttgcccccaaaccaccacagtacaagtattgatctcttgtgattgggttggcaaattgcaaccccactagctagccatatagccaaaagccaacccttttttaattattggctcaactaattggcttgtgcactacacacacatgctgctgctgtccatatgcatgtatacaacgtgcctaaatgtgataaaccaatggtcctagctgcagcatatgcaacttgatatatatgatgctggtcggccgattcagattgttggcatgcatcaattagcacatagatcgaccaaagcctaactgtaaattaaaaattctagatgcttcttaatttcgttggttgctttcttggatccacgtcaacttgatcgatcgatcgatatcatctactccctcaatcataaaatccgatatgctatttgatcaacaatatctataaaagtaaaatatttaaataaaaagagttgctcattatgatagtttgtttaacaataaatctagtaatatcaattatacattattaatcttttttatttttttatatgtcactatttaaatatgcttatattttggtacgtacggagggagtatgtatgcatatgcatgtgctgtttggactagctatgtttgatacggacttttagggctttaaattgtggccggcggcggcgcgtggttttggtgatgatggccggtggccgccgacgtatacgccgccgccggcagcaggccggccggacggacgtttgaacatgtgcatccaacaatgttagtcctggtgtgtctatcacctctctctgccattttttttcttatgtgataactaatgtgcggttagtactctccctccatttaaaagtttaaaacattttcttaaaaaaaatcatcaaaaccaaagagaaattaattcatcccgcgtgtaacgaagaccgagaaatattatatatgcatgcaaccaacaaatattaaaatggttgataggttttctatcaacacaatttaatctagcattgtgaaacaaaaagacaatctcttcgtaagtcttcgatgcgtgaagactacaaatatgatcatcttatttggagaaatcagaaaaataacatatgctcaaagatttctggatgaaaagattatattaaaaatgttattgttgtgattactagctattcggtacgtataaatttttaatggaatctttttaagtactctatatttgttttgagccgttcattagccgttgatccaatggtcgatgttaatttctagagcctcactactgtctctacgaaaacaatctgaacgcgttgatatcatttaatcaaagggttcaaatctatttatactaccaccccagttagcggtagtagaaacatggaggggcattattgtaaaaaaaaaggcgcggaagggtataatcatcactttgcagtgattaaacttttccctctcttttttggctttccgatgaaatatgagcgatgccagcgcaatgaatgatcatagattcctttcaaaaaaatgaatgatcgtagatcgatttagccgagaaaacaaacataaataacaaaataactcctaatcatgtaatagtaaattgctaattttccaataataatattggtagtataatactaccagtagaaagcaccggagcatcgctctaatttctatatactaccatgttaacttgatcatctatctatgtagtgtcatgcatgtaccatatgcatcgatttgcatgctgttggagtagataagtttataaaataaataaggtttttaagttttctggtagtaaccgccggagcacacactactatcgaaatgattttagcagacgagccctcctccaactttcaggcagacagtaacatctccacctgcggtaatattgatcctaaaagaagacaagacccatatgcgaaatcaattttcacagcattttcacaaatgggcctgttaagagacgcacatgtcaccaggtcaactaccctttcccttggatgaaaattacgtaagacttccgtccttcacaatctggaaagaccccaccttctcaattgtcacgtgtccagctgttcgcacggatcttgaaacacccatcttctaccagtgcccaaaatttccccttatctttcctctccactccccatctttcccttcctttcttctccttagctggagccccatctctagcacgaacacatgctccaccgctgcatcctcttgctcctcggatggagcatatctgacacgagaacgcgctccctcgcctcctcctcttcctctttcctgttgcagcgcgggatgcaatgtggtgctagtcgagactatgttcctgacaagggagtgtggtaagtttgccatccggtgccctgcagttagacgagtttgtcgtcacgtgacatagacttcagctaaaatttggacctcgagctatgaagaaaaagaggaagggaggtagtgagagtggacatgagagaggggaaatagttgggtgagctctccatcccctgcgcgtggaacgtattccaagctagagatagtgctcccctgccctagtcgatgagaagcagagaaagtatgggggagaggggaggggaaaataattaagcacttgagctagaggcagaagatgggtgctttaagattcgtgcggacacgtggtagtaaataagtgaagtctttccaaacgtgggaaggacagagttcctgtataattttcttcccttccctaaaaaatctaagtgctattctcgtctcctcatcctcttctcaactcatcctctcctctcctctaaaccccccactccacctcccaccacttcacagcctaggcagcgacattacttcgagcgggcgctccaagaggtggtgaaggcggcagctgcgttaggcgctctgggaggtggcgaaggggtggccggatccggtaactatgccctcatgcgggcactggagcggtggcaaaggtttagttgaggctcgcagtggcccgatttatttatctggcatataaatttaaccttctatatcacctgatttatttatcatatttaacctttacccattatactgtgcacattaccattgatatagcataatagaaatatgactaaccatagatcaaaagtaatggatgacatacatgtttatcatacactaagacatctgtgcatattgtaaaaaagaaatattgtttgagattctttttgcaataaattgcagctggcagctgagcaatcaaatctgctattttcctctactatatatttgatgataaacccattattcaagttctaatcatgcatactagcatgtgtgtttttggaagtccctatcaatgtaaaggacggatcatttaccttagtttatccttcatatatgtttcttacaggtagattagtttgaaatgcacatttaaaattgattagatttttttcagttaacacgtccctcaatcatacttttaaaattagaagcccaaaatgaattggttttgcgctctttatgtgaaagttaagataacttcatctttcgtagaatattatctgaagtggaattgcaaccaaagatagtcctcttacatatatgaggatcttatggataggaagaatagatcatagaggatctgatcacaatataaaaatattttgctgccaattggttattgtttggccatctggtattactccttccgtctcttaatataaaaaattttagaggaatataacacatcctagtactataaacatggatagaaatttgtccagattcatagtatgtgtcagatctctttaaaatcccttatattttgaaatttagaacggagtgagtatatatatactccatccgtcccaaaatatatcggattttgggtgaatgtgacatgtccggattcatagtcctgaatatgtcacatccacctaaaatcccttatattttggaacagaaggagtagatccttcattgcaaagctagtacttctagctactaactatattaagaaatgtcacgtctggttaatttatttgtggttatgcgtgcaactaatcacaactagcctgtgatgaaaggaaagttgatgtgcaatgtgatggatgcttctgaacgaagaaatatgatgatttgcaacctcatatatattttatagcttgcagcaagacacttgtaagattcatgaaggagcacacaattttctttatacaaaaatgaacctcaatcatggtgattaccaaagaaaacatcctgcaaattttctttattaattgggccaactatagcctgtgggttttgattggattttggaattatagggatataataagtgggatatataggggactcgaaaataaacagatactttgagagaagcagaaaaaagagcaaattaaccttccatcttatcctagtagggtatcttcccccattctaataagcaaaactcatggtttgtcatctctttaaagtggcatttcgatattgtccacccccacgtctaaatgatatgtagatcccatatatcatacatatataagtggttaattatttcatttaatttggaatcttggatgaactacgagcaggatgtatatggacgcgaggtgggcgattacatgcctaaattttactgtttaacccaacccaatgtattctagcatgttttaggatctccttatttcttttttttttcaacattctttcattccccatcattgatttagctagaacatgattgttttctcgacaccaacaagtgttctatgttaatcactaccatctcaaagaactactcactagtggagaagtgctttttagtcccgattcgtaacccctatatagttccggttttcaaaccaggactaccaatcaccaaccgggactaaagagagggatctttagtcccggttgttgttattaaccgggactaaagagagggtagcggcagtccagctggtcctttttttttcttttttattttctcacgaatcaagtggtatgcatatcgtgaaatcaaaccccaaatccacatcacaaatccacagcacgattcacagattcatcacaaatacatcacaaattcattcacaatatctattcacatattcattcataacatcacaaatatattcacaatattggttcacaggttcattgacaacatgacagactcattcaaaacatcacagattcattcacaatatcgattcatagattcattcacaaatcaaaacattcaaaccacaaatcataaaaaaactcaaaaaaattgtctcaccagccggcctcccatcccgccgcaggccggccacccatcctgtcgcttcccctccggccggatctgggggaggggagggcgaggccgccggcgaccagcctccgtcccgttggcccgcgccgggccgccaccggccggcctccatcccgctggcccacgcccggcctccatcccgccgccagcccgcgcccggcctccatcccgccgctggctgcctctgcaagggaaggaaggggaggggaggaggaaagggggtgagagaagagcaaggggaggatggaaggagaaggatggagaggatggagataaggaaggagaagaaaaagagataaggatgggagatggagagagagagaggttgcgcgtgcatgcacaggatggagagagagagaagcatgcgcggtggacgtttttcttcccaaccggaactagaaatagatctttagtttcagttggtgttaccaaccaggactagaaatagatctttagtcccggttgagaacaccaaccgggactaaagataaaaaagtagctctaaccttttgaaccaggactttagtcccgatttttattgcaatcgagactattgtggattttggccgaccgaccaaagatggtttctccaccagtgactgtaagtcatgagaatatgagaatgatgggaacgtgtgttccatgcattgaagatttcatcgttccacttactaagaaaatttaaatgactacatcaagacataattattcttcctagtttttacatagaaatgtttgtgtctttgggagacctcatctaatgccaatacactttgtaagattttagggatgatgataaattatggtgtatggtgggggctaagcgtcttattagcttttggctataaattaagtctatttggtcctaatcgtacactgctggagaaactatctttggtcggtcgaccaaattccacaatagtcctggttctattaaaaaccagggctaaaaacgatttttagtcccggttaaaaaaaattggactaaagatgatctttagtcccggttcatcccctgtcaaaggcatatcagggggccaaggatctttagtcccgattgatactaccaaccgggactaaagactaccactttagtcccggttgaaagtaccaaccggaagtaaagatcatctagatctttagtaaaattgaacgcgtagtataaaatccctatcactcatcctctcaactcacacagatcgaatctcttccccttctcctccttccctctcacacagatctcaatcccccttctcctcctctcctcatccccttcttctcctctcctcatcccctctcctccccctcctccccttcccatcaggtgggccgacggccggcggggccacgcccggcggcagtcggcggcgtagtgcgcggcggcgggcagcggcggccgtggcgggcggtggcgccgggcggctgcgagcggctttgtgtttttttttataatttgtgattccctgatatgtataaatttgtgatttattgtatggatctgtgatgtatttgatttgtgtgtaattttttagatctatgatgtatttgatttgtgtgtaactttaagatttgtgatgcggatttggtgatatgaatttgggatgttactctgatttgggatttatggtttgatttggggatttgcatgccacttgattcgggagaaaataaaaaggaaaaaaaaaaagaaaaaagaaccatctggtactgccgctattctctatttactcccgattagtaacaacaaccgggactaaagatccctctctttagtcccggttggtgttaccagttatttcatccgggactaaagataacgatttttagtcccggattgctactcccggttgaaaaaccgggattaaagggggttaccaactgggagaaaagatggtttctccaccggtggtagtttccttttcttctagtttgttgtgtttaaccatggcccttaaaggtttgtacgagtctttctagacttctctcttcttcttaattaatatattgatgtacaacattcttgcgcatttgagaaaacttagacatatcaccaccaccatcatcaactagtgagcttagttgatatagctctagttatcattggtcatgcaaaattcttgcatgtttggtagtatggtatagctaataagctaaatatatgtctcagcatatgcatgctactgatctttgttgatcaatggatcaaattgatgcttcaaataattgattggagtgcttatcattggtttaacagttaaaagagcaatatggagggaaatggagtaaagaaaggtcactcccttttatatggttttttcagatgcactacttctcaagtagttatagtcatgaaactaattaattcgcatgattaggatggtgaaaaaatattccctgaaaaggtcttaatctatacttgtgtgcccagcaagcatgcttgtatatgcttatcgatgattagcagagaagcatctacaaatcggacctggccccatgggaatttctagaaagtgatgcagatcactagccgcctcctaacaacatgatttgtcagctttcctgaagatactataagaccagcgtgccggttggcacgcctgcaatttatagcccgtgtgtattatcatgtgttgtactgttaaattattaatttctacctagcaataggttgcaattttctaaaatactccttctgtcattttagatagatgtgttatatctcagtacaatgaatccgaataaatattatggtatggagggagtataagaaatgacatagtaatgttatttgtcttaactttatttatctagatatttttcagcatagtaggaaaattatcggcgttacttgcttatgtactggtaattacacttattttgccttaattttcaattaagtttgtagaatattgtacttgtttgaatattagacccgcaacttatttggtgcttttaatttcactattaaacggttttattttctttgtcttaactgtatttatgtagatgtttttcgacattgtacgaaaattttcggtattacttgcttccgtacttccgcttatgtactttatattacgcttattttgtattatttttcaattaaatctgtagtagattgtatttgtttgaatattaaacccgtaacttatttggtgcttttaatttcactgttaaacggtttattttctagacaaataggatgttactatcatggagttacttgcctatgttttatttaacatgcagtaattgcttatagggaaaaatatcataggttagaaattataatattttttcacgtttctctcccttccttttttatttactcagtttattattcctccatccagtcataaatatttggccaccaatatcttacgtagcttatatagcatagtttatcaaacaaaaaaaaatatgtacaaggttatatgaaaaggttaactggaaataatgatcaaagttcataaaaataatttttttaaaagattttaagaatcaaataattttttaccggtgggagtattgtttttcctttgttcttttttttcccggaactttcgtatagttctatcttcagatatagattcttgatggtactagtgcacaaaacgtgagaaacgatgtgcttcagttttttaaattcctttcatgctaagacgtatgctttgtgtgcaaggcccaacaatgccaggcccttccatgacgcaagttagcgttcctccgttacttttttttttaaaaaaaaaaacaaactatcgatctatccagatgcaaagcaagtacgcctgctgttattgtgcgtgaagattgattccggtgattaaggacgtgctatgtggcttatctccacggcaattaatttgcatggaattcgtgttataagatatgatatatgcattagcatccattaatccctttgacactcggagctcataggttacccgttaccctagcaagccaaagctaaggttaaatttaaattttaaaacataattttggaatcaattttaaaatattttagcgtagtttcttttttatattggcttttgagggcctgttcactttaatatcattttcaactataccatttttggtaaagttgctaaaaagtctacgtttagttcgttaccaaatttggtcaatacataagaaatcctgctaaaattttggtaatataccatcttgccaaaattttggcattactaaaacttgataaggtttattttaggtacaatctgaataggccctaagtcactaagaacacatataaaattttacctgcaaattaatttttattttttaataggttgttttgttttagtagggaatatgggcaaccgatgagaacctcggttaattaactccaaatagtacgctcaggcgtgtgttaattaatttgtcaattacttttgtcgtcttctctagcatgataggatccaatgtgatcttaactttaatcacatatctaccatgctaatttctttgatttccaatcaatgaagtgaatattgtcaacacatgcactttagtaaagaaacacctaggttgcacttttatttacactacaattacttaagcctctttaagaaaacaaattagaccaaccgtacgtgtgttgctttggtggcttgataggattaacttcccaagaagtatctgatatattgggaccaaccaggagataggattgtccaactgtacaccagcaatgccataaaaaagttgttattatcttttttaaaaaaaaactatattatgattttaggaagagtgaatatataatcagtctaagagcttgaattttttttatcatatataatgtattttcttgtagaacaattttccatctatgatacttttttcatggtttaccttaattgtaagtagctttgctgggaccgcacttcttaataatcttgaggatggaatcaagagggaagtatatatatccatcataatcaactgcagcatcatataataaattcctcagagaatctaaagtagttgcacatatctttctttaaactcttctctttttgcaattaaatatagacaattctgagactaaaacccctagttttttggctcagggacaaagttaggtacattagttgggggtggcaaaaaattaagctataaatttatcaacaagttgcttggagataaagatgagtaggtgcatgttgaggctgagcagttttcatgaaaagtacagcattttttatttattgtttgcagacaactttggatagtgaccctgcaaattagtaccacgaacttgatcactttaagcccatcgaaagaaattatttggactattctttgtgagtttgtaggcctagccgtgtataatttgtctacttttggtccaactgtggcccaatccctatttgattttaaggagatttttttttctgttttcatttagatactatttgataggtttgggcagtttgtgcaaccagaatatggaatatgatacactcttccacatcaattttattatgtctatgtggtgttacttttagcttggtaataaaaggttgagtatgtggattcagcattctcattttggtagttttttcccaagctgttttcccattttcagtttattcagttctcaagctttgagaaccttgtgaaacttgtaataatttagcgggtttctactagaaaaacaggtcgtacaagacataaataggattgaagaaaaaacaggttttataactaaatcagaacaatagatcgcttatcttggcatgatcagcccagctgcctgtcagaaaggctcgcgtctttgtgagataactgtaacctgtaactttgttaactcaccaagaagctgaagtcattttatccgaaccaaacgagctgcagtagtaactacatcttgtaaaagtgaattcatgagcacttaaaatcttgcattattttcacacagatagccttcattgtaatgacagtatggaagtcccttatgatgcagggtttcattgtaacgatcgaactctacggcagcaacagaaataaactaatgtgcagcatgcaggccaacctgaaaatttcaatcaagaaaagtctccaccacactggttgaaaccagatggacaggtcaacctgaatatttcaagaaaaatatccaccacaatggctgaaatctttcggtaaaatcaagaaagaatgccagttttcttgccagtcgaatctcgcgacaaagcctacgaaaacattcctgatactttttccactactaaattatggcagcttatacaaagtcaagtaaggctacaaagagagagaatccttaggcaaagaaagatatcagcacatatgcttgctaagggtggaaggcggaggggatgataaattacatatcggatgtcatctgacatggaaaaaaagggagggaaaacttcttttccgggtaaggagtaacaccgtaccatcaaggatggtggcagatgcaaggcaaggctctaatccttttaactctatctttcagtaagacaactgaagcaggcagcaaaatgccatagttgcacaatacacaagcagctaaacgaacagttacaacatacagttgacagggctcagatgctttgctgtcgcgaatgattcctttttccatgacagcattattgcaaagaccaaatgctttgacacagttcgaggtgtcggcactgttacttgtgctccataagcaatgaacccagtgagagcagccacgtcgtcatatcaaacttgtaatgttctatctttattgagatggtttccagtcatactgaaggttattgaagctgtttgctgctctaagtccactcaacagttggtttcctaagtcatgttgctgctgctgctgctgctgctgttgctgttgatgttgatgttgatgttgatgttgatgttgctgttgctgctgtagttggcccaactgtgataggtcatgtgcactgtgattcattcccatcctaccactaattgccatcgcattgttcgctattgcagttctcaatccactagctgcatgatttggaccaagcccacccatggccccaaaccccattcctcccattcctgagttatttgtaacagcattaccaactaaacaattaactccgttaacactagatgtaagtccgttcggtcttttcatgtcattcccaagctggccaacaccattcatctgcggtgacatcatcaaatcttgcaatattctctgaaccgagctttgggactcatttggatcaggctcctgaggtcgagtagcaggtggctgcattggcggtaggtttgatgatgcggttggggagctgagttggtttgtgttctgaggggcaggcatcatgttgttattggatgttgttggcactggtgaaggaaaagaggtagatggagttgactgcagtgaggttgtcgagttcaccttgggaattgcagcactgtttccactggtatatggaccattagcactgctcattggatgatcttgtctagagttcattgaaccttggaggagcccaacaacggacggtgaaggtgcagacgttgagggtgcacagctgagagaattatttgatgtcacatctgcatttgcagaggcagaagcctgcacaccagtcatgggagcagcattttgaccactctggtttgaactctgcgggatagattgctgttcttcaggctgttgctgctgtgactgttgagggtttacccctcctgatgaagtcctccgaggaaagctatgcaaactagctgaaacaattaatagtagtagatgttaaatatgcacaaaacaagtggtaacattaataaggctgtaaaatacagttaacactatagcaacagactaccatgttctttggctaggagtaaaaatcagcaaggg

SEQ ID NO: 16443 - DNA, 9430 bp, Oryza sativa
tgtgtaatccgagtctccaagatacctaccactaaaacactatcttctgtagcaacagcattttaatgtaattattccgctgttccaaattcaccatgatacagtcacatccccaatgtaataattggatcgtgtttaattagatgtgttccatcagatgtaccagatgagcaaatcatgcatactatattcttgtacttcaaaaagatctcagaaatggattaaggtccccttttatggaaactcttaagtatacataaattatccatctcccctatcatagtaaaagaacacacggtgctagaacagtaagaataaccatacacccatagatccagaatgctttacgcttatagtttttctgtacacacatcccaacatcatctaaacatccacatcgtaggcctgagatgagcctggatgtgaataaatggtcagtgttcccctggaagcttaacctttttggaggatagtcagtgagctaaactaaaccaaaaacactgggtagcaaaccttcaaaaaatcagtggttatacccaccactttgtttcgtgcaactccttcgcatactacagtggcattgaaagaagcatgtttttaaaaacatctcattctgtagcctcaactatatattttaataaatatttcacccatatgggtcaacgtacatgtcaaacatgcagaatatgtaacacaaaatatgttgattctacatattacgctgtagtctttggataatgctgcttatactgtgacaataacttgccttctaactagaccactgtaggtgctcctcaatagttgtaactttcttatcaggcataatttgcctgagatccaattagaaaagaaacaaatgagatttccacggaacatttcaaacaagtaaaataccatctactacatgaataaacgatgtatgcatgtagccatgaaggaccttctatccagtttattgcttgatttctaaaaagtttcaagtcattcaagatgttgaggcaaatgtgcttgtagcatggtggtaaatgccttccagtgagaatctaccaaccagggttcaaatcctggtctcgcacaaaaaaggtgacttgtgcatgtaattcagtaattcaatagtgtactacaagcaggactgcctacaccacagagtacagtacataactaccatgacatgttgaactcaaccagtggaccagaataccacgtatttaaggctcatgccattcgcacagcactgtgtcttctggcactttgggggcacttggacactaggcaggtgcctagtcagcatctaacagtagttatattcagtgaaatccatcatataccaactaaagccagtaaaaagaacaatgaaaaaggaaaaaatggcccactaaacctatcctagagaccaggtctctgtttagactttagacccatcctcaaagcactaacatacactaaaattaactacttgtacatggcgattatgccacctgtcatgttgaggatagtctaaacacagacttagtctcagagaactatttttgcacctactcagtgcagcctaatactagtagtaacgacttgacaaccatgccttaagcacaatatcaccccacctcaaaagaggtaataaataattctaaccggggtgcaatcctaacaccagttgtaatgctgtagagaccaatctgcaagtggacctgctaatgagttgaagccactccactgccgccaagccgaccctaaggatgatcaaccaatccaacccaatccatcactatgtggcctacatcctgctgatatggtatggttgtcaaaggccatatgctaaccaaatcaaccacaacagccataggatctaaatggttaggccatgaatagtatttaactatttttacagcttggctggttggccctaaactcgaaggatgacacagtggctacgtcccattttgcaaggcagttcatgctagtattgagttaaaaaagtatttacatgagtagacacgctagcttctttgctaataagatagatttcagaagaacacaaaaatatgcatgtaggaacaaggtggataaagcattaatgattttgcaacacactgaagatggaaagtattgtgtgcatcagagacagtctccttacgagttgcaattattctgcatgtcttgagttgacaaatttgtcgaattttgaacagcactctggtatttttgcacaactgcgcccagttgactaacctgcatagaacaccgagggttccaaaatatattaaaccctttcccgttttgcccaaaattcagaatatcaaaatgagacatctgacttgaataaaaatatgcatacagtgaaagggctaaatacctgtgggattattgatctacgtggaataagctcctcgtgacgccttgcacaaaactcccaagaagcgatcttcaataaaaggaaacatgctttagtcaaaaaggcgccatttatcataccagcaactttaaaggaccaccagtgacaaaaaaaaatcaaaaaaaatataataccttgagatcaggattaaaaactatccttagatgtccttcgcgtaccacacgcaactgctcaaagacactttcctggattgctttggtatagtccaaaacaatctgaccagaggcattctgcgattcacgtggcatgtcgacatatagtaattcttccaatgtaccactggcatatttaatttggcataatcgtggtaacacctcaacggtggtctctgttaaggtagtcacgtaagtggatgtaaaaagcagattaacagagaaacatgtgcaaattaaaatgatgcttaccaaagcctcgcccaggcttccgattgcatatctcacaatgccatacatcctacaagggcaaatatagaaatctttaacgaataatttgaaaggaaattaaaaatatgaggcgctacttcacatctgccaattaaaataatagaccagaagcattaatgaaatatatgaaaaacagaatggatattccagatttaaaaaatgacaagtcagcaacggctcatgaaacctgagggaaaactccagtagtttgacgaccacttccatagagagatacacaccacctttttttagcatttggagaaaaatactcattgacaaagtttctccagtactcgatattgttatcctgcatcaaaaggaacaagtagagacacaaaactgtaagcccatggccttcactatacactaaattaattgtttggaaaaagccgaaaacttacctgtggcctgttttgttgatgatacatgtaatgagtcaatctctttgcacaggttcctggctcataaggagccgattttcctggagttctcatgtttagactctgttggcgaagtagctgctgctgttgctgctgctgctgttgttgctgttgtaattggtttctctgcaaaggcagattctttagaatctgttgttgttgctgctgttgttgctgcatttgcaatatccgttgctgttgcaaaaggttcagttgagctgccgcagcagcttgaggattctgctttgtcagctgcagcaaatgttgctgctgctgttgctgttgcaggaatgctgatgggtctgaactctgctgctccatcttcaccgcactcaaactcctcaaagcttgcaactgcggcggctcaattttaacattgctagcattgcgcatcatctgggctgtgctattctggtcaggctgccccatctgcggttccaatttgaccccacctgtgctgccaccattctccaacttcactgtagcctgcggctgctgtggcggttgcggtggcaactgttgttggttgtaagacattggcagttgctgctgatgctgatgctggtgctgcaagtcctgcatagcatccaggtgttgttgttgctgctgatgttgcggtggtggatgcagattatctgaacccagctgattgcccaaactaacttgcgacgatgaagggaacgagagagaatcagaacctcccgcgccaaccaaatcgccagcaccatcaagccctcctctctgctgctggagggtattcattggaagcccaccaccacctggcatcgaccccggaccgagcatatgtcccccattcccaaacggccggttgagcagggaggaaacattggagccacctcccagcaggccattagcaccaaactgcgtgcgcggcgacacgagggacgagaagggcgactgcgaaggaagcatgcctccgccactgcccatcccctgctggccgccgctgagcaggctggagctcgtcctgagcaacgaggccgcgccaaccggctgcccaggacccatcgggttcggcggccccgacggcaccatccttgccggcaatgacaaagtgctccaaacctcccccgcacaaaccgctgcaagatcacgcgcgccttcactcagctcgccatccttccaccgtaagatccaccggaattgagcaagaacaagcggtcatccccctgaaaacaaaccacagattgcaacctcagaacacaaccacgggatctacaccaccattaccagaacaaatctactgtgtcaaactccatcgcccaaaaagccaaccgaaaaccagcaccagcgagcaccaaacccaacctccccctcccgcaacaacaacaccgagcgcaacaaaaccaccaccgaatccaccccgaaaacgaagaaacacgcgcagaaaccatcagcggaattaagcaacgccgagctccccgaacaccccccagatcgcatccctcgcctcccaaccccgcaaacccgcgcaaaatttagcaccagaagcagcagcagcagcagcaacagcaacagcagcaagccaccccacctcacctcacacctcaccaccaccaccaccaacaacaacaacacaagcacaccgccacaaactccacgcactcacctccccgccacgaatccggcgatccggagctcgtccacccgccaaatcgccgctgccgccgcccaccaccggcaccgccacttcggctagggtttagccccgccgccgccgccaactccgccgccgccgccgtgggccaaatttacacaataaaataaaataaaataaaacctcgcgagtttattactcctctcgctttttttcttctctctctctctctctctcgccttcgcgatgggatttggttttctcctctgcggagaggaagagaggaggaggaggaggagagagaaagaagaaaaagaaaacaaaaacaaaaacggaggagagagagagagagagagggaggagaaaatggcgagacgcggacgtcaaaaatatccgctggatttgattaggggaaaggcacggccacgcgggtggcgtacgctgccgctcgctgacgggtggggccaggggttggtggggcccacgtgggtgtgaggggggcgggttggggtttgggtggaggttggggtagggaacggggttgattagagagggggtggtgttggtgttttttttttttttcgttttcgtttgggtgtttttaggtttaatttttttgggggttcttttgggttaatgttttttttgtgtaggggtgaggttttatgtaattaattgattaatttaatttaaatagaagtcaaaagggagtgttgtgctccatgccttgggggtggccaatggtgtggcatcagttgcttgtgtatcctcactcctcctatcagcttcggctcatccacggtgacgatgataatgacgacgacgatgatgatagagttttgcaaggaactggttttgtggttttatagttatattatttgcgtcgtgtgaaatgttggtgtttgtatttttataggatagttgagtgtttttttttaacgatcgacgtgttgtgtaatacgaattaagttttggcgggtattttgaaatgtcctttttggaagtatttatgtttaaagcggttcttaaatgctagtttagcaacaaggatcaatccaaatttggtgaaattgtatatatagataacttagtaatataacgtaggaataattcatccacgtaaacttcaagttgggttattaactgagaatcctattgcacctttcaattctttccctttttattctttttttctatgttgctttagctaacctcagacttttgacccaactagtacttagcttatgtttttcttttcaagcatagacaactgaaagacccaactagtatttatgtaacctcacattcgcttatgttctttttcttgtcaagcataggccgtgtttagttccctgtcaaaaagatttttaagtatacggacacacatttgaagtattaaacatagactaataacaaaacaaattacagattccgcctataaactgagagacgaatttattaagcctaattaatccatcattagcaaatatttactgtagcaccacattgtcaaaccatggcgtaattaggctcaaaagatttgtctcgcgatttacatacaaactgtgcaattgattttttttccgtctatatttaatgctcctatgcatatgtccaaacatttgatgtgacggaatttttggaagtttaaagggaactaaacaccatagacaattgaaagacacaagtagtacgatgtactctcacttttgcttgtgttttcctcatcaaacatgcatggttcgaattagaggggtttgatcgtttccgcaatgctcaacatatagaatattggtggccgattaaaaaaaaaaaccaaatttcagtaatttttactatattgtatcgtacatgcttttctctttgtcataccatgtttgtttccgtatagtcttccctgtttttagaaaacgagcaagtttcgcgatataaataattgaaaccctgtacatagggagtagctagagctagtgagaattggataaatccaaaaatataagagtagcaaggaaggaaattctaaaattcaaagaaggataaaggagcatgcatgccattgtacacaatagacccatgctacatgttagctagctaggattttgttgggtagacaaactgaagatgccagggggcttcaagattcgtgcaaagctcacttctgtgggccacatggttttcgttgtcccatgcgcatggacttctttgaacctgccaaaaatcaacttattgagttggatatatgtgctccaaaagacttgcaacagcatcagttgtttctatccacttgagtctaggcacatacatggacatgggtcttctccttttatgacactgtatgttgttttgatatacctggattggtctcaatttcaccgaatcagtatgtaggttgttttaaaaagtacatattgtgaaaatggttctaattcttgtttatctataagtgggctcatcaaattcatgaacacttctctgttaataagcttaggtgcatatgaatgtttttcataaagggcacgctaatatgcattaagtaatgctacctttggtgaggaatacttgtcgctttgacaataacttggtgttcaaaatacaactatgaccgtagatttttattgactacaaaaggtcaatggatttatattttgttgttattttgggggtgggggcgggatcaagtgtacacacatgcaaactttatatatccaatccatgtaaagcatatatatactcaaccattcaaaagcttaaaccaaagacatgtccaaagcaacgtgtgtatactcttgttaccaaagccactagttagtacttgtattctgccaccctataggtcgtttgccatcatttaaattgacatttcagtcattgatattctgccaccctgtagatatatatatttcagaagcagacaattggtactttctaggattagagaagtttgcatttggagggtcctacatataattttcaataaaatatgaactaaaatttttactacttgcatcaatcggtcaaatatctcatatttaactatctacttttgtcttattattagtcttcataattcataattagctgcatcatccttcctgactctgcatccactcatatacacctttcattaaaaagaacttctgaatctgaatctagagatgacctatatattcagatttaaacttagagatcgttttatggatggagaaagtatatgattaaaatgccaatctacaattttttttaaatgtactcctttctatcacttttatttgacgctgggagtattaaattgagtatcaatctacattcatttatatataataacattaacaatctaaatatagacaagccaagtgaattagttcattatttccgataattgccaagccaaagtatacaccagcacttgatcatctgatccacacaaaccggattggtctccttcgtgttgtcaaaggcgtgcagcacctgtttctccctggttcccatggcccacggcatagcctttaaacatggaccactgtctatctccagcaccaagaaggctagagagtaaatttcactttggatcatattttattactgattttttttactttggattaaccaatgtttttattttggactggatatttatacctttatggcactttaaaccaccggtcctcaactattttatctatatacattcaacttgtcatatgtcaaagaaatagtcttacatatagctgctagagttcattgacgagtaagaacacagaggtactcgagatcgtttatagtttgataagagagttgggtggtttaaagtaaagcaaaaataagtttatacgatccaaaatgaaaacaatgattaaaaggtgatccaaagttaaacatcattaataaaatgtgggctttggcaaaatttactcaaggcggaaaagcctcatgctcttgctcatgcattccattccattccagatttccaaattgacttagcattgaccctggctggacacagccaccacaaatttttcatgggttctagtgagtgcaagccaatcaaatagggatgagaacggtggcaaaatttcttgaccgagcatcatttatgtagaagtggtaatattttttattttagccaaagattaaaaaaaattaaaaaaaaagaatctatcactaccatattatagttgtcactaaataaatcattagttgacttggtaaatatgaaaaaaaatatatcacggaccaagaatcgttgatgtagaaatgatatcgttctcgagcaaatcatcacaaactcacggtgaaaaaaattatatcccaattatattcttttacatgaaagatgattgtttcctttgaatttcatatattttagacgcaccgatttgcaccacctctactagggagaagaagtagaaaggaaggaaggatttaatggacatggagcagttggccgcaggtcatatccaaatcatgccggggtgccaagcagattgggagacagccgatctgagttggagccatg

SEQ ID NO: 16444 - DNA, 2884 bp, Oryza sativa
  unsure (1)..(2884): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacgccccgaaagcttcggttgtgattccgaaataggacgtgtttaaatccaaccagaatagttcgtaccaaaatttgaatttgcgtcttagtaatttgaaagttttcaattagctgttgtgaagaagcggaattaactgacggagtgaaatcatcaggagaagcaaatggctgcattcccccgctacatattgcgacctgtgtgcaatgattgtactattaattcgctttggctcagccacgctgtcagctcgcaatcagataatgtaaccaattgctaaataacaaattccagagaaagaatgtgaatggcgtacgctaccatggcggaatcaaccaacgtcgcctcaacaacattaaataaaaacaatcagaatatacaaaacaaaaattgatcgatcatgggaagtggtacaggttggacggctggagcccggcggtgacgttgaagtacctgaacgccgccgcccaccggcggttgtccttgagcatgtgcacgaggacggtgtccggccggaagttgtccatgtcccagttgaggtcgtacatccgcggcctgaggctgtaccggttcttgccccggcggccgatgttgagccatttcccgacgaggaggtcctcggggccgtgcgtgtcgttgtaccgcaggatgtcctcgttggtcgacacccacgtcgcgacgtcccaggacacgacgtagcccatcccgtgcatgaactgcatcgggtcgtcgccgacggcgaagccgtagccgaggtagacgtcgtcgcggggcttgtgccggagctcgtcgaccagcgcggccacgcggaggtacgtgtcgtcgtcggtcttcatcacgtagtcgtagggcgacgacgcgaacatccgcggcacggaggagaggtactcgtgcgtcttgccgtcgttcatgttctccgtgcagttgagcaccaggatgtcgccgtgccgcgcggcctccagcaccaccagctgcgcgtccaccgggtcggccacgcggcagaacacgaagcggacgtccacctgcgcgacgccggggggcaccgccggctgcagcgcgtacgccaggcgcacgatgttgcgacgctcgtaccgcttcggcgtcgtcagcacccccaccagcagacggagctccggccgcacgacggccttcgtctcagcagcagcagcagcagcggaagctgcatctccacccggcgtgacgaggtagccgtcggcggtggatgggccggcgtggcagaggacgccgaggccgtcggagcggacgtgggaggagccgaggctggggacgacgagcaccacggcgaggaggccgagcggcaccagcaggagatacggggtgcagagcgaggcggtggccgggaacccgtgcgacgacgacgacgacgacgatgcggtcttcatcgtaaaaatctcgcggggaaatgcaagtgcccctcgcacgatcgcggcccgcgcgttactcgagctatagccgtactcgacttataaccaggcacgaacgcgcgctggtttagcgatgtgggactaaaatttcagcattttccccctctctctctatctcgtgtcaaaagcgtcggtggaaacgaacggttcttcgcggaagaagtcgtcgtggcaatggcaatgtggcatcacccacgggagtacgcgacacgggctcgatcgatcgatcgtcgtcgaggctgccgtcatcaacggcgacaaggaaccttactcgataagtttactggataattttgggttgtctcgtgccacatgacaggggatgtttcaacggccaacgccatatggtaggtggcagacggccggggatataccccagccctccagagctctagttttatcgccaatgtatggaaggacagctcaggggtacatcgaaaattcgaaagggatttgattaaaataacaagtacacagtgagcaatcattcaatcattcatgctgagattcgaggcatccagcttccagcatgcattgttggcgacttggcgtgatcgttttgagttcgggggcggctggaacagaagaaggtcgctgggaacaggcaagcttgtcggctactactacttgcgcgatagatatgcccggtgtgtgttcaattgttcatgacatgcctgatgccttggctggaggacgatcgaaaccgagatctcaccaacttatacaaatgatggtagattaataggcagggaaattgacaattcttgcggatgcttttgcctgtatgatcgccttaatttgagatcgtgatttttcagtgaaaaaatcgatttcgtgcaacttcgaaacgttgagggttaattggctaatgcagctggtcttctgttgagtaattcaacataagaattctactagcagatcgatatagtgttgacctgttctctctattttgtaaatataaagtttagaccttttctgggtatatggcatgtgttatggcaaagtcggtcagactgatcatacagtgaaaccaacttggtctggtctttctttctcagaatacaacctgaatgtacgcgtacccatgcatgtctacttcaattgattaattaagttttgtactttctagtaatatacggcattgtttacttttggatatgatatttgaccattgattttattaaaaaaaacctaagtaatatttatttagttgtgatttgttttattattaaaggttccttaagcatgactatatatattgttttatgtatttat

SEQ ID NO: 16445 - DNA, 6462 bp, Oryza sativa
gaaatacaatttagaaatagttgaaattcggaattaaaaataaggaatattagaacaggagactagagtccatatagaaatacaaattaggaaataactgaaattcggaattaaaaataagaaatattagaagtagagtatagagtccatatagaaatacaaattaggaaataactgaaattcggaattaaaaataagaaatattagaagtagagtatagagtccatatagaaatacaattaggaaataactgacattcaaaattaaaaataaagaatattagaagtagagtatagagtccatatagaaatacaattaggaaataactgaaattcagaattaaaaataaggaatattagaagtagagtacagattccatatagaaatacaattaggaaataacagaaattcggaattaaaaataaggaatattagaattagagtatatagtccatatagagatacaattaagaaaaaaacagaaattcggaattaaaaaaaggaatattagaagtagagtataaagtccatataggaatttaaaactaactaaaattcggaaaaaaaaagagtctccatgttcactctcatgacctagaaattctcatattaatcggagaaaaagaaaaagcaaagtccatatagaaatacaatttagaaatagctgaaattcggaattaagaaataaggaatattagaagaggagactagagtccatatagaaatacaattaggaaataactgaaattcgaaattaaaaataaggaatattagaagaagagtatatagtccatatagaaatacaattaggaaataacaaaaattcggaattaaaaataagaaatattagaagtagagtatagagtccatatagaaatacaattaagaaaaaaaatagaaatttggaaataaaaaaaaagaaatattagaagtagagtatagagtccatattggaatttaaaactaactaaaattcggaacaaaaaggagcctccatacaattaagaaaaaaaatagaaatttggaaataaaaaaataagaaatattagaagtagagtatagagtccatattggaatttaaaactaactaaaattcggaacaaaaaggagcctccatacaattaagaaaaaaaatagaaatttggaaataaaaaaataagaaatattagaagtagagtatagagtccatattggaatttaaaactaactaaaattcggaacaaaaaagagcctccacgttcgctctcatggcctagaaattctcacattaatataagaaaaagaaaaagcagagtccatatagaaatacaatttagaaatagctgaaattcagaattaaaaaataaggaatattagaagaggagactagagtagttattacacattagtagtttcgtaaagttattgcaaaatttaaaattatgttgtcattgtaatatattttaataataaaatgagaaaacatatatgctattatacgtgagaaaatataatgatgctaaccgcgtaatctgcgcgggccaccatgctagtttttttttttgaatgccaaaagaggtagtatatgacatggtacatacggagtaccttctattagtatcttctcaagcaccgtgatagaacaaatgtccatctatctcgaggcaacaaattgctcaccttaggagccaaactaccgaatgtataataagatcgtaggttgtgatatacaggtttaatgcttgagaatgcaacggacattgctccagtcaaggttaagtacatcttgcactattgttatgcacttttcttttgagtgagaccaccaaaaacaacataggaaatccccaaaattgatatggcaaagctatctgaaatatacagccttgacaaattacgttttgcaagaggagtacaagcaaattacagagctaataacaagcagagcaagcacattccactttggaggctacaagtctactacagcttcaccctgcggaccacttgcatcaaccctaatcgtatgaagaagatggatacaaactttgagttatcatatccatcagccggcgacccccccatcttgaatgctttcatttcctccacacgcggacacaccgtgctgtttctcatcaatccgccaattacaaccacacctatcgttgtcacgaggcgatcaatgacgaatcgatcgaacaggatcaacccgatgatcaccaagaaatcgagcagccgaaatcgaatttgagcgagtcaaaccgaggcacagctcgcgcatccgtgttcgtgcaccgcacaaccaatgcacgaatcgaattaaacccgttaaagaatgtgtcgaacgattagttaattagaattaatcaaacggggaagaaattaacaaacaacaattatggatcatcgaagaggtgatcgatcgatcgatcgatcatggtgagaggtggtgcaggttgatcccggcggtgacgttgaagtagctgaacgccgccgcccaccggcggttgtccttgagcatgtgcacggcgacggtgtccggccggaagttgtccatgtcccagctgaggtcgtacatccgcggcttgaggtcgtagcgattccggccgcgtccggcgaggttgagccacttcccgaccatgaggtcctcgggcccctccgtgtcgttgcgcgcgaggatctcctccgccgtggacacccacgtcgcgacgtcccacgacacgacgtaccccatgccgtgcatgaacggcatcggctggccgcccatggcgtagccgtagccgaggtagacgtcgtcgcggggcttgccgcggagctcgtcggcgagcgccgccacgcggaggtacgtgtcgtcgtcggtcttcatgacgtagtcgtagggggacgacgcgaacaggcgcggcacggaggagaggtacgcgtgcgtcttgccgtggttcatgttctcctcgcagccgccgagcaccacgacgtcgccgtggcgcgcggcctccagcgccaccagctgcgcgtccaccgggtcggccacgcggcagaacacgaagcggacgtccacccgcgcccgcgccgccgccggctgcagcgcgtacgccagccgcacgatgtcgcggcgctcgtaccgcttcggcatcgtcaggacgccgacgagcaggctcagctcgggcttctcctcctccttcggcgccgccggcgccgcgacggtgtagtcctcggcgccagcgctgcggcgggcgcagaggacgccgaggccgccatcggagccgacgcgggcgccgttgagagaagggagcaggaagacgacggcggcgaggaggagcagcgcgagcggggcgaggaggaggtaggagttggacgacgccggcgccttcatcgccatggccgcatgcaaatgcaacgggagacaacgtggttggtaggtgcaatgcagaacgagctgtagtagctgttatacgcgcactaatcaagctcacgtaatcaagaatttccattaagaaattccactgcctaacttggtttttttgtaaacaaatcgtcgaacagaacagctgacaagacaagagttctttctagcttgacgcgatgcgctggccagttagaactcgccacgtgcagtaataacaacacccatcgcttaccttttaacttatctacaaataaaacttaatattgaatttaattttagagttttcaattatgatttattttttacattgatcttttaatcgccaaggacgatatatatatgagtgtgtgtaatagttttatagctttcgaacgattaaacagaaaacatcttctctttttcttttgacagagacggttgctctgtctcgttattgacacaaaggttaagttaatcacgaaacgagtccatatcccatagaggttcagaaatggcacgttgagctgtcgccgttcaataatagcagccgagtcaaaggagagcgtgaagtgccgttcacgacgacggcttccccgctgcgaaatgcctagccttaccggtgaatgatcggatcaaactctgaacaggaataataataataacaataatgcagagaagtttctgaatatgaggcagaaaagaaagccatatggtccctagtagtagggtcgaagcctgtagtatacagataccagtattaatcaaattttagtccctgagttgccgtgccgtgctgtgctatgctcgcacatgctgatggcattgttgtttgtgttcatggctctgaaagtaacgggctaccaagaactgattccaatcaaatcgcacatcgctgtttcatgtgacgaatcctggtcatgggctggtgtcatctccagtcgtgtttcgtccagaatttgtaccgcgttttcttcctgttgctcgtcatctttgtgcttctcggctaagtaattactagcctgtacgagcagaattgttccacggcgaggagcccccgttttcaagccgtgctccccgcgtttctggagacaaagaaaacttgtcgatacccaacagtcctacctgattagctcgaaatcaatcgacaaaaaccggtgaaatccgaacaaattttgcagatatatacactgaacctttcccgtatttagccggcttactgcacggtttctcaattcgaaccgacttgataagattgataaccgcgaccgattacttaccgtcataggagtatctttgagaccctggtcaggtcaaaggtcatcggaaacgactcggaaaattaaacctccaaattcacaagtctccatcccactggtccctggacatggaagaggaggggaccggccgtgtgtacttgtacacggaaggaaccaagcaacagcactgtcgccggatggagtttggtcccggaggaaactgatcgatgaagctccaagactccaagcgccggcgacatcacacagctcgatcgatcggcagcagcagcagctacagaatatagatgcgtcgcgtagcaagctgagctatgccgatgggccctgtggcactaacggttgccaagagaggggattctaatcactcgagatgataatgtagtgatcgataggtcgcaataggcgccaaagccacccgtatagcctagtgatctttaaaaaaaaaaaatctgaattacccttcttactatcgtggtgaatagcagatattcaggtcccgtttgatagagctctaaactccaactcccaattctaactccaactccagtaagagctggctcctatacgagctgagacgggtatagaaagtatttggctagattactcagatccacgccaccacatccctcgtcgccattttgtcgaacaccttgtagacgtcaccctactgttgctgccgccaggcagcccgcgagccgccgctgctggtcagcccccgcatctcctccgccgccccgggccaccacctatcgccaccgccgccaacgcctgccgccgccaacgcaaacgccgctatcacagccacagcaagacgccggaggaggatggggaggaagatggagaggagagacaacgggaggagaagggtaggaaagggtagtttagtggtatttttacgtaaatacactaaaaaggtagtggttcttttgaggtggagtggagttgtggagcagcaaaaacccaactccatcccgtagtataattttgtggagcagctctgctaactctgctctaaaaaaataaagaatatgtatctatcgatgggggatacccgtagaccggataaatagggtattggggtacgttggtatgaggatctacatgatacgacatcaaaacaaacaaggagacaaagattatactggttcaagcccctcgttacgtaatagccctaatctagtttgtatgagattgatatgaaaaatcacagagtacaaagagaacaaaagaatccggcgttactggcgagatccttctctagatgattcgatgagatctcccggcaagtgggcttcgcgtcctcccgctccgtaaactatggtgggggtgttggtgttgtgatacaatgatctgaaccctcaggcggccttttataccgtgagttgccttagtctccaagtagaactcagagacaacaaaccctgcacgatatagaataaacctaatcctctctgaataggactctgataatcacttgcccataaggatattttccataatatcttgtaaattcccttatcgcatacggaaacatatcgtatacatgaaggtataccgtatccgtatattccataaggcgtgggatatgaggtatgccttatccgtaaccatgacagtaccgtttggcacagttctccagataagctggagttgggaggtagagctgtgccaaacggggccaataccatcaacttttcatactagacaattaaccccctaactcctgttttagatggttttgaactggggaggttaacgtggcattccaaggtgtcaaaaaaataaaaaaaaaagtaagtccaccaagggtggtaacaaaaatttaataaa

SEQ ID NO: 16446 - DNA, 6603 bp, Oryza sativa
cgtgttagttattaattatttttaatatcaaattcagttatttgtaaattatatatattcctatatatactctagactcgtcttttaatatttctttttttagtttcaaattttttttgtaaattgtatttctatatagactctatgctcttcttccaatattatttatttttatttctgaatttttattatttctaattgtatttctacgtggattctaaactcatcttttaatattatttaatttttaatttcgaatttcagttacttctaaactatattcctatattgactttaaactcttcatcccatatttttcttaatttcaaattttagttatttgtaaattatatttttatacggactctaaactctacttttaattttattatgtttattctaaattttagttagttttaaattcctatatgtactctatactctacttctaatattccttattttttaattccgaatttctatttttttcttaattgtatttctatatggactctatactctacttctaatattccttatttttagttccgaatttcagttatttcctaattgtatttctatatggactctgtactgtacttctaatattccttatttttaattccgaatttcagttatttcctaattgtatttctatatggactctatactctacttctaatattccttatttttaattctgaatttcagttatttcctaattgtatttctatatggactctgtactctacttctaatatttcttatttttaattccgaatttcagttatttcctaattatatttctatatgggctctagtcttctcttctaatattccttattttttaattccgaatttcagctatttctaaattgtatttctatatggactctgttttttctttttctccgattaatgtgagaatttctaggctatgagagtgaatgtggaggctcctttttctattcctttaataatataactagctaggtggcctgcgcaattacacggctagcacccaaacaaaatcatatatttttttagtatgatttttacttaaaatttattaaatagttatctcattgtcttaagactttgaaagacgaaaccttatcatccttatgtttctaattatatagtttttaaaagtcacaccaattgctaccccttatgtcatctccttctttatttgcttgctcgatctaccattatttctattcattctttttggaacctttaaaaattggattttatagtttttagagtttattgtcacattggatttcatttttataatatcaaaatgtcccgtcaaacgttgccattatactcctctacggcccgtccattgtctcttctctttattgtcattgagattttaaaaatcgaacataattattgtttgggttcatttttactttctaaaagtcccgccaaaccgtcaacggctttgccattgtactcctctacggctaacccgctaccttacttctttattgtcattgaaattttaaaatcgaacatgattatcattggttcttttttactttttggaagtttcaaacctttaaaaattggacttgtagttttattttttataacttttagaagtcccatcaaacgatgccactatgcccctctacagcccgtccgccgccaactctttattgttattatgattctaaaaatcgaacataactatcatttgaattcattttttattttctagaagtcccgtcaaccgtcagcggctctgcaactatactcttatataccccgcccactgcttctcctttttattgtcattgagattttaaaaattgaatatgattatcaatggggttatttttttttactttctagaagtcccagcaaccgtcttactcgtttgcttcacggcatgcctgacgtccctccttttaattgtcattaggattctatttggtgttttattaacaatttttatatctcgtatcaaccgccaccactctactcctttataggcatgtttcttaatttatctcgtcatgtgttttagatggtcttttctttcaataatctttatttttatcacaaattttagttatttataaattgtattcctaattgaaatcttacttttctttttcaaatttcagaatttttttaaaaaaaattagttaatatcgtattgtgttcttttaatgtttttattttttattttcaatttcagttgttttaaaattgtatttctacttgaattttcttttaattttttctaattttagatattattttatttttattctcaattttaattaatctcgtattgggttcttatatggattcttctttcaatattgcttatttttaattctgaatttcagctaattttaaattgtttccttcatgaactcttcttttattttcttttgctaattttggatttatttatttttatttcgaattttaattaatctcgtattgggttcttatatggactcttcttttattattccttatttttaattctgaatttctgctatttttatattgtattcctacttggactctcatttgcttttctaattttggattttatattatttttgtttttaattttgattaatctcgtattagattcttatatggaaacttatttcaatatttcttatttttaattccgaatttcagctattttaaattgtacttctacttgggctctccttttctttttttcttttctttttctctgaataatgtaggaatttctagcttccacagcgaacatggtgcctccttttaaagctgttttaataatataatagatagataatgaatggtcccacatgttaccttcttctcttttcttcccccattttcttcatccccagccgggtagatacggaggaggcagcgagccagcaagcgccctccttggcccgtggaggaaggcgacgatgatagcagtggcagccagccgacggagaggtgagctcatgcagggtgggtcatgtcttccctgtcacgccccgaactagtcccgaccggaactagcccgtgacgcttcaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaaaaactcctcatcagcaggatccgcttcatcttcttcagcaactgggggggaattatttatatagagcaagggtgagtacgggagtactcagcaagccatgggaaataagtgtttaatgcaggcttcaaggaaaggctgatgtttttgcaattaatttttatttgaactcttttctgaaacaactaagtgagtgcttctcaaacgacacggatgagacagtgcgtctcgtccggtcggagtatgtgcaatgtatcagtctttagaatttaaacaaggttagcacccggccaacagctttttcaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccgcatgacattactaacccggatcacccagcccgtggggatcagccacgtcgggagacctccaagctttcatgacaaggcatttccaaagccgacacaggtttaccatacgccgacgagaggggtcccagaccaacaacaggttagctcccagaccatactgtgccaggaagcccaggggtcctccccgacaccaccccggcgaatccacatgtctctcggcatcaaggctcccctgataagctagttactcagccaggggtgtcccattccacccatgtggttgtacttgtcttatgtttggatgaaattccaaggaatcggtccttaagtgcgagagcgggaaaccgtacacccggtacgtttcccggtccgcggttttggaaattcatttagttcgcaagcaccgacccaggtgtcgggttttccaagtcttttgtaaaactccagttttacccaagttattactcagattttaagtttgaaggcgaccgtcgatactggcacagggtgcacgaatatcgaggcgcaactggatggttacaaggggacatagtatagcaattaacaatggaaggatcaaatgcaacaagttaggtaggtctgccaatctgccttgcagacggaacaacagattaagtgcaatcctatcaatgcataatattttacaagcaatataattagatttcaaatataggctcaagatgttcaaaggtggcttgccttgctcgagatctggagcttgatcctcgaaatcctcgcaatgcgggtcttcgggctccgaaactacacgcgaaacgggacaactcaacaaacggcgaaaatgaaaccctaataatgacctctaagcgtgccattagatagatctcgagatttgaggaattttggaagttgaacggagtcaaacggatctaaggttaggaagatattgaatttctaagattattggattttttggtcaaaaagaaaaggatttaattaaatccttttttggaaaagaaaagaaaagaaaagagggagggattatagacttttcctcgggcggctaaggcgcggcccaagggaattggagcggaccggccgagttaaatgggtcggccggcccaaggcggcccaagtgcgcgcgcgcgggagggaagagagagagagcgccggtggaccgggctcaccatgcgcgatcccgggtgggacccgcttgtcagcggcttggctcaccgtgcggagggagtacgcggctcatgcgcgcgggcgggggagggacgcggtgcacgtgcgcggttcgcggtggatgcggatgcggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcagcggcagcgagcggcggagcgaaccacggcgatacggacaaaagcgagcacaccgggcggttgctcgtgatgaggggagacgagccaacggctcggatttgccggaggaagcttgacggcggcgaatcgcggcggcgacaaccggcggggagggaagagggaaacggcggcgaggccacgaggggtcgattcccggcggtgagagcatctacgcggtttcgggaactcgatgctagcgtcggattggacggagctacgccgagcaaggctggtgacgtgtgagtgctacggagctcgagcggcgacggcggcgagcacgcggcgagcgacgacaacggtcggggtggcgccggctaactacggggagtctactcgagctactaccgaaagctagggggaggagatggagcgaggaggaagaacagagggaggcatcaccgagatgaggaggggcgctgtgacgagaggccgacggcgcgggagtaatctctccggcctcgggccggggaagaggaaggagagggcgcggccgaagtccccttccgcgtccttactcgtgccgactccttcgacacgcgcaacaacgaacggcgacggcgaacagagcacgggggcggcagctatggcgaggaggcgaaaacgagggagattggaggggaaggagctggggtttaaagggggcggcaatgtcggtttgggaaccgacttagggcggtcaaggcgcgagctggcactcggcggtcgcggccagagcggcgacagggaggatgacgccggcggggggaaaaggggaaaaaggagggggagaaaggggcttgcccttttgccgattcgggaaaaaggaggaggggagcgggggcgacgcggcagagggaggaggggcgctgcctccatcccttggcggcttgcgcgcggagtggcggggccgggcggtgacgacagcgatgacggcgggcggtttggagcggcgcgacgacacgggcgacagacgcgtgaagaggctaacggcggcggcgaccgggcggtcggccactcggcacgcgcgtgcggcttgcaacgggcggcgtccgcgcgggcgtgcgcacgcgaacacggcgcgcgggaagtggcagtgagggagcggagagggaggacttcgctcggcgcgggcggctcacgcgcacgcacgcgggcggagcggaggaggaggagcactcggcgcggctcttcgcgcacgcgcgcgcggcgcgcgggcgaggtggagcggagctgagcgggggggggagcggagcgcgccggggaggggagagggccgggggagagggggagatg

SEQ ID NO: 16447 - DNA, 19214 bp, Oryza sativa
  unsure (1)..(19214): unsure at all n locations
cccccccccagggggagatgggccgggaggaaatcggcccatcgacccccgggggaggcaaaatagacttttgtggaggaatttgatttggaaggattggattcgggattggactcgacgatagatcggggattgagatcttgagatggcacgaacactagacaacaagcaaagaaacaaatttcgcaattagggtttttaagagataattttcccgctaggcgccacgacggaacgggcgctacattccctcctcttccatggaggccgatagctaccgagctagaggactccaacaacacaggtgtttgctagctgcggttgcctccagtcttctcccttcttccttcttccctcctcccctcttcacccctgccctcaatctccaatcaagccagcaaccaagccgattgccaaatccacatcccgttgttcgttgaggttccctcctattccttctcctccggccgacaagagaggagatggaaggagaagcgtgggcatcactggattcaccacctcgaccctcgcgtcgtccacttcctccctcacctctctttcttccatcccccatctgtctgggctccatcgagctcacagctaccaaactgcctactgcttccagccctcctcaccgccgtccgccgcgccacaactggccccttcctcgcgcagcccaccatctccagcgccttcctcgccaccgttcaccatgccctccttgccgccgcatactcccgccttcctcaccattactaggctcccactgcgttgcaaccccttcctcacctcgacccgccacctccaacgtcctccttgctagcgtgcgcagcaccctttctgctgttcccgccatccccgcagcgcctacatcgccgatagagagataaccgaaacaaatgaaaaacaaactcgtaactgaaaaacgatgtgtggtcatgtgaagtggtcttttaaccgaaacaaatgttagcttggtgattataagcataattaggaacaaaagaagggatggaaagctattgcaacagttcgcgaaattctcacgcacccgaacacccgcgagggcactacgcgtcgagtgcccgatctggggtgcaaaaaatcgggcgcccacgtcagctgaccgtcagcatgcatgcatgcaaaactattttaaactattttttctcttaagttatttatccaaatcatgatccgattgcaccattaaattcattgcaattaaatttttaaaataagaccacacatagatatattacgatgacaaaaatttagcttattattgaattgtttttaaatgttgcacactgttacaccaaatatatcggaattgtttcactaagtagatcgaaaatgtttcaatcgtttaaattggatgttgtttcaccttatataaaaacaaagtttcagcaaatagcgaaagaatgtttcaattcactgcaacatttaatctatacatagtgaaacatcacgagtacactaggtgatacatttttggtggaacaaaaaataaaacggattcacttaatagagggttttcataatatgtgtgtgatttgttgtaaaagaatgtttcaattcactgcaacatttgattcatacacattgaaacattgtgagtgcattaggtgaaacatttttggtggaacaaaaaataaaacgaattcccttaatagaggttatgtgggtggtttgttgcaatagagtatgtggtggagatacatggcaggtgggggcaggggcacgtggtggggcctaggaggcagcacgcgtcacgtggggagggagcgtctgatttttctccttcccctgagcgaccgacgcgaaggattttggacaagactttacccggaattatactctgttttaaaacagagtaagaaatgagggagacaaaatagacatatttccaactgattgctgatgactcgttgttcggttgggccattctgatcccagaaggatggcaaggcccagaaatacataaaccgtcggcgttgaggcacttgtcccaccgggcctggtttaatttcgatgtaactacacattcgtagtcggtgagactaaggctctgttcgttatgaggagataggggagattgattctcgttttccgcgtgcacgcttttcaaactactaaacggtgcgttttttgcaaaaaaatttctataggaaagttgctttaaaaatcatattaatccatttttgaaatttaaaatagttaatactcaattaatcatgagttaatggctcacctcgttttgcgtatctccccaatctcctcaatccccttctcctcaaacacaccttaatagaagtgagtgatagcggagtacattgttgtgtccagccaatatatatagtgtacatccatttctagcgattatgccgtttgtcactggattctagttgtgtggccttgccgctgtggatggctttatgccgacggtgacgttgaagtgccggaacacggcggcccaccggcggttgttcttgagcctgtgcacggcgatggtgttgggccggaactcgtccatgtcccagttgatgtcgtacatccgcggcttgaggttgtaccggttccgtcccctgccgccggcgttgagccacctgccgacgaggcggtcctcgtgcccgcgcgtgccgctgcgacgcacgatgtcctcgttggcggacacccagcgcgcgacgtcccaggacacgacgtagcccatgccgtgcatgaacggcatcgggtcgtcgccgacggcgtagccccggccgaggtagacgtcctccgcggcttgccgcggagctcgtcggcgagcgccgccacgcggaggtacgtgtcgtcgtcggccttcatgacgtagtcgtaggggcacggcgcgaacaggcgcggcacggaggagaggtacgcgtgcgtcttgccgtcgttcatgttctcggtactgcagccgtcgagcaccaggatgtcgccgtgccgcgccgcctccgccgccaccagcaccgcgtccgcggcgtccgtcacgtcgcacagcacgaaccgcacgtccacctgcgcccccggcgcgggctgcagcgcgtacgccaggcgcaggatgccgcgccgctcgtaccggctcggcgtggtcagcacccccacgaggagtcggaactccggctccctcgcggccgtcgtctcagcacctagaccgccgtcgttgttagtgttgtcgacgacgggacgggagcgcggagcactgaggcagccggagacggagaggacaacaaggctcgacagcgccatggctacgagtccgaggggtaggaggaggcggaggcacagcgagcaaaacgaggtggccggaaagcgcgacgacgtggcctgcttcatggctcccgaatcccaaccggcgaaacgagacgacgagacgaacgaaatggcctggttacggggtgttgcattgcgcagttatccagcttatgaagcagcggaagatgacgggtggacgtcacactcattcattacatgtcaattataacgaaaaaaaataacaagatagatcaacatctaatatatcaattcacaaacatgtgtttttacaagttgtaacaaagataacaaatttaattgcaaatatacctatactaattttgagttttatttattattcttgttacaattcgtaaaggttgaattttaacttgcatctatattgcatattgatgtatcttatcatatttttttatttttttcgtaattatttaaatggcatacaataaacgggagaacatccacccatgtgattaaaagagtttcctggcatgatgatggaggtggattttaaactctcgagagaatacctcctcattaatcgtatgttattcaaataattatgatgtttttttaaaaaaataaaagtttgtattaacacgtgatatatcagttaattaaaattcaacttttaccagcaagaaaaaacattaaactacagctagttaacgtatattcataacgtatattcatagttgaatttgttttttgcattgcaatatgtactagttaaattttaccttgcatgtttatgaagtaatttatcatatattaatttatctttttttattttaaaaataaatcataactatttgagtggcatgcaagttcttaaatgtttataatagttccgtgataatgtccatacaatttgatgataggagaaggctaagtcggacagagctcctctaacgtaaaatcagagagacgtgggtcgctgataggtgggtctcacctttatgggcccacacgtaagtgaccacgtccctctgactttctgactttatgataggagatgcttctagcttccggctcagtcacagtcacacagtaccacgaacgaaagtggtttgactatatactaattgcaaaagcaacaaacaacgatttgttatgatgtatacgtaccacatagtagtactacatctgaaaaaatctgcccaaaaagttatgaagatggagattaagtaaggacatctaaaacaagaaaatcatttgaaaatgataaattaaatttaaattactacaaacctgaaaaaatagatttatttaaatattttagagcaacaactatacataaagtttttttttacgaaatcacggtttaaccgtttgaaaaatatgctaataaaaattgagataaattttgtattttaatatgaaacggattatgaagcttaggacgagatatgcggcccgtgcaactgcaagcgaaaaggaaaaatcgtgaaaaaaataaaaattccaaaagtcgaaaaatacacccactaccggttcgccgtcgtccttaagccttcgcagccactgtcgacgtcgtcctcctcctgtcacggtgaggaggcaccgggagggccacagccgacggatcagggtgggggagggcaccggcctgcggatccaggcgggggagggccgccgccagcggatcggagcaggggagggcaaccaccggcggatccaggcgggagagggccgccgccgtcgcccatgccccccagtgccgccgccgtagtctgtgtcgtggggtggtgcctgctcccagcgcctgctcgtcggccgcaccgcccgttgcccagtgcctcccgctcggtgagagaaagagagagagaggagacgaagagaaagagagggagaggagaaaatgagagaaagatagaggtgaaggaagagagagggggaaatattagagaggagaaagaggagaggataagaggtgaaaattttgaagtggtgaggagggaaaaactgtaataaagagaagataattttgcatgcgaatctttaagagatccgcatgcagatctttaagaggcccgcatgtgaatagacttatttttacatgcgaccccttaagagacccgtctgtaaaaatagaattttacatgcgggtctcttagggagtcgtacgttaaaatggaggtcgatttttgcagacgccgttagttacggttcatctgcaatctaaaggggtcctcgtacagaaagattgttttcctaccagtgttatttaggagtttgagaataaatgcgtgtgcgcggaaaacaagaaaggtgagttgggaaaaaagagggaagaacacagcctacaacaataaatttcccatttgaaagaagaggtagcagagagatagaaacatgaacggagagatagtaatcacaaaataactcaaatcaagaaaaaaaatactcctatatgacaacatatttttttaagtagaactgttacgattcgacgtgagcgcgctgagcaagagaagggtgttgcagtggagtggaatgtccggttggccaagcttgtaacacaattaaacaagcctggcctctgcatgtgcatgtgctcgcttttaatttgcttgatatcgactcgctcgtactagttttacactattcatcctatttcgtcttatttaaaatttttttataattactatttttattattattagatgataaaaacatgaataatattttatgtatgactaatttttttaaaatttttcataaattttttaaataaaatgaaaagttaaacattggacacggattttcacggctacatttattttgggatagaggtagtatacgcttgggatcgatgaacaatcgaacatgttacgtacactggtcacctcaccgcccgttcctacggatcgagaaatgtttaatttgcagctttacgtatacaacaatcaaaagaatacaaatctcacgaaccgaagttgactcggctcaacaaaaaaaattcaattgcggtaaaaactcacgagatcgatatatcgatcaacctaaatcaccgggtagaacggcttgagcgcggcggtgaagttgaagtactggagcgtcctcgcccaccggcggttgtccttgagctggtgcacggcgatggtgtccggtatgaactcgtgcgagcacgggtgcctcccggggaagttgtacatggccggcttcacgtccacccggttcctgcccctgccgccgcgtcggagccacgagtagagcgtccggtcctccggcccgcccgtcctcccctcgatctccgccgccgccgccacgatccactccacgaggtcccacgacagcaggtaccccatgccggacatgtactcgttcgagccgcggacgtagtcgcacggcaccatgcacccgtagtagaggtcgcgccgcggcgctcgcgacagcgactcggcgagctccggcagccggaagaaggtgtcgtcgtcggccttcatgacgaagtcgtaggcggcttcgccgccgccgaagaggcgcggcacgctggagaagtaggcgtgggtcttgccgttgtccatgttctccgggcagtcgagctccaccacgtcgccgtacgccatcgcctccagggacaccaggacgcggtcctccggcgagccgacgcggcagaagacgaaccggacgtccacgcgcgccctcgacgccaccgccggctgctggagggcgtacaccatccggagcaggtgccgccgctcgtaccgcgccgggagggtcagcacgccgatcagcagccggaactccggggccgcctgcacgccaccgccgccgccgccgccttgatgatcgccgcatgcggcggcgccggccagcgaggcctgcagggcgaactcgttggggtagacgaccaagagaagggcggcgaggagtgcgacggggagcaggaggagcgccgcggcggggacgggcggcagcggcagcctctgcggcttcatggcagaatgcgtgcgtacacggtgtgtggctgtggcccaaacgaagttggttttggcagaggcagaaatggtggtttttctggggatttttgcagcaggttcacgcggtgcggagggaacacacgatcgagtacaggctgctgcatatttgcagcggagtagagagcacatacgctgtgaagaagtatagtgcaagcatatactcccttagtctcataatattaaaaccttagactggatggaacgtttcatagtacaacgaatatggacagatgcatgtccagatttgttgtactatgaaacatcacatccaattctagattgtaatattatgggacgaagagagtaacaagtcttcttcgcctttgcgtggaatatagttgtggacttgtggagctgtggtggactggtggtggcagaggaaccttggtagtagtatttggtttctcagaagtccattggccgggccatgcttcgattcctggatggcaggccatatcatttgcatgaaaaagggtccaggttttaacgattcacaagtaatcaaagacggcatgacacgtagctttctagactttttaccgaggaaacctgcacatgctcatcgcctcatccgtagcacattgccatttgccagtgcgcccagcgcagcccagcccagagctccaaaaataccaaaccaaccaggcaaggctgtgccgactgccgaaatccatcacggcgcaaaactcgcaaagctcgcgccgcgcatagtccaaaccgcgaaaatttcgctctcccaccacgaaatccccaaatttccccgcgcggtctccactctacactccccgaaaccaacctcgccgatccgcgcctccctcaatccaacggcccacgctgcactcctcaccactcacgcggatcgctccccatccgacggctccccactccccactcccccacccaaatcctatataacatcgccctcacctatctccccaatacagatcaaccaaaaatcgccaccaaaaatccccaattccatcgtcgtcgatgtcggggcgcggcaagggagggaagggtctcggcaagggcggggcgaagcggcaccggaaggtgctccgcgacaacatccaggggatcacgaagccggcgatccggaggctggcgaggaggggcggggtgaagcgcatctcggggctcatctacgaggagacccgcggggtgctcaagatcttcctcgagaacgtcatccgcgacgccgtcacctacaccgagcacgcccgccgcaagaccgtcaccgccatggacgtcgtctacgccctcaagcgccagggccgcaccctctacggcttcggcggctaggagccttttgcattgtgtttgtcttgttaggaatctgcttgtttcggatgtagccctgtatcctgtaatgaagaaaatgctagcagtaaaacttgtttgaattcacctatgaatctagtgcgaaattctgcaatcacaaattcttcagattaattttgctgggacatgtattgaattacgaacaaactgctaatttgaccggtagtttgagacataaaccaaggaaaatctgaagaactttgaacttgctgtagttcagttctcccattcgagagcgaaggctgactcgaacgacgcacggtcgaacaccgcagggccgaccccggtgtcgccgaccagcagccgcatgagctcgccgacggtgtcgaagtaccagtcgcacgggccgtggctggcgtccttcaccgccacctgcatcatggcacgctgcgcggccaccagcgctggccccagcggcgggaggtcggcgcagacgaacagcttcccctccggaaaccgcgcccccgacgcgaacggtgccgccgccgcaccgacggcgaagaacgcgccgctcagcgagcgcgacaggccgtgaacgcggagccggaggtcctcgtgggacgcgccgagcagggcgcggacggcggacaccgccgccgcgtgagggacccagcggagcgcggacgcggcggccacggcgggggccgggttgtagccgcggaagcgagactggaactcgacgttggagaagaacacccagtgggacgagaaggccgacctgaacagcccggcgtcgccgaccagcagccgcatgacgtcgcggacggcgtcgtagtagcagtcgcacgcggcgtggtccgcttcctccgccgcgacacgcaccatcgtgcgctgcgcgtcccgcagcgccggcccgagcggcggcacgtcggcgcagacgagcaccgccccctcgttccccgcgccagcgaagaagacggcgctgagcgagcgcgagagctggtgcgcgcggaggcggaggtcgtggtgggaggcgccgagcagggcgcggacggcggagaccgccgcggcgtaagggacccagcggagcccggaggacgccgggccgtggggctcgacgtcgtcgtcgtcgtcgtcgtcatcggtggtggaggtggagtacccatcatcctcctcgctggcggcggcgagttcgctcccccggtccaccccgtgagccaccacaaccatgctggtatcgaacgtaatggcgtggcgtcgtgcggttactcttgtgcgtagagggagctgtgactcctgggctgttgatcactccatggaccatgttccatcccgttgcgacttgcgacccaggggcggagctataacgtggtccgtgtggtccatggaccaccatagaattctggtccatggcccattacctctatgcgctacttaaaaatatagatggcactttgacgctttgttttttcgccaattcaaccaccgcgtcgggcatcgggcgtcggcgcgtcgcttcgtttccatcgcaattgtcgtttccaattttcgagcgcgcaagtcgacgagtcacgacgaccactgtccattgaggcactaacgagtgagttgtgacgtcgccacgtcggcggccggcgactgcgccaccgcgggcagcgaccgcaccagcgcgcagtgccacaggccagcagcaaccagcagggagaaagcaatcagcagcactccattcatcaggaggcacgcaacaccaaagcacagcaaacagcacgttagcaaacagcactatagtaggttctcaacttctcatctgcttctctctttctcctccctaacagtagggtttttttttctttaggtttaaatgttcaatctcatttcaattttaggatatccggtcgattggaattggaatggtaaattcaaattaaaccttacaatcctatataatctatggtagatttgctgaacaagttgagttagaccaccatatcttaaaaacctgggtacgccactgttgcgaccgttggtcccgagacgacgcgcgagcctcgaggcagagagagagtgcaggactctcatctgtcatttccatttcatgtgcagaagtcagcttttacaggtactttctcggtttctccttctggttgggttggcatcgtctgtctcggggtgatacggcaaacttcgccgttttttcatctcgagcatccaaacgtgaccgataactggatgagcaaatgttcgatggttgtgtttagttcacgctaaaagttaaaagtttgattgaaattaaaattgagcaaattgtttagtttcaacttttctgtcacaccaaatgtttggacacatgtatggagtattaaatgtggacgaaaaaaaaccaattgcacagttcgactgtaaattgctagacgaatcttttaagcctaattacactatgatttgacaatgtgatgctacagtaaacatttgctaatgacggattaattaggcttaataaattcgtctcgcagtttacaggcggaacctgtaatttgttttgttattagtctacgtttaatacatgaaatgtgtctccgtatacttaaaaaattttggcacacgaactaaacacagccttggacgttaccaggtttacgattcctagatgatctttcgttttgggctctgacggaatgacagttttcacgaaattcggtggaaagccaaaattccgaacaaaactccggcgattccgaacaaattttataaaccaaaatttaaatacaaatttcttaagtttaccgataagcttgcgaaaaccgataggctttggtgaaattctgagcgaaatcatcaaaatttcaatcgataactagaaaaagaggtaaacagattttttttccttttttaattctttattattttctttcctattgtaaatttcagtaaatacacggaatacatcaattttttcgaaaatttatatcccaataagttctatgaatatcatactatttataagattttatttgatttttttcttttttatcaattcaaatttaaatttggataaaactcatcgaaatctcagacggcttctactttgagccttgtcgaaacctcaaaaattcgcgggattcgaccggttttcgtcggaattgtaatccctggacgttactaatctacgcatcagttgaatggagaatctaataattaataagaagaagaaatgtgcaagtatgagcatgttagaaataacaacagaacaacactgaggtggtgatagaatctcctaaaagataaagattaacaatttcacgtaaaacgaggtggtaataacatgtgattaattgagttttaattattacaaaattaaaaaatggattaataacaactttcatatagaaagttttcgcacgaaatataccgtttagcaattcaaaaagcatgccacgagtacctaaaaatttatctaatttatttttacagaaaagaataggcctgaagtcatacaactaactgaacaaattatggaataaaaaagaaagctggctaggatcaatgtcaaggaaggccctaagcgtcggatgcccgatgctttgggaaaaaatcgggcgctgacgctagcatgacgtcagcgcccgatttacgtgtaaaaactactttaaactgatttttctcttaaattacttatctaaatcatgatccgattgcaccattaaattcgttgcaattaaatcttcaaaacaagaccatacatggatatattccgatgaaaaaaaattttagcttattattgaattttttttaaatgttgcacgatgttccactggatatatcggaattgtttcactaattagataaaaaatgtttcactcgtttaaattgggtgttgtttcaccttatataaaaataatgttttactacctccgtcccaaaatgtaactatttctagcatagcactttgtcccaaaataaagctatttttctacctaccttctcctctcaaccaatcacaaccattctttttcacctactttctctttttaaccaatcacacatcttcttcaatcattctcacctactttcttaatacccgtgccaaccttaaaaatgcttacattttgggacggagaaagtagcaaatagcgaaacaatgttttagttcactgcaacatttgatccatacatagtgaaacattataaatacactaggtgaaacatttttcgttggaacaaaaaataaaacgaattcccttaatagggggtttccaaaatctgtgagttttttttgttgcaatggagtatttcagttcactgcaacattagatttatacatagtgaaacattgtgggtacattaggtgaaacatttttggtggaataaaaaataaaccgaattcccttaatagggggtttccaaaatatgtgatttttttttcaatagagtatatggtgaagatatgtagcaagtagtagggacatatggtggggtcccagtagaagcacatggacacgttgtggaggggggaggaggggagcgcccgattttctccccctcccctgggcgaccgagcggcagcattttcgcaatgtcaacgcacgtagaattaaatcttaacctttttttacattcggacaaaaatcttaacctttttctaattgaagtaaatcttaatttaagccagtaggaattgaaaggatgtcatggttgtaattggtgctgattttctgaattcatttgatcccgaaataggtactgcaggatgatgttaggtgcttgtcagatacggtggttggaatccagccataggtcatgtatggatgctctgatgaagcaacggcaaagtttgccgtatcagcccaaaggccgacgatgcctggttagaaattcatgatgagtgtttggatgactttcataagtgtgataagatttctttttttaaaaatattggtaaatccaatattttttttataaatattggcaaatccaatatttctctttagtgactctaaatagtatagcatgattttatttagattatggcttggattttgatgaccttacctttgacaagtttgacgaagaaaacatgataaaccttggcaattatagattgtgaaccaaacaaccactcattgtttcatgctttattttgttttgccacttaggagtaggctttttatgaaaattcagtatcccatactttattttgtttcccatttaggagtaggccttttctactactccctctcccaaaacataaaagattttgattggatgggacatattctagtgctgtaaatctgaacctctgtattcatgatctgctatactctccatggaaaaaaaaatgatctgctatactcaaatataatcatgatcgagaaaaaaaaatcatgtacagttacataaacacatacgtacagccagtatacaaacgcaaatgaaaactaaggcacacagcacgcgttcaactctgatcaatatctgatcaacaagcgagttcatgcgtacacctcgcaacatttccactcgtgtatagtgacagccgaaactctttcgccatccaagatatatccaacgaaacccccctacctgtcctctcgacttcctccgatccgctacgggtagctagggtcgttcggattcaagtgaagaagtcgtacttgaccggcgtgccggtgggatcgatccatggctttgcgtgcaggaagttgtcgacggtgaacttggtcgcgtccgccttgctgatcaccttcttgtaccccggccacgcgacgcgccccgccgtgtcggcgccgggccccttgttggcgtactcggcgtagtagagcgtcttgagcgcgaactcgccgttccacggcatgtacccggccttgtcgatgatcgccgggatgtcggactccatgatgacggtgcgggagaactcgcgccacggccggccgaggtagttgcggatggggggaagcttggcgtcggtgagcgccggctcggcgttgaactcgcacttctggagcacgaaccccgtggcctcgcggccgtcggcgcggccctgcgccgtggcgatgttctgctggttgtccatggggcggcggagcgtgaggacgcagttctggaacacggcggcggcgtcgccgaagacgaagtcgatggtgcccgtgatgacgcagttgcggtagaactgcgccttggagtgcgcgtacagcgtgtcctggaacccgtccatccagcagttgaggaacaccgacttgtccgactgcaccagcagcgccaccgcctggtgcttcgccgcccccgccgtgttctggaaccccatcccgatcgccatgaacccgtccccttgcgccgctgcaaaaatcgccatcgatcacattgcgcgtcaatggcggaagctctgatattggtttataccgaaggttgctgtcttgaaggtggtgaggccgtcggcgaagttcttgctgccggtgacgatggacttcctggagccgtcgccgtacatggtgacactcgccatcttcttggtgatggtcacgtactcggcgtacacgccctccttcacgtagatcacgtaccttccactgtaggtcttgggcatggcggcgagagcttcgttgatggtcttgaacttgccgctgccgtccttggcgacgatgacgttcggcgtgaggttgttcttgaacccgccgcccttgagcaccctccggtcgccgtcgggcacccactccgggatgccgtcctcggcgagggccaggtgggggtccgctgctcctcctccgttgtcttcttccccggcgagcagccggcgttgggagcccttgagggcggagaggaacgaggaggccttctcgatgagcgccagggcgttgctggtgaactccctgccgttgttgaacgactccttgaccttgtccctgaactcgccgtcggggaagccgtcgatgcaggtctccatgttggcgatcaccgcgctcagccagacgcggagctggaagccctgtttgaggccgtccttgccgtcgatgcccttgagcgtgcagttgaggtcgtccttggcgtcgtcgaagagctccttgcagtcggcgacggcggccttcacgcgcgggtcgttgctcatgatcaggtcggcgcggncgaacgcctggtcgaccgcgccgccgatcacgtccacggcggtgcggatgatgtccttgggcgacgacacgctggcgttcgccgccttgccgatgctcgtggcgcacgagtccgcgaagtccgtctgcgcgcacatcatcttgatgctcttcgacacggcgcgcaggtccgctttgccgccgccgccgccgccgtcttcgtcgtctccacctccgccgcctttcgatttccccttcgacgagcccttggagccgccttcgtcctcctcggatttcttcccgctgtacgtgatggcggcggcgcccatgacgatgaggataatgatgatggacaccgtgccgagggcgatcatgatgcgcctgcgctgctgccgcgccttctcggcgcggcgccgctcggtgagcgggccgaagtcgccgaacgccgacgacatggccggaatctatccctagctcttctcttcttcccccactcctctttctcctcctccttattgactgcttcttctttctctctcacactctctgcctgacatcaccattggcagagaggacggaggaggaagaaggccggaggcattggagaacgagggttcattcatgtggccgcgctgacgcttcccgggaaaaaagaagggcccggagacgattgtggaagctatgtttagaagctttggcatgcaacaatggccgccattctcggacgctcccgccattttcttggaggggtcaatgtactctcttctctgcgagaaagctccatgaaaattttggaatacaaggattcttctgcgtcaactagacattcaaccagaaagtatagaagaattcttctacgtcgactagagattcaactagaaaagaaaatagagacggcggaggcggcgctgcgtgccgccagaatcagggaagagcggtaggactcaaactacatattttacaaacgaaaaatatactgcctccgttttttttttatagatgacgttattgactttttctcacatgtttgaccattcgtcttattcaaaatttttatgcaaatgtataagatataaatcacatttaaaatactataagtgataaaacaactcataacaaaataaattataattacgtaaattttttgaataagacaaatagtcaaatatgtgagaaaaagttaacggcgtcatctattaaaaaatgaacacagtatgtgtttttagcgatctaaaagcaaatactggaaaacaaacaacgacaaaaaactttaaaattaactctaaatctaaaattaaaattttaaaactttgctcgtataagtataagcgaaaagatgagtagtctcgatccgatctgacgatcgaagtgacccaaatgggctactttcataggcccatctgggtgacttgggccgttgaggaagcccatcgcgccgtccccgacacggaccaggcggcccagttgataagccgaccgaactgagccgccgggctgcggcgtccccatcgtcggcgtccctttcttcctcatcaacggcgagcttccaattatgcaaccagggtataactataaattctatcgtttctcgggagagaggaaagagcaatgatttgtcgagctgtccctgcctcctcctgtccatcactctactgttagaacgagatgaaacctctacctcgagtggtccagcagcagctgcccctgtggaattggttctccggtccgctttcacttccaacagggagcacagcatcagtgatgcctaccgcctcatcaatctgccggggggaagattaggcggagaacgcgtcaagcatccaaatccatgtcagtatcagtgtagcaagatcgagcggcagaggcctctggttggaatgtaacgggtcgaatctactccctccatcccaaaataagtgcagttttgcacattcatgttcaacgtttgaccgtttgtcttatttaaaaattttttatgattaatatttttattgctattagatgataaaacgtgaatattactttatgtgtgactaaatattttcaaaatttttacaaatttttcaaataagacggacgatcaaacgttgggcacgaatatccacagctgcacttattttgggacggaggtagtactactgatggattcttgcacgagtgagaatctttgatcttgatgaggagcttcttgatcaatgatcatcctctggaattttcagatttgcagttgaaagatgcgcggtttttctttttttttggaggagtttcttttgcgtggcctatagattcgtgcctgcttcaagtctgcatcgtccagttgtaagtacaatgggggtgttgcatcttttcgtgtttggccaaaagagaggaaaagggtaaaggagattcgtgcctactaataacttctgcagttcagcgattctctagaggtgacaagtcacaactcaaaagtgagcggcaacttggccaattctcgcagcagaatagcagtgtaggtgtagcacagtagcacatgctggttttactgaactgaacaatgagcaagaaaaacgtagaaaaaccaaatcattttaagatttaagtggatgatcagcttaaattactgcaacatctgggatccagaagagaataggagatgataaagttcctgtcaggaagtatatcatgcacattaagatttacgatcatgaataaaaacgttgagcacaaacactggatcctaccaccgtattggtgcgtcggaaagcaaagtaaaccacttaaagagaaaattctagatttatgggtgatgtgtgattaggactgcaggattatcttgatccaactggtgataacgcactcgtctgacttttttcccgggatttgctgaggaaaaaccacggttagattccacaattgccgcactaactccattgttcatctctagttttactgaccacactaactctgtcaccgtgtctgttccatgatcggttttagcaagctcatgctttccttgaaagaacaaacaagagcagagaagagaaaagcaaggcatcaactacagctttaattctcactcccacaaaataccaatcattcatcagcttagctagctagctagcacaatcaacattgctgtcaaattcccagcagcatcagttgcatcatcatctttgttaaaaaaaaattgtatcattatcatcttttttttaaaaaataatgaaattgatttacatcccggtctctctaccataagacacataaccaacgagttttgatacctaaaaatcaaaccatataaggtgaagggaaaaaccctcaactccctctaaacaagttcaattgaaaaaacattccaaaatcaaataaattctagcatgtcattcggtatatgctaagtcagccaaagtggaataaaagaaacttggctaccaattccaataaccgaaaattgaccatttttaccatcatttggccccaatttcagatattaagaagataattatatacaatactaattacttaattagtgaccagtgatcacttgtgtgtgtggacagagtggctttaaata

SEQ ID NO: 16448 - DNA, 4964 bp, Oryza sativa
ggcgacggccatggcgatcacggtatcatcagtatccaccagcagcgccttcgtgtcgtcgggctgcagatcgtcctcgcccagacgaggcaccaccaccgccagcagcacggccatgtcgtcctcaagcagatgcagatggtgtccccgccgccggcggcgcgtcaccggcggcggcggcgtccttgcggtgacttcttgagcgcgtgctccctgtgcaggctggagctcggccccgacaaggacgtgtacatgtacaggtacgtacgtacggcaacggcacgccgacgacatggccggcggcgggccggcggctagctggagctcgatcgatcgccgcctgaattttggggtggtttgcttggatgcaggggtgaacaggggttctgcagcgaggagtgcaggtggcagcagatcatgacggacgaggcgagggagcgggacgccatggccaagaaggagcggctaggcctgcatcatcggacgccgcggccgccgccggcggcgatccgcggcggctcgccgaggagactactcgccgtagcctagcacgagcgaagtacagtatgctatacttgatgagaccgtgacccatgcttggatgatatatgatcaaaagaaaattttctactgtactctctgtaaaatatggagaaatcgatgtaattaagaaaaacttgataaggaggaaggagagagagagagagagagagccaggttttgagtaatttgaggcaaatttgaggaaacgtatacgcataactgcatgcagtttcatatttcaaatgaacacgaaatgtttggtgggggaaagaagctttccaggtctcatgggtacaagtgtgcaacttaactgtaacctgctcctgcttatgtgcaaaaaacctggtaaattctggataaattagtttcctgtgcgtgtaaatttcatctcgattatttttagaggatgcgaatgattctcagtcgagtagaactcgtggaatgattctgaacacaagtaaaaaagctctgatgaatcctggggcatctgccatcttttgctttcgagatgccgaggtgccagaaatttgatgccaaagacgaagtggagggaacgaaaggatggtggccgtggcatcaagcaccttgatcgatggggagacagtgagacaccaatcgaatcaaagtggaatcttctcttgctagaaaacgaccaacaaaaattggaagcagctagaagcctataaacattggtcaaggaagagggagcagcctaagagaggcagacagcgattgctacattttagtgccacgaaaatctattaggacagttcgaaaagaagccatcacgttcgtggtgaagactaaaaacacttagatcctgtttagataggactaaaacttttaaatccctatcacatcggatgtttggacactaattataaatattaaacgtagactattaataaaacccatccataatcttggactaattcgcgagacgaatctattgagcctaattaattcatgattagcctatgtagtgctacagtaaacattctctaattatggattaattaggcttaaaaaatttgtctcgcaaattagctttcatttatgtaattaattttgtaagtagtctatatttaatactctaaattagtgtttaaatacagatactaaagttaagtctctggatccaaacaccaccttatattaatcagagaaaaaattaagtaaaaaataatttagaaataattgaaattcagaaaaaaagaaatattgaaagaacatcacataaaaaacccaataaaagattaattaaactcagaataaagaataaaataaattctgaaattagaaaaagaaaaaaatgagatttaaataataatataatttataaataactaaaattcggaattaaaaataagaaataatagaagagagtccatatgtataatccaatatgagttgaactaaaatttttaataaataaataaattttggaattacaaaaataaaaataagattcataataatataatttagaaataactgaatttcagaattaaaaataataaataacagaaaaagagtccacatagaatccaacacaagattaattaaaattcaacataaaaaatatatcattacaatttgacataaattaaagatatagctctacttaccctttaaatttcatttatataaaaaaattatacaaaattaccccctccttccttctccctctctcctctcttacccaagattcagttgaaaccacggtcgccggcgacggagctagcagcggcgtggttaggttaatccattgacaggggcgattgaaccgtgaaagagattgacagattagaaagagggagaaggaagaagggagtgaagaaaggaggaggccggggtatagtttagtacaaattttttgataaatgcattgaagaggtataagtatggcatatctttaatttctatcaaattgtaacggcatatgtctttaaataaacgaataataatgctattttttccaaatcaaagaagtcctaatgggtatgatatagttattttttttaatgtgaggactggtgagcccttatattttctttttttttataggtgaagccattaacttttggacacataatttgaccattcgtcttattttagaaactttgtgcaaatgaataagatataaatcatgtttaaagtttttttagtgataaaataactcacaacaaaataaactgtaattacatactctctcgtcccataaaaaaccaacctagtactatatgtgacacatactagtacaatgaatctggacatatgtatgtctagattcgttatactagaatatatcacatccggttctaaattcacttttctgaaacggatgggactcaaaagttatatcatagtcatcatctattaaaatacagatgtagcatgcatccagttgctttctcaaatttcaggcgccagcccgatcatatcgatgagaaagcagagaacaccatgcaccgccgaacattgacgccgcgcgccgaaccaccgcggcgcgctccgtctccgtctgccacacgtacaacgcggcacgacgtacgcgcgcccacacacaccccgcgatcgattgacacgggtccgacgccccagtgtgtctgtgttccccccctacccgggacgtgtcacctgcatacgctgcctagcgaccgcccaagaagctctcgcgtcgtcgcccatttagcagcgcacgcgcacgcacacgaacgcgccgtgcagcatcagcaggcagcagcagcagcttcctcctcctcctcctcatcttcaccgacgacaccgcacgctccgcttgctcgtctcgccggcgccatgtcgtacaaccattcgccgtccatcaccgcagagaccataaaccagaaggtacgtggctacgtgcgtcgttgcgttcctccgtcgatctgaacctcagctcgcgatcgatcgatcgatcgatggctagctcgatcgagttttattaactgatcaaatatgtgcgcattctcattcgtcttgaaggtcaggatcttcacctacgagccatgtggggagattgtccgccacgcacgggtaactataaatctcatcaacctacactgagggcaaagccaatgtttgaagcttacaattacttgagatgagacccataaatagttaatttttgttgtagtatgttatacaatacttatgatcataagataagggcaatgtatacgggttaagtagtccttatggtacggttaggccctgtcacaatagacttcagttatctctatttctatcgctacaaacatgggatgggaatcatgggacccactaacaaataaaaatgtattccctccgtttcaaaatgtttgacaccgttgactttttagcacatctttgaccgttcgtcttattaaaaaaattgtgaaatatgtaaaactatatgtgtacatgaaagtatatttaacaatgaatcaaatgatatgaaaagaatacataattacttacattttttgaataagacgaatggtcgaacacgtactgaaaagtcaacggtattaaacattttaaaacggagggagtagtaagtaacatcaaacacaaaagatgaagaggggagcaaaggagagagatattcttatttcttatgggtagtcgttagttactccatggatagctcatgctattgactcccataaagactccttccacaatatatacattggtacattgaaacatgagctcactacataccctatcttattataagttgatgtccactatctcctaaaattcaacatgtaagtgtaccatatcatcaccactagtaaaatataacctttcagtgatggtgggagtatagatggccaaaaggcctgaggcccgacgggccgccccacggcacaacattttggcccgtgcctccccccccccccccccaccggcacgttgggcaggcctaggccaggcccgacacacaaagaatagggagtaaaaatagacatattatatgccacggttcaagaatagggacgcaaaatatagttattttagctatatatatgtcaacctaaagaggagggagaaaaaatagacttattttatgtcacagcccaaagaggagggaagaaaaatagattcatttaaaaaaaggcatgatgtgccacccgtgccttcgggccggcacggcatggcccgactactggggggccgtgcctgggccggaggtgcagcccatgagccggcatggcccggcacaaagtgctgaccgggccgtgccggcccgatggccggtgggtcatgcctagccatgcctgggccgggccaggctgggcgggccttatggctatctataggtgggagagagcaaaggagttgtcttttcgttaagtagcgctagattaaatttatctcagattccaattagccatcctccaaccccattgcat

SEQ ID NO: 16449 - DNA, 2859 bp, Oryza sativa
atttctgcttgatggcttgaaggctccaattattgcgtttaggttctttctctgtgtgacaatccatctctcatagacagagacgaagctcgtgcattattcaggttggaccaaatagacaaacagtataaccttactttccctatgtaatttccaaagttttagctttgtacagtctttttcccactatattcaatgaaatgggcacagtctggtgccgattcgttttaaaaaaaacttagcatgtgctctctccatttgatattgtaagacatttttattttttttctaagtcatttttttaagaacattaaccaagtttatgaaaaaaatgtgatagcattttcaacacaatatagatatagtatcaaaatatattcaatgctagatttagtgaaactaatttggtgtttgtagatgttgctatgtttttctatgatatggttaaacttaaggaagtttgatttttaaaaaagtcaaaatgtctcataatataaaacggagggaatatatatcaagcattgcaaattattttcacttcttgtgtggcaataaatttttggcctaaaaagaaaatgactgacattctttcgatctacaaatgcagtccatgtgcgctaaaacgagccaggaagattattgaatcacttccaggcagagattctggttcctatactagtagtcaggtactgtaaatacatgctccttatttacaaataacaaaaaaaaagttttttacttggcgttgtcctaggatgatttttaacctttttcattgtgcattacacttgttattacatatatcagggagtcagaggtttgcgtgaagcagttgctgatggaatagctgccagagatggttttccatcaaaaccagataacatttttctgacagatggagcaagttcagcagtaatgctctgcatttccaagctccattagtacagaatgatgcttggtctatctggatatcttcaacttaattaccctcctttttcagatcaacatgatgatgcaaatactcatcaggtcccatgaagatggcattttgtgcccgctgcctgaatatcccttatactctgcttctattattcttcatggtggaacaatggtacggtgctagcatttggatttttcgagaaagtgtccattgatatgccaatggtatctcaaacttccaataacaacttggagtatcatgccaaaaaaaaaaaaacacggagggctaacctcaccttatacagttctttttcctttttttaatgtttcttccctatttcttattttatttcccttttgccttttcgcagtctctttttgaactctttgactcaccatcattacaatggttataagttagagtatgcaccttttccacgtccgaaaaacacttccaagtggatgaatgttcaagtgttattatatgcaagaaataacgaaggatctaaattgaattgaaggtaccgtataatcttactgaagacagtatttgggggcttgagattttcgaagtcaagaggtgtttagaggacgcccgtgcatcgggtttgactattagagctatggtggtcataaatcccggcaatcctactggccaggtgtgctgaatattttttattttatcttacagtttcatgacttgatagaataatgaaggaaaatcaaaagatttctcgagaattactgcaacctatatcctatatagcaccacataatgctagtaagtatctaactgttattcaggtcattaaagaagtttcttgttccacatttgcaacccttgttgtaggtactgtctataaccaaccaggaggagattgtggaattctgtaggaaagaagggttggttattcttgctgatgaggttcacacttgctgattgtttgatatttcaaattagattcatcgtgttgaaaaaaaaaactcggttatatcgaaggtaattgtcttgcagattagtgatgtaaatgcatttacaggtataccaagaaaatgtctatacagagaataagaggttcaattccttcaaaaaggtggccagatcacttggttatgatcaccatgacctctctatagtgtcatttcactcggtctctatgggtaagtcttcatgtcaaccagagtatcttccaaaaatttgtcttctgatttctgaattttgcaggatactatggagaatgtggtagaaggggaggctacatggagatttgtggttttggagatgatgtgatcgatgagatgtacaagttggcttctctaactatttgtcccaacatagctggccaaatccttatcagccttgttatggatccacctaaggtttcctaaaagatgctttcgctacaattttcgtctttagcatattagtatcttcacaatctggttgtacaatagaagtactttgacggaggtttgctgaacttttttatccttgtgaagttctcccttgactcttgcctataaaatttaagaaacagaatgttttttttagtttataggagaaccatagagaacttattacaccttacaccttcaaacttgtgttttaactgacttgtgggtgagatttgcagctaggggatgaggcttttgagattttcatggtcgagaaggaagagacttattcatctctactcaagcgcgcaaaggtcaggaacaaaatacacatatcagcaaatttatatcagatatatccaatttgcatcacacaatgtcaaaaaccagaatttgtgtgctagaaaaaaaatcctcttctcccaccatgattaacccgcgtgtgtcatggtttgaaacttcgtttcgaaatttccgaaatttcggtaatccccccccccccccaccggcaagctcatatctcgc

SEQ ID NO: 16450 - DNA, 2120 bp, Oryza sativa
cctttttgtctcaagctggtgcatgcatttgcctgactaggatttggtctcctcctgcaaaaaggtttccgggacattgcacatccggtgcaccatcctccccggcgaggagacgatcacggcgatggttcccagccttcaggcgttccatgaggcgttcatggacgagtttcgcggctgatcgattgagctttgtgaagcaacagaatttggcagatcacaagatcggcagctgtgccatgccttgagttacacaggagatacagctagcggagctgttgcttgtcgtctggcttgcttagcttcctgtttgtgtaatgtccatcggtccattggactccatgcatgtgtgccgtattataactgcaagtgcgttttagttatgcgcctatatgcaaaactcgtggaattggtgttagtgtttgatcagtttgttactatgatgtaaggagttatcagactacgatctagtactgtatggctgtaataatcaagtaatcaactaccccttgagggacaagtcctatttgtattgtattacaccttagtccactgtgtgtacaggctaaaatgggttggattaattccgaaaaaaaagaactactccttccctccctttagtcagatagtaaaataaatatgactattaatcaattttaaaacacttagtttaaaaacaaacaaactgatgtgaattaatcgtttaaagcacttgcatagcaccataaactttgtccaaaaaataaatattgtcctaagaccagagaaaaaatcgaacgtagtaccattccctctccgcataaccaaaaacagaaatgtttacatttttaaatggttggaatgtacttttatcagaggatgtaatacaatatcacggaattattgtattttaaagaatgaaataaggctctatttatcagttagtgtcaacaacaacaaaaaaagcctgagtgcaaattaagcacaatccttgtgtcaggagaaacaggagatacaaccaaaacatatatcaacaggctcttaacttaatttgaccagctaccgtagtagcttagctgtgttgtcagttgttacattctatataaaacttaagcttcctacgctgaaccaaattaatagggtaatacagatcacaacactacacaccttcctctctctatcagcagcctgcctattctctactctactgggctcttctccccgaaacacagggcaaaaaagaagaaaggaaaactaaacatttcgtgatacagacactgtattcgcaaagccattagctaccttttggggaggaggtttcttcttatagtttgctagactacagtgagggcagatgtattccagcccatctgtctttgcataatcctgtaaagaaggtgactcatataagatcaagctatggccaatagaaaaggactgaactaaaagttttttttttctaaccttgaaagtgcctaggccttgtcgtctgtcacaaccaaaatgtgcccattcaccacacaaaccacagttcacccaatctccaggagcgctactggaattacacaggagatggtgttagattcgattatgacaaaccataatcgcaaattggggaaccaaaggaggcatagaaagggatgtcctcaaacctgtggcaaagcaaacagcattccccgtctacatcatcatgagctagctcatattccagtaaatatgtttcgtaatgtcttttcagtgtgtttccaacaccctaaacattttaggacaaatgtgtacagttaacatttaacatttcacttaacagaatttgttgaaggtagtagcagagataaataaggtggcactttatgatgaatttacatcaaaatgaactactactccgtatatatatttcaacatagatgaaagacaatgatgctgaagctgagtagtccatcaattagttagtagcttttaccagactcaccaacaaaggaaatgataaatttaatacgtgaaagtagtgtgaacaaaatggcataaagacatatgttagtggcactaagataacagcaaaactatagcatgctaaaagtggcacaggttaagatccaataagaaaatgccttcaaggttacgcattctatttgtcacagtag

SEQ ID NO: 16451 - DNA, 26213 bp, Oryza sativa
tgcttagatgtgatgacgttgttaagggccttcatagggcaacgtggctttcagcccgagcactccaccttggagactcagcatcacgtccgcgtctgaacctatcaaaacctgaagatcacgcgttcaaagaggatcatgtgttctttgaagttatcgagagcgtgtagcgtggagagggagagatcttggccgcactacggaggtgaggcttgtggcttccaatacgtgactttgggtatactccctcctaccctaaatgtttgacgccgttgaattttttaaatatgtttgaccattcgtcttattcaaatcttttgtaaaatgtgtaaaactatatgtatacataaaagtatatttaacaataaatcaaatgataggaaaagaattaacaattacttagattttttgaataagacgaacgggcaaacattttttaaaaagtcaacggcgtcaaacattttggaatggaggtaatatttattgaagcttctacttgatgacacatgcaccatagaccttgtatctttcatgggtcttatgcctacgtggcacctgggaccaaacaggtttgtgtctggttactggtcaaacaaaaaaaaaccagtgctcctatctgataaagacatcgaaaagttggcatagccctagaaaagtcttccctagaaggggtctcagggtcataggtaggataagtacactgttaggatactaactcttctagtggagcggccacggcaaccacaactttaggtttcaaagcagctataatggcggtggatctacttgagcggcccctggtgctagcggattggggacggctgaccgatgagcttcctacagtctggcagtaagctgcccttccccgtgccgcactcattctctcgtcccaaacactatttggtcgcttccttgggagttgttcctccacgtgttcctgcccttggcctggtgagggcaagtgctatggtagatgtgactatcacctccaaatttatctattttattcaataatgaattaagaggcaactcatacaatgtatcacctctagtatacaaatattaatatatctaatactctcacatcctttttgaaatttgtgtggaggttgcctcttgatttaggggtggctcatcatctctctcctcacttctctcatccacatcatcactcaattcaatgtggtattcttagggacaacatatgggtcattatagtactcgccctgaggccattgtgcctctgcggggatagaacagaggctagggtggacatgtagatccaacatggcaagctagggatactcactatatccccgctctgtgcatggcctatggaggattccaagagagattttgattacatgctttagaatatctttgcgtgagcatgtggggcgccactgagagatccctactcagtacgtgatcaatattagaacaataacgtgatctatgcattccatgttgggggtttacctcatcttttgtcagtgaaattcgagcactaacgagacgtcgatttttttcttttaaaaaaaattcaaacaaacaaaatgcactcaagaattaaggggaagaccggtggagatatgttggcagtgtttaccccatgaaactagatatttttttgcgaacgcagaccgctggatttcccaatcaagtttttaaaaatcaaactaaatttcaatatttttgataaaactaaaccagatttccgatttcacaaaaaccaaaaaaaaaaactgttaaccctgtgtttttttctcaagaatggtttggtgaacctcgcatgttcgaggtcgcttttgaagttttgataatagggttgcactcggtgcagtgtgcccttcgcagttcactgttgcgttgtggccgatggtgatcgattatggtatctataacgttgaatatttcttctgtcaaatcccctggtagagaagtgtattttagtcccagtttgtaaccccatatagttccagtttactatcaatccggaactaaagatcgctatctttagtcccgggtgaaataaccaaagatggcccccttttcttttttttcctttttattttctcccgaatcaagtggcatgcaaatcaccaaatcaaaccccaaattcccaaatcaaagtaacatccgaaattcacatcacaaatcttaaagttacttatacacacaaatcaaatacatcacaaatcctaaaaaataacacacaaatcaaatacatcacagatcctaaaaaattacacacaaatcaaatacatcacagattcatacaataaatcacaaatttatacatatcagtgaatcacatattattaaaaaaacgaaaaacgaagccgctgccgccgctcgccacggccgccggctgccgggcgcagcctcaccggcctccggccgcctgtccgccgcccaccggcccgacggataggaaggggaggagggggaggagaggaggaggtggaggagaggaagagagggtagatttgtaggagtggaggaggagaagaagagaggcctgtaggagtggaggaggagaagagggagagattcgatctatgtgttgcgattgtggaggagaggataagtaatagggattatatattacgcgttcacttgatctttatattagtcccggttggtattactaaccgggactaaagtggtaatctttagtcccggttgatgccaccaactgagactaaagatcctcggcctcctaacatacatctgactggggataaaccgatctttagtcccggttgggaatcccaaccggaactaaaaatcataaaatggcagtagggttttcaaccgggattaaaaatcatttttagtcccggttctttttggaaccggactattgtggttttagattgatccagcaaatatcatttctccactaatgctagttcgataacgtatgcctcttcttacctgattctaagaggcagtgtatttagatgaccattgtcagtgttaagttactcgaactaccccgggacagagatgacagaattagaataatatatatttgcacccagattagcaatgatctatctctgggcagccgttatcacaagcccagctgaagccaaaatgacaacttgaattgctgcccaaagtccctgtccgccgtacattttggctcgtcccaacgaaggcgacggcttagatgcgtcccccgtcaattacatgtactatctccttgcaattgccaattgcaagcaaaacgacagggaattggtacccgtttgtttacccctccgtctaaaaaaagctcaatcctaactacgaatctggacacgtatatgtctagatttatagctagagtttatctttttttttttaaggacagactggtatgtcggacgaccttttctatcgccgagcagtaagatatatccaatcacactgatcgagaagtttactgttatctcgtagaagtggctgccattcactggatccgtcttcagctaatcgctagtgatgcctcaagttggtaagccgaacacgtacgagagcaaagttgccagacaaatttaaggcttggcgtttcgtcaaagctgctggattaattagcttagctctgctacttgcgtcgagttgtcccatccatccaagcttggtcaccactaccataatgtacgtactgtttgatgtgctcgacacggcgggaggatcaattcgttttgtattgttgattgggtgatcgatcgtttttcgttaggtgcagtttggcgagagaaatgttactacgtgctgcaggtagcacgcactcgaaaatatctgaagatacatatcacttgtcctcgtgatcacctcatctatgcgatgatgatgatgattcataaaaggttttgctacatgtttgttcacaaattttctttaagactttattaaatataaatactacatctatattttaatgtatgacgccgttgatttttttttcaatgtttgaccattcgttttattcaaaaaaattatgtaattatcacttattttattgtgacttgattcatcatcaaatgttctttaagcatgacataaatattttcatatttgcataaaaaaattgaataaaatgaatggtcaaacgttggttgaaaagtcaacggcgtcatacattaaaatacgaagggagtacaacgtaacttgatataattacaaagtaactctgatgtaattttaaaccgttagatttactttaatatttgtataagaatggatggaaaaaatcacagtgcaggcacaggtaaggggatttgatcccgtgaccttcgcttggtacaaatagcgtgttacgatgtgatttttgaaagttacgtgtgagttatactatagttaaatacaagttacaatatataattaaagaattatgttatacttacgtctgatttttttagagaaaattcaacgttaaatgtgtagacagccccatcataaagggcaccaaaaagcgcagcgttgggagccgtccgatcgcggaaatcaccggtcgacagagatttttttttttggctcgatggcgtgtgacgatccgatccaaccgcgcctccctcacccgcgttacgccgctgcatatacacgttgtccgtatccccgcgctggcggataaggaaaaaaaattggagggactcaattacactgtttctttaaccttcagctatttagaaaactttagtttatcatttatatgatgaaaaaattaaagggggtattccagaggtatctataggtctggtgggtgtaggggggactcgagtccccctgcacctacgttggatccgccctgctcgtgtctcatcaaacaaccttagccactgcgcgcgtccgccggcgtacgtacgcacgtacgttagccgcctcgcgcgccaccgccacgcgacgatttccacctccacgcggccgcgtactgccgcgcccggtacgcggtcgagaaaaaataaaaccacagccgagaggaggagacggcgcaaacgcgcgtggcgcgcgcacgccgcacgtacgtcatcgcgcgcgcgtcgctagctagcgaaacggcgccccccacccctcgcgcctcggctcctcccgcggctgcgcggccgcggacgcgcgcgtgcagcgaaaaacggcgcggcgcacgcagcaaacacgcattctgcacgcacgcacgggcacggcaacggcgaggcccccacggcggtcaggtacgaggaaacaggggcaaagcgagcaaatccaccccccaagctagtgacgacatcatatcagtggaggagggggtaataaccgagcgaacgaatgatcggtgcgtgcaagtagggcacaaacggccgggagcccaattgcaggtaaagaacgaaagaaaccggcaagcctttttccactctctgcgtgtggacagggaatgaatcatcatgactgtactacggtgtacgtgtctatactccacgcacccaaacaaacaaaaaggtgacgtgtcgtgtgtgcgccttggcagtggcgaatctagcgccaacttggtactaccacctctccctacgccctcctagtgcatactactacagacgatcgaccggtagccaaccaggccaggcaccaccgcgacacagttcttttcgtcatcctcttttccctttcctgttccttttaagaaagagctgagcaacagtactgcggtagcacatgaggaagcccagctctcgctgattaacacaatcgctgacagattagcagtaagtgtatataagccattcaatctcctcaattattttcatcaggtcctaatccagctgaattaattgcatcaccacaccagcagtatgcatgcagtgtgagtaggggtccagtattccaatactactcactccatcccacaaataacatatttttatgattatgttgtttgactatccgtcttatttaaaaaaattttaaaaaatagttacgcataaagtattatttatgttttatcatctaatataaataaaaatattaatttctaaaaaaataaataagatgaagagttataaaagttgtatcttaaaaactgataaatgtattttttatgagacaaaggaagtagtagtccataaggaatcgtctaattgttgctttgtatgatagtgtctatggaaaggagaaaagaaaaggagggagagatctacccaacaaattgctggtcactagggagaggtgagggcgatgtggcaggggggaggagggagggggggttgagttcagtgaacctggggagggagtgggatccatggcacggcaaacggacgccggaggtaggcatcaacgctggcaagtagcagccaaccgaagcactcatcgatgattatatttgcacctgtcaatgcggtccctttctgacccccagcacaagtgctttgtgtcctcatcgtcgatgttcacctctctcctgcataggagcaacatcttgcttgcttagggagcttaaaattctgataagtatatcgtgagatcgaagccagctagtgagaatatgaaaaaaaaactgggttttccaacttttgagttctggttattttttttggatttcgtaactataaattcttagaatcattgaaaaaaatctaatatgtttgagaaatctacaggtttgaaaagaaactacatatgttaaaagttcatccaaaacaggcctttctttgattacgtcttcagaaatcagaaatatctccatgacaagagggtgtgggggctgtgggcgttcgccgagacaggctagaacgcatgaactttacctgattctcgtacgtggttcatttccttcgttccaaaggagacttcaaacactgaattcctgtactctcaattgtcaccgtattgttctattatgattttccgttgttgcaaacggctcctaaatacgagacatgaacattcgtcatgcactagaagtccaagtgcttacgaatgattttttttttcttagctgattcagattctgaatttttgttcaaagatccgtgtaaactctgccgtgccgatcactgccctggtaaaataatttaaggccggagctagagactttctgagagaaccacttggcggaaaatggtgatcagtgaaaaggttagaatccttaaaccacgatgcaactgaacccaggccgtctctgtcactgactatctctcatggcaataattcggagaggaccacacccaatggcaagagccagaggagaaattcccaacttggccaatttgctccctagttttcgatttgttgtcagaagcaaaatctcgagatataatccgccatgaagcagactcgccctggagcctgaaatttctgccttaagccataaacattggctacttgctgaaaagtacatcactaagcatcgcaaagacgaaaaagataagctaacagctacgagtaaatgaaagactttgtggttgcagatccgaatgccaatatgataaagcaaaaccaggaaccaaatccagtgtgcaaatgatcttatttaagctttttttttcaggtcacagtcctgtagccaatcaactgccccagtattaaatcttcagcatcaaagtataaatatagcacgaaagaaaagccaaaaatcagcttatgccttaaccaccgactgctcagaatatacattgctggaatgagacacaaatcattcccaacaagtaagctgggcaagacaaataagctcatacatcgttaacatgtaagcttgattctgtcttgatttctctagatttctgatgtcacacactagctgttgacattccagaaaagcagaactgcacaggaaagcgaaagcgagcactttcaaagttgcagattgtagatacgcaatatgagcacaactatataacttaataagcacattacagcacacacatggccaaggcagttatttgaatcagtctccaacatacttcaaatcatagaccacaccatacagcaaacatagtataaacattgtcatagagagtacagctgatagcagcttgtaatattctagcattactttggtagcatccctctacaaaacatagcagacatcaccagctcttcatcttggccatacacattcaacctgacaagaaaaccatatcccattttacaacatatgtaatctgtacatgaaaatgtatctacaagaaatcaaaatagtaggtagtgtggagtgccttacatggtttgctagtgacagaccacactgaccagaacatttcgtctcctcagtaggcaccagctgccatgagcagctcatcaaggctccagatgccctcgttgcttgccccgtcttgtgtagcatcattttgcagaaggttgtccattgattcatctgagctgctctcaacataaggtaatggcaaatacttcatctcgggatcgaaggtgggcatgttttgtgcgagattaggcatgccatttccctggggcacggcgataccatagttgttcctcattctctttggcgctccacctgtcaggtaagcaggttcaccatatgctggcatggcagcattaggaacgaagactgaagtgtagtctggggtcagggtgtcatcctcccaaccaaagtctgaagagccaaatgagttgctgctcgtatcagagagcatgttcatctcgaatgtctcagtggaagcaagaggtttgactggaggcatgagatcaacaggctctgccggctttgcaggcacctttgcaagcattgcaaacaaatcattgtctgaactgtttagctgaaagaaagcatcatcgccacaggtcttcagaggtggagctagtttctcttgcttggcagcgttttgcttcagggagagcttctgagcaacagctggttcatcaggaaagttgaccttggctttcttgccacggatcttgcgggcttcagcgtcatatgccctagctgcctcctcagcagtgttatatgttccaagccaaacacggacacccttgctggggtctcggatttcagctgcccatttgccccagggacgctggcggatccccctgtactgattcttcctcttgtgctttgctgatctagcagtaggtccatcatgttggacaagctttgtagtcaacatcccatctacacgaaagcttatttgttagtatacatctcaacaaacagatttggaagaaggatataaaggaaatatcatagctataaactgtaagttacacaatacactctcaagcaacatgaagatgaagttatactggatgttcacagacaggttgagacatgaatcagttcaattgatcacttctcaaataaatcatgacatatataagaaatcttaaagtccatgaatatagcaagcatatggtgtaagcactgtcaaagtgtagaactactcacttgccctatgattaacaatagataataatctacatatactgtctacagtagtcatctactcacctgcaacgttctatccaggaatgagatctcagatgcataaaactaacgaggtccctctgagggtatattttgatgtagctcaaaatcaactgtacaaactactaaattagagttccttatattcgttagtttttttaaaaaaataaaataattctttaaattcgtatcccttgaatgagagtacgagatcaccaacaaagttcaaattaacaacctaaagtttcttctgtttagaattaacaagaaaaaaaaaagaagggagctttgacagcatcacctaaagtttcttctgtttagaattaacaagaaaaaaaagaagggagctttgacatgcatctaacaatctatataaagagtggaacaactaaagaacccatcattttttttatttttagataatactacagaacccatcatactctgaaaactaacagctaaatatgataaatcaagagtacaagaaaaaaatatgcctcaaagagtactccaaatctcaagatgagatggtggcacagatgaaactttgccaaggaaaaaaaaaaggccattaagttttgcgtaattacactactagatcacttattagaaacaaagcaagtaaatccagcgacagaagagcatccataaacataggttaatccaagaacatactacaactctacaaagccaaattttctctaatccaacacaaatattagtgattaaaacacataatgacactgcgaaatcacaagaataaatatctaaaactcatcactctctctttgctactccaattcaggaaaaagaaagaagagtagaatctaggacaaagttgaattcctatttcgtagtgtaaattcgtaaaccaccaaacctacagatgctatccatctaaaagaaccagattcgctagcaagtttacgtacacaggtattaatgaagttaagaactaataacacgctagattgaagaaaaaaaaactatactacacagtgccgtcccatggttcgcatcaagatcaaatccatggcgcaacctgatgaagccccatttggcagctaccccatgagaccccaattctctccccaaatcacacgaagaacgcaagaaacggacccagaaaaaaggccgcatcttgcgctcgtctaacgagaaaagggggaaaaagagctagctttatgcgttattttttcacctgcagttgggggcgccgccttggccgcggcacggacgacgaacctcgccgccgccggcggggggaccaccacgaccacgtcgtcgtcgtcctcctcctcctcgccgccgcccccctccgcctcgtcgtcgctcatgccacgctcgaactcgcggaagtcggcctcaaagtcctcctccgccgccgccgccttccccttccgcagcatccccggccacagcacgtcggccgtgaccctcctgccctgctgcttcttggccaccgcagccgccgccgccgcagcggccgacggcgggatgaacccggagatgattgctccgccgcacatggccgctaataagctacagatcaagaaaccaagaaagataaatcgagaagaagaacgcagtgaacacttgctgccgctcacgcggagggcgcagtgggagaggaagccgggggtggtgggtggtggccgctacttataaccgcggatgcagctgacgcgctactcgacagcgacggcgtaatcaaataaaaagaaaagaaaaaaaaatggaggaagaggaggaggaggacgaggacgaggagtggaggagacgagctctcgcgtcgcctcggtccttttttaccccgcctaattaccaacctcctcttctgtccatgatgtcactacaaccactaatcaaaagattcctcggtaaaaacaaaagattcggccacgaacagggatgaacaggagagggacggtgtggtaagaatttttctccgaggagatattttgggatgatttttactatcagctttttggagcgaaccagatcatgtgacgaactgccttgcatggtgtcatcacggtatcatcctcctcttttggtttttcttttctttctttttttttttgagatttgggaaatgtttgctgcgagaaggaacgcaagatgtgtggggcgagagccataaccgatgggcggcaccgaattcgctggtgctgttttttgtttttgtgttcttgcttcgattggtggtttggactttggaggattgcttcgctcaagatcgacaaaaagaaaaaaaagaaaagagaaaaaaaaagttggtttggagtttggggttgattgaattggtttgacgtttttaatcatttgacgatgctttcatttgcacggttgcatagtgttttgtttttttccctcttttgttttttaaagacgattatggaacggaatatcacaccaaaatcaatgtgggaactgatcagcagtgtatcagaccccattttgatcatacacatcggggtatctctaagtttgtcttaaatgactttttcttcgtttcagggtatttttcatttggctttcaaataaaagtaaaagtttttatatttgtatcattatcaatttgaaatcgaagaccggaaagtaaacttagatgaaaaataaatcctataatcaaagcttcaaatttcaaaatttggaagctggtggtcagctaaaaattagatgatgagagtataagattaatcggattagctagatatgtcaaatgcgatttattttaccaattagttgtgttttcgttcctgcgagcctaccaagcttaccaattagtgaagtttgtgtgatttggtttgtcctatgtaaccatttgctttgtttcaggttacggtttctacagaaactatgagaacaataacgtaaagctaaaacagtctcataaaacttccatatacacctaatagataagatgatttggatttatcctatgtgactattgtttcgtttcgggctctataacatggttcaacaaaaaccatgagaacaataacgtagcgctaaaacaatctcataaaacttccatatacacctaatagataaggtgattttgtttatcctatgtgactattgtttcgttctaggttctataacacggttcagcaaaaaccatgagaacaataatgtaacgctaaaacaatctcataaaacttccatatactcctaatagataaggtgatttggtttatcctacgtgactattgcttcgttccgggttcttctataacacggttcagcaaaaaccatgagaacaataacgtaacgctaaaacaatctcataaaacttccatatacacctaatagataaggtgatttggtttatcctacgtgactattgcttcgttctggttctatagcacggttcaacaaaacccatgagaacaataatgtaacgctaaaacaatctcataaaacttccatgtacgccctaacacctaagacgatttggtttatcctacgttactagtgctttgttccagttttttataagacggttctatgacaaccatgagaacaataatataaagctaaaacaatctcataaaacattcatatacacctaatgtgattaggtttatcttacgtggttattgctttgtttcaggttttatgacatggttctacgaaaatccaagagaacaataacgtgaagtaaaaaaaaatctatgaagcttccatatacacctaagatatgagatactctgtattggacaaccatacaaaattttgcgatgaaacttaaattcatagcatgatattaaaatgacaaacaacaaacaaaaatacagaagccaggattaataatgtactccctcttcaaaaatataagagattttgggtggatgggacacatcctagttccttgtccagattcattatattaggatatgtcacatcatccaaaatctcttatattttggaacggatggagtactaatttatttgtcgtttgtccatgttaagaacaggtacaataatgggcggtagtagttctacgtaggattttgtgatgatttggaggagagctgggaagagagagagagagagagtgagtcggcgactaatttgtcatcgggttgcacgcgccgctcgaggagactgtggggcccgccttgcgctgcctcttctcgtcgccaactcctgcatcgggcatgcctttcgctgcttgcctccgtcgccaactgccgcagccactggaccgccgcccctcagcctcgccggcaccgacgcacgcccgccgctatctcccacatccggcgcacggcccctgtcacccccgcctgcacaatcgccgccgtcttctgcctccgccgtgcgggccagccgccgctgcccccgccgcctgccgcacggcagccaccgtcttccgatgtccgccgcatggtcgccgccgtcttccgcctcagccgcgcgacccggtcgccgctgcccccgtcacccgccgcacagccattgtcgtcttctgcctccgccgcgcggcctggccgccgctgtcttccacctcagttacgcggcccagctgccgccatcttccgcctccgccaccatttcctacgtccgccgccgccgtctttcatcatcgatgacaggaatcgagggaataggagaagaagacatgaactatgaggggatagaagagagagagaatgtgaggtaggagaagatggtgggtcccacgaatcaataaaatatttgtgttatagtatttctattgtattgacattagctatactgcttaagctgtttttttttggagccaacagcgggttatattattgaccttcctctaacatgaatgaaagttgtttgctattttgtgtgtggttgtctaaatcatttctctatatgtgggatcgtttttagaatttttctaatttttaacatggaagtttccaagtttctaatactagtcattaattatctcatttacatatttttaacttataaactgctcatgggtaacttctaaaatatcctggttgctttcttaaaaaaaaatcctggttgcacaattgcacgtcgccctcacatatccttttttatttcttttttgtacatgctcacatcttctcgatgcatcatgtatgtaacacaataaaaagaattcggcatggtgcatgcatttccctctccatttacccaatggattagcattatcacgagtaagtttctctatgttcatccaccatgcatgagaacaactactcgtccgctgtaaatcacatgtcgatcgaaggtttctttcccgggtcaaaaaacgttctcgttcatctcatggccttggtaatctcaacaagctgtacaaaactgccactggcacacagactggagtactggacgtatcacaccgaccaaggaggatcatatggctacgatcctagaagtgtctgcacgtaacaaattttggctgtttttgtgacaaactatcggcttttgatctttcccttcgtagtattttgttggattatactccttattttccaaaattcttttttatttttttgtgtgtgtgggtgtgatgagtcgtatcgtgactgaatggtacattcacgcatggatgctcatctacattgcacgccacatttatgaaatcgacaaaagcagctactcctcctgcctaaattgcaggccgtgtcgtattcagaaactgtataaaaacatgtggacagatctttttttgagaacatgtggacagatctgacatgctcctgattagctgtactgtgcattgtataatatactccctccgtcctataatataagggattttgtgtttttctttcaacgtttgatcattcgtcttatttaattttttttttgtaaatataaaaaacaaaaaattgtgcttaaaatactgtagataataaagtaagtcacaaataaaataaataataatttcaaaaatttttgaataagatgagtgatcaaacgttgcaaacaaaaactcaaaatcccttatattatggaacggatggagtagtactaggggtgtgtagttccacgctaaaattgaaagtacgaagaaatttggaacgatgtgacggaaaaattggaagtttgtgtgtagaaaagttcgatgtgacgtttttttttcaaactttggttctaaacacggcttatggttgtgtttttcgtgtgccaatttttttcttaagtatacgatcacacatttgtagtattaaacgtaaactaataacaaaacaaattaaagattctgcctgtaaactgcgaaacgaatttattaagtctaattaatctatcattagcaaatgtttattgtagtatcacattgtcaaatcatggcgtaattaggctcaaaagattcgtctcgtgatttacatgcaaactgtgcaattggttttttcgtccacatttaatactcaatgcatgtgtccaaacatttgatctgatggaaaagttggatgtttgaagaaaacatggcctagtacatatgtacacccttcgtcccagaatatagtaacctagaaccggatgggacatatcctagtactacgaccccctgtctagatttatagtactaggatacgtcacgtccggtcgtagattgctagctatattatgggacggagggagtacatacagagaggaatttttgactcaattgtttagttttttcttatatttttgcctctgtaagcaaactgagcaagcgatagattgacttcgattacaaaacaatactggagtacatactctgaacatcttggattcagttgcagatagtgtttatctgtttatctctccaatatacaatagttctaacaagatcatggcagatactgcacattattgcatgaaagttcagcccatccctctggtttgttggacaagaccatttcctcatattttgcagctcaagggccaaattagcagaggtcgtcattgtatttcttattcttctttccaaccaacttgatttttatatctatactgtatttgtgtgaaggaaatgtcacccaactgaaccatacttcgctgcacttctgtgtccgtatccggacgtcacctttatttttggctttgtcttggtttggcatttcgcatggcacttgggagcaccacagaaatctgtacttctttagttaattatatgtcatcaaacttcatgatacattgaatggaacaagatgctgaatttggactatgcattagtgtgtacaatataatttgtttaaagaagtgatgaattccattggagcaattataaatcacaccctttgcctgacgaagagtccgagaatgtgtggtgctgtggacaccagcacagtgtacatttagatgtcttggatggcaccagggccgtccattcacgagggttcccccgtacaaagttctaacggagacataaactcaattgacgaaataaaatgataataatttatacgcgagtccatgtagtattttgtagcaactaggaagatagctcgcgcatttgcgcgggcatgtgtgttaagttgtttcaaaaacaattataacaaattaaatttaaataaaaagtaagatgcttttttttttaattgaatgttcattctctctcttttttttctgtagaaatcttgaaaaggttatattgctaaatgctgattaatctatccgtcatgctggtcctcccttttcaatggggctatctttatgatagaattttacttgtatatgctataggtgcatagtttcagcgaaaaacaattagaggtaatgtccttacctaatgaaatataaacctaacctagctactactacatttgtttactcatgcccaatctgaataaatttgtaattgcatacattcagtatatatgaaattcttacgctctctggatttttaaatgtccccaaaagcatcaatgaattaactttattgcacaattttcaatagggtatttagtagtttaaaattaaataatgatccaattttcaaggtttcaaacaaccaaattttgcaagcaaggacaacacaaaaatatatgtgaacaacccttatgcatctagttgttgtattattcaaaccttaatttaaggattaataaaattaaattcatttctaattcagatcaagaaaaaaataattttgctaaccctaaggcatataaatattaaaactattattatacgttgccaaaattaaataaatcttagaggattaaataaactcatataatacaatttattatagctaaatcgattgcaatgttttgatttgaatttgcatggattgagatatatcgatatgtaatgttagcattagcttatttatattgtaaatagaggacatgcaaatttgtataagagaatgcagactaacctcatcatttaatatttggttggatcagataaagtcaactcatatatatactctctctatctgggctcatagctaagattcagcaatgcaataagtgtcaataaagtttactataaacactaaaatattaatcggattcagtaagacaatcaattaatgcgcgcgttaatgaggcttatgacaaaattaaatttgaatattatgcctaaaattaagtggtagacggcatgctagttgatagcgagttgtgtgtggttacttcatcgttcataggatttgtcagcctaatctcttaacggtgctcaaagatctatagtgtgtgtatatttatcgaaataagtgtgtatgtgtgtgtatatgaggcacatttgtgcctcggaaaaaaagtaataggagttaaaataaatgcatgcatgtgggatcagatcaatggctttaattgattgaaagtattttgctaaaccaaatagtatacttactcatcaccaagataaagcagctaccagagaaactttacattgatcgatcatgcatcttgtcgcattatctgctgctatactttggccacatgcgttgctatggatgcccatgcaagtagccaagctgccaacgtgttgcacgaatgcatgactaattttcgtcttctcctgtatgcatcaaatcccatagatagttatttttttagataatcagagataattatagatgaaatcaaatcttgattgaggaaacaacaccagagttgtaaaggatttgtatgtagtggtcatcggtcctcttgcactcgccgcgtcaatatgaatagatcgatgaagctagggcgcgctggcatacaccgagagatcgtcatggccagccggccgccgtcgctaggtttggaacaggctccatcgctgtttaaaaatcccacctgcgccgtgttcctatctactaatggctgaacgattgatacaaggataatgatcggttgttgattggatgcatccacatatacgtactacgtatgtatgtacataacaaataattataggatagatctaatggttaaaaaaaatgggtccaccaaattaaatcaaaatagatggttggatgttttgctttcttttttagaatttataggactttctttaatttattagagcgccacgtgtcggcttaagaacgtttgtaaaatgccacgtggcggcttgagagcgtttgtaggaagtttaatggacttttagtatataatagatagataatagataatagatagatgatagatagatagaagatagatagataatagatagaagatagatagataatagaagatagatagatagatagatagatagataatagatagatagatagatagatagatagatagatagatagatagatagatagatagatgtaaaatataacacaatttagttatgaactattatccaatattcgataatttagttcgaatcaaagcattaatcaaaattagagaactagactacacaagaaaaaggatttggtggatctgatgcctgataggtgactacgtttgctgttggagttttggggtgttacggtgcgccgtgctctctgcaggcgtgttgcacaactagccagatagagattaaggcacggcagcacgtcggcaagtagccgagcacagagcgcgtcaaccgccaaggatgatccagctacaatgtactcccttcgtccctaaatataagaaattttggtttgacgtgacatattctagtacaataaatctgattaggcttcatgggcatgttcggctgccggcagccccggcacgaacagtgccgcactcactatgcgcagccgcagccacagccgtagccgtcgcagtcggcctgccaaacaagccccatattcagattcattatattaggatatgtcacatccaaccaaagccccttatatttagagacggagggagtagtcaataatcaatcgagaaaacaaatcaatgctcttgatcctaggaaatcaatcggagtaacaaagttcacaaatggtttacaaaaccaatggtaatcgtgcttaccatcgagtataagtaaagataaaaccacaatagccacaccaaattcagataaatttcaaatataatttaaatttttaatttgatatgatttcttacagtttgctgcggttaccgacgataacatacttattgtcgggacgaggtaactccatcccgacggcaaggaaaaacatacccttattccattcgctacttggtcttgttggcatacgtctattcatatacgcagttgataatttaaatgggggactctgaaattcgggagcctgtactgtcccatacttcactcgtccttgtagatgggcctaaatgacgcttgaaattatggaaaaataatactcaccataatgtaaggtaggagtggttcatagtacagtagtactattttcacaagactggtagttcaaagaatggtagggactagggagacgatgaatcgctgaaccgaacaaacctcttcctacttttgccgctaacataagacccggtcatccgagaaaatcgtcccacctcattcattttaaccacaaattttgacaatttgacactttgcaaaaactatttttacaaatgaactgctgccaaaacttatttcaaatatgacccttttgctcaacgccaaatcatgtggcgctgaatttagacacctcagagccacgtcagctagtgctgaatgccgtgccacgacggatgggagactaaatcagcgtgtaaacgtacattcagcgtcatgctatttggtgctgaggtgtttaagttcagcgtcacacgatttggcgttgagcaaaagggtcagatttaaaataagttttggcagcggttcatttgtaaaaatagtttttgcaaagggtcaaattgtcaaaaattatgcattttaacggtcttcagattttacatggacatggtcatacgagaagtaggtgtcaaagtacataggcccatctttttctcgccccaatcgtaacttcaattttacgaagatgaacagataaagagaaagcgacgagatcggtgagacgggacctcatcacaaatcatacagcccgtgaggacggacggacgcgcggttgagcgaatcaaagctcatccgcagcagagcgagtggcactgtggcatgtacaggcctacagtgtacaggagagagagaggaggttgaggcgatctctgcggctcccgttattacacgcgtgtgtcctgtcccctagcagcggtgcgggcgacttcctttcgttgcggcgacgcgacgcgcggtgggatgatactgggacggtggttttgtgttgtgccgcggacagaagaaccgcggcgatattgcggcggccgagcctgggcaggggctagggtggtagtagtacgagtagttcgtgggctgttttgccgacttcggttttgccgtgccgccgcagcgcgcgcgcggggaggcggcaacggcgatagcccctggtctcggtcgcccgccgccacacccgcggtcacgcaccaaattgcggcgccacgcgcccagcacacgcggctacggggaggggacgggaaaaggttgtgccgagtgccgacgcctgtgggggaatatctcgatttgactctcctaaacatataatctaatttatatccttgaagcacaataccgaacatcttaatcttttaactattaaaacatgtataatttaacttacttatcgattttggagagcggcttatgtcattctcactcttcccttttatctctctcctccttatctcccttcggcccctcctatctaactctcctgcactaccagcgccactacctccactgcaccgccagcgccactaccgccactcccccatctgccacttgcgaaggatggcctagatccaggtgcctgtggaggagtcgacgacagacattgccaaatcggggtcatcaagcccgccgagctcttccttggctgttgatctacattgacttttgcgccgacctgctccatcacgtcgcctctcataagtcataactggactagcgcactgccgtcggctgtatcttcatctcctgagctccgcgctattctccgtcctgacgactagccaccgtcttcgccatggggaccccgccactgcccagggagcgttgtctcatcctcggatccacgccatctctcttgaccagccgagcgcaccgtcatcaggctacatctccatccctcaagctccgcgccgttctccatcccaacgaccgctcgccgttttcgtcgtggggtcccctcccctcccaccgtctagggagaaccatctcctcggatccatgcccgggcctccaccctcgtcagctctgttgacacagtgataaaagtggagaaagtgtgtggaatagagaaggagaggaagagagagggggagtatgacaagtgggtccccactttattttttaatttttttttctgatgactagtatgagacgtgaatgccaacgctctcaatactgtcctaggagtaaaattgcaccgttttaaaatagttggaggggttttcaaaatatccggtatcgcggttgagtgacatacgaattgaattttacccataattgaggggcccgacttattcccgcacgtggccgtaatgttggtccgtcagttacactgggcctctctgctgtgtttcggggtcgcgagggccgtcgatggacggcccagtaggccagtgctgaaggcccacacagtttccccgattccccacccgtcacggcgccgtctgcagtaaacggcaaagtcctcccctccgtctccgtgtccgtcgacacgccgccaccgccacgggggttggggatttctttcccctcctccaagccaagccggacgcggacgccaccgccctcgccttcacctccatttatacctccggcgagcgccgcggcggcggcgacgcacgcatccttccttcctcctcccgcaccaccggcgaccggtaaaacggagagacccgtgggcgagcttgttcgaggcggggcaccaccaccatgtcggcccccgcggcggtggagcagcggctgcaggcgctgcggcagaagctggggaggaagcagcacttcgaggaggccgtcgccgacctcgccgccgcggtccgggaccaccacgccgccgcctcccccgccctccgcgatttggtaaatgaggccgacctcccctagccagcgccccccccccccctctctcacctcacgttacttcccgatttcctttcgttgcggcctgggttaggtccaacgtcgccgccgctgtggtaatgatgaatctaggttcgattggtccggtaatggagtagaattcttactctaaagtcatcatcaatgggcagaagaaattaaaatgatcttctctgggattgttaatcctattaaaatgatcttctctgggattgttaatcctatgaaaatgatcttctctgggattgttagtcctgtcgtgtcagtaaggaacacgtccttagaataactcatctcatcccaacgaaattgttccttttcttttctccaagtagcttgatatctaaatttataacaagaggctaaacgttacaagtaaataccaatcaaaatgcagtgaaatcagtacgtacccatcaaaatttacatattcttcaagctagcatggagcatggttaaattcaaagcaagcaataaaaagaatctgccggagtagtagtttattataatccaatgaatcggcttggtaagatgtgacgttaacgttaacatcgcccaattcacgggaatcaagaaaccgaaataacgatcaccatgaacgattggaattatttgtagacagaagtagcgatgagtgacagagtaatctggctcaggtgtttcctgtggctttatgcacactcaatcgagcaaatgaggaatgacatacatggacagaactatgctaacaaaagtgatttccttggataatactaatccttttgtttcattatcttctgatgaagtaatcctgttaatgtaaaaacttctgatttttttaagttaaggttaacttctgatgctgatgcttttttagttaaggtcgtcctcagggattccatttttgtgtaccagtataccacacccctacaatcagttgtttggattagcattcttttccatactctaccttcattaatatcatccatcatatcgacatatataatgctcatttagcacaatcttttgttctttggcagatgtattctacagtttgccgtgtggcaactgtccttcagactagatatacagcacctggattctggcgtgctggtctgaacctcttcttaggtacagagaagctggtaactaatccttcagaaaaggagcaactgaagactttcattctgagggcccgggagcatcttgatgagaaagagaacgaggaatccatgccaaacaacagggaaacaggtatgtcattaataattgaataggatgatgtgacattcatagacacatctgcatacttagattggctatactctaatgattattctggaggcaacctgtgatgcatatgcaattaaatttatttcttggtgaaattgataaacataggagttcttcaagtacatatttgtctgcagtgtattttggtgaaataaactttccttaaaatattcacccttataaatatctatttgctaagaagatgtaaacttttttttccagatacaagatttctttttgaagggcatcttacagtgggacctgaacctccacctcctgcctggcttgttgcccagaatttagcacgagaacttagcattttagctgaaccttctggagatcaaggtgcgaacaacaacggagagtccagggctgaggagatggcacctgctgctgctataatgaatttcttaaacaccatgacagtggatggagacctagaagccgctttggaagaatctctgcaggtaagaaagaacaattcttgagagaatcaatttatttggtatacttatttcattattttttcagccctgaacttctatgttagtttcttgttgcacttttgcacactgcaaactggagtagtatccaaactgtgcacaaccataggcttttggcccatgttaggtgctatagagaaacaagcaaatttgataaatttgttgaatgtcttgatcagtggtttgtaaaatgatttttcaattactagtctgctgcgcattcaagtgctgatcaagttgctaaaagtggagctcatcatgctttgatgcatgccaaatttcttcatgttattatgttattgcaattatcaacttggtttagacccacattctcaaatttatataagcttgtcacttgctacaacgagaaggatatacttgtatctcttatgattgtctagtaaccaccactgaaattcttcgaaaatggaaagcccgcatttcatcattttgtcattcagttcaatagggtaacaagatttgcatattgttatggatcttgaatttggaactactattttcagaatgtgatggcgaatcctaaggtgcctccagcttcaaaggaagtcgttgcgaatctaccagttgtaaccgtgacagaagaaatcatagctagattgggcaaagagactcagtgtgctgtttgccgggagagcttgctggtggacgacaagatgcaggagctaccgtgcaagcatcttttccaccctccatgcctcaagccatggctggtaatgtccacataacccctttgaatcatctgaaagtagcctcgacgcatcgttacaactcggtgtagctgaacattatacccatcatggttgtgttgtgttgcacgcaggacgagaacaactcctgcccgatctgccggcacgagctgaggacggacgaccatgtgtacgagagccggaaggagcgggagcgagaagaggaggaagacaggaagggcgccgcgaatgctgtcaggggtggggagttcatgtatgtctgaacatctgaatttcaaccgaacgtgattatctctctgtaacgatttcctgaaattcagagtgcactggagttgaaaattcatgtacaaacaacgtttgcttcggttcaccaccgtatcttcgttgaatgatactaccactatacagccagcttattacagcatcattgttcgttgatgtgcatgtgatgaagtacttgagttgagacattgttattcttttattccctttttacacacagtattcagtcgcgttagtctccttcgaatatgggggtggtgagataacggatgacgctgatgataactattcgatgatacaaatgaataaactaagcattgtaaagttaaattttattttaacaaggtttcctaaagaaatagaggactaagattttttttaagagagattgtaccgtcgagattgaacaaacgcgaactatattactactgtagccgttctacgagcttagtagcactc

SEQ ID NO: 16452 - DNA, 5118 bp, Oryza sativa
ggtatttctattaccgtacctcggcgataagaccggtaaccatggtaaccgcatcgtttatcagtaatgtaaaacctggtagtagtagcctagcagagtaggttgtgttggtggtcacttgaaaaattgcgattccatgggctgatgcccttacgtgggcccaccacccacccctgacgagtggggcccaccaggcagcgaccccatcacacgtgagaagtccagtccacagctcgctccatcgctgcgatttgcaacacggcgagacggatcaaacgggcgcctgcccccacgaactagacaagcagcaggtcaagcacccaacccaaaatcccagagaaaaacacacaaacaaaaacaacatacaactgcacacaccctgccgatgcagcgaacgtgtccaaataaattaaaaatcccccaatcgatcaatatacgctgcaccacaccacatactcaaaagaaagaaaagaaatccccccaatccccatttccagcgaaatctaatctaatcatctaaaaattcccttcccttcccttccgtccgagccagagcagtagtagtagtagaagtaatgaggaaaagaaaacgaaaagcgccaagaaaacaacgcaccaacacatccacagcagcagcagcagcagcaagcatcatcggctcaggcttcatcaggagaataggttagatgtgagaggaaggaaaaaaatccgaggaaaagtctcgagcccaccccccacatctccactgctgcagctttgcttgctcgagagaaagaaagagagaaagaaaataaaataaaaatctctcacaaatctctctctcgcagccgtcaaaatccaatcttggcgcatccccggccgcctactgttctcgccccccctctctggtaataattgtcaggctggtggttggtttgctgctgctaataatcgagtcttttcctcccaaggagaggcgttcaatttcttggtcaggatttgtggaggtttttcttggattcatttcgtcatctcgtcgcggagccaaagcttttggtttttttttttcctttggttggtcttggctcgatcgggatggatgcggggtgggttgggctcgcgtccaattcgcctccaccaccacaagtacgcttcttttttattgtttccggagtggggattgtagagagctatttcggcaatcgctagggctccgtgtgtgttctctctcgcccactttactctttttttttctatatcattattcccctttgccctccaaatcgaatcctctctcccctcctgcggcgccgcggggagggagcgatctggggagggggaagccgtcgattgactcgattctgtgtcgcgggggctccgattcggcctctgaattgcgccctggtatgtttgccccgcgtcgattcgtgggttcttgccgcggatttggttggatttatttaattttgtgtgatttgttcttgctgttgttgtagggttccatgagggcgtgaggtgaagttggggaagagagagagagagagagagaggggggtagggttgctgcggcggccatgtcgcaaatccagagcttctcgcggcagaactgcgtgctcctcgcggtgctgtgtgggaagcacgctgagaagcgtgcccaggcgaggtcggggctggaggcgaagcggctgcggccgtcgtacccgttcccggagctcagctcgtcggggagattggaggtgagctagcattctcggttggtgttgtggggggtggtgatttgttttgttgtgcgagctgaaaacgagggagattttcgagtgcaggtgcacacgctgttcaacccgacaccagagcagttcctcgaggcgcagcgcgtggttcagcccaacttcttgtacatccaggggcaacagcttgaggatgagaaggagattggctcgctcgtctggggggacaatgacgtatctgatccgcaggcgtttagttgtctcatcagcccgccatttccgaccatagtaagcacaaaccttttgtcgagcgtatgcaatatttgtactctttagttgaaagagcagtagagcaacctttcctttgtctactattagctgttaatggaaaaccaaaaaagaaggcctcacaactgcatcatttcctagttacatgatggtctctgatatgttctgggcaccacattgtagtgccataccatggtatgtgagaatttgaaaacttcctctgtccgggtggtgctaaccctgcttaacggttgtcaatacaggtttatctggaggttccaattggtgaaaaacttgctcaagcagttcattcaaaggtagaagtcttccattttcctttttcaatattccatcttgttaatcaaccaaaccttataacatcgttttgagactgtagttcgttcagaagtaccaaacgttttccttttttagtctgtctcatttagatcatatcttaaccctacgacatagtagtagtacagtgctagtagtttttcaacaaatgtctagactctgtaggacgaaatttttgctctatagattcttttatctataaacaagcactgaaatgttgaacaaccaagtatgcagtactattttacacatgacactatttggaatttagcagtggtgatgtttcatttcaggggattccatacgtaatatactggagaaattcattttcatcatatgcagcatcccattttcgccatgcattaatgtcagtggttcaaaggtaccagcatccttttccctctctaccatcatcatcatatggcaataacaactaataattttcttgtatatgtagttcggtgagccatacttgggatgcttttcagcttgctcatgcatcctttcgattatactgtgtaagaaacaaccatgtacaaagtgttaagcttgggcctcgtctactaggggatgctccaaagataaatataacccctcctgagaatgagatggttgaggaggaaggttcttcagatgtgtttccagctataaaaatttatgatgatgacatcaacatgaaatttcttctttgtggagttcctagcacaccggtaagctttggtattttatatccaaatttccttacatcttatttcctctattgtacgaattggtttaatggtgttgttaacctcttctcttctgcaggatccttgtttgttaggttcattagaagatggcctgaatgcacttctgaatattgaagtatggaataaagcattgcagctctactgtacattgattattttttatggaccatggagtaaattttacactatttcctgaagaaaagatggagtataatgattctatgagcaacctttgttttagataccttaactcaagtttgaagaaactaggatctcagtatgttagatactattgaaactgttctgtttttttaacattacaacattttgttttcttgttcaatatttagaaaagggatgtattttgcgtgttaattgttctgattaaggaaagagagggagggagcggaaatgttttgatgtactgatgtggctcacaacagcactatgcatgaaaccaccctaaataacaccacacaaataaaatctagatagacatcttagtttcagtctacaagatgctagcaataaaatggtggttcaattttttacttggcaccaccaaatctcagactatgttgtacacatgctggttctgaaaatctgaagttagcagtccatccttttcttgtattatttcttggtcgaaggatgcaaacacatagactagcatagtgatatttgatgcatcaggatttctttagttattatccaccaagcttttatgcaagttctttcttctgtttgtgtgttgtttttgcaacttattgctctatctaacggttgatcttgtttttggcagattcgggggtgcaaacttcagaatcgaatcaggtacgttgaattgttgtctgttctagctgtttacatacccgtacctttctgtagcatactaccatgtccatgactcctttagttttgtgccatctgtcaagtttgattgtcatgcataatgctgtcaagtttcttttaggggtggacaaactgtttcagaaaatgtgtactagtgatccttttttcctttatgttagagctactaataaactgtagcttatactgtatacaatttgccttatgcatgttggagttgtcccaatattgattttccatcatacttaaaataccacttaacaaattgttttctcttctgctgctgagtatagttgataagacttctttcatatgtggcagtgcttctccaccaccacttcatgctgcatccttaccacgtggaatggttacaatgcgttgcgacatcactacgtgcagttcttctcatgtgtcacttcttgtttctggtagcgcacaaacttgttttgatgaccaggtatgaatttctgcgaacctggatatataattcctgatcttacatgtacaaaattatatggcatctacctttctgcagcttttggaaagccacatcaaggatgagatcattgagaagagccaactagtccatgctctgccaaataatgatgataagttatcatcaagtgtgcctttcacttcaatgtccacagcttgtggggcttctacctttgaagtttggatgacccttcctaagtgggcagcacaggttggataactgtattgaacacacaagatatgctgtgattagaagtgcagggtgtgcttatttgctcatatttttattcattacttggcttctctttatcttttttttttccgatgcaccgactgaaagttcataatgttgtgtaattctattgtaaaaggctcttctcatgcttttgcttttgatctccaagaacagtgattagttatgaaagcaacaaaagtcttcaatctcattatctaatcctcacatgtaaaacattatttgttaatctttgactgaccatcaatatttttatctgaataattaggttctgaagcatttagcgccagacatctcatacaggagcttagtggcacttggaattggttgtataaatggcacgcctgttgcttcatttgataggcgagatgcaggccgccttttttttttttggtacaaatca

SEQ ID NO: 16453 - DNA, 2460 bp, Oryza sativa
aagttaaattgtctaaatgttcttttgctcaacatcaattgtcatatttaggtcatattatcagtgatcaaggagtcactactgatcctgctaagattgaggaagtggttaattaggcagttccaaaatctgtcaaaaagctcaggggatttttgggtttggcaggttattataggaagtttgtcaagcaatttgggatcctttgcaggcctttgaccaacctgttaaagaaggatgttccttttgtctggtctgtggaggctgatcaggctttcaaggctcttaagcaagctttggtatctgctcctgtgttatctcttcctgatttttctttgcctttcactgttgagactgatgctagtgatgaaggtattggtgttgtgttatctcagcatggtcatccgattgcctttcttagtaaggccttggggggttaaaactaagggtctttccacttatgaaaaggagtatttggctattttattagctgtggaccattggagatcttacctgcagcagcaagagtttgtcattttaactgatcaccatagtttaatgcacttgaatgaacaaaggctgcacaccccttggcaacacaaagcttttactaagttgttgggccttcagtttaagatttgctacaggaagggatccagtaatgctgcagctgatgcactttcttgaagagttatctgaactacatgtggtttccagttgcagtcctgtatggcttcaggaggtttctgatggttatcttcaagatgccttttctactcaacttttgactgacttgactcttaatgctgagtctcggcccaatttttctttgtgtaatggtgtccttcgctttaaaggcaaagtctggataggtaacaatccatctgtgcaggataagattatctctgcgttgcacagtagtcctttgggggggcactctggttttcctgttacttatagtaaaatcaagtctctttttgcttggcccaagatgaagaaacagattcatactactgtcaagacatgtggtatttgcatgcaggccaaaccagatcgctctaaataccctggtcttcttcagccccttcctgtccctgatggtgcatggcagattatcaccatggactttattgaaggtttgcctaagtctggtcaattcaactgtattttagtggtggttgacaagttttccaagtactctcatttccttccattgtcccatcctttttctgctattgatgtggctcaatcttttatggtcaatgtttacaagttacatgggttacctaagttcatcatttcagaccgcgacaagatttttactagccacttttgggagcagttgtttttgagatccagcacacaattgcaactaagcaccgcttatcacccctagacagacggacaaactgagcgtgtgaaccaatgtttggaaatatatctgcgatgttttgttcatgctgttcctcataaatggagttcttggttgtatttagcagaattttggtttaacacttcttaccattctgccattcttcagtctccatttgaagctctctatggctatcctcctggtcattttggtataagggatgatgcctgctcagtacctgatttgcatgagtggttaaatgaacgtaaggtgatgactcagttactgaaacaacacctgaatcgtgcccagcaacaaatgaagctgtatgcagacaaaaagcgcagtttcagagaattttctgatggagattgggtctacttgaaattgcaaccttatattcagtcctctgtggcaaaaagagcaaatcataaactatcattccgttattttggtccttttcaagttttacatcgggtgggcaaggtggcttataagttgtctcttcctgcagagagctccattcaccctgtttttcatgtttcacagcttaagcatgctgttgggttcaggcattctgttcaaccgtgtttgcctgcatgttctgaccttaaagtttcagtggttatcttggcttctcgtcagatcaggaaaggtaactctgtgaaagctcaagttttaattcggtggtctagaaatgttgcaggacaggaaacttgggaggatcaagttgagttgtgtcagcgttttcctaatgccttggcttggggtcaagccacttctcaaggagagggggttgtcagcagcacagctataccggatgagctacagaacactgtcaagaccaaggaggttaagcagactaaggaaggaagacctgttaggcaccgagtatgtaatcctagagtgagtgggccggaatgggccatatgagcaccatgtccaggctgtcgatagttgcgtgtgagagagagagcatcttaaaactaactctgtattcatttggatgagttgaggatgaactacgcggcgaaggcggcggcggcatcaaccctgtcgggttggtgaaatccatctgtgtgtgtgtatcg

SEQ ID NO: 16454 - DNA, 2553 bp, Oryza sativa
gatgctgcagcggaggatcattcagggcgagctgatccgcgcgcaaaggacgggcggccagcggccgtcttcgcccccctcgctggccaacgcctttttccctctccgcgcacgctcgccggccggcgaggaaagatgctgggtggggagagaggaggcgtcggtcgctccctctcccatcgtccactcgtccgtggatagagatgatggtgggtcccactcttttttctttggtctaactgacatgtgggccccacattttgtttttatttttatattttgcttccaatgccatgtcaccgccacgtaagatgaggaccaagtcaaaccggccacgtaggcgccacatcagccaaaaccaccatcaaaaccactgagggacctgttttgcaccggttttgatagttgagggaccattgtatctggtttttcggttgaaggacgaaaatcggattcgttgataagttaagggacctcaagtgcacttattccaagttgacttatatagctcactatgtaggagtatttgtggccatgtcaccattgaggagagagataagacaaaaaagagtgaacggtggttagtcgaccggcatctacaaattctacacaataataatattctttaaactttattctgatgtaatcctacgaggagatcgaatagtttatcactatatttcaaccaataggcatctacagattccacataataactcttttttaaattttattgttgaggtaatcccacgatgagattgaatagtttatcactatatttcaaccatatataagacaatgcattattttcaagagcttttctccccattggaagggatatacacctccctgtcattttaggatgtgaaaattttaaaccggttgaatgtttataacagtgaatgattgataatatcaaggcttttgttatccttatcaggtatagatatatatatatgtatatatatatatatgtatatatatatgtatatatatatatatatatacatatatatatatatacacacacatcatgctgttaggttggagatatataggagtaggaaaatgctacacacacgactacggcgtccgactgtcgtacgaccacggcgtaagcgacgtgatctattcagctccggtgtgattctccatctcgttgcgccttccaaaagcccaagtcaaagctaagcagctaaatagacgtttgctttgcatatcttatgaaacagtgatcaaacttggttgtagtcttgtgatttcaatcagagaactaaacagaatatttgcatgttttatttttatttaagaattagaaactatgcttgtggttttggacatcactgcatttatattttgtttaatgcaacctgttatagccataaaaatagaacttgaaactatggtatatactctctccgtttcatattacaagttaaactactttgacattgatcaaagttaaactactttaaatttaactaagtttatagataaatatagtaatatttacaatatcttgggatgaaaatgttactatttttttacaaatttgatcaaacttcaagcagtttaactttgatcaaagtcaaaacttcttataacctgaaacgggggagtatattaagagggttaaaaaaaaacttgtctggaaaatgggcatctgcagctgtgaaaacattacaagagaatgttagatagagatcgaagttagcaggcagtgattgagatcgaccaaaactccggcagaacagttgtgtagccatgtccaccatgttaatgctgtcttcctgagtttgggcttagagtctagacttgtatatgggcttgcatggcattggaccgattcatatacagagagtcgtctcacgccgtcacgttgttcgttgttgccgtttcagcgttcgttgttgccgtttcagtcgtatggtagtcggatgatttgcgtcggacgtatagcagggttgataggagtatatgttttttcgggaatatgcaaaaggctttatagttcctcggttttctgttctttgtttttcctatatgtagttctacaatcttcttagtatgtttatacatccggctaacactttgttaatttataaaaactcctggctaacactcaatacttgtatttttctactacaagagaaaaattaaacggcatatatatgtattttaagataatgctactaaacagcatatacgaagttgaaatgctaatctttctaccatacctatcaaattagttttggtgccaaataatgtctcatattgtagttccctgaatacttcgatgatagaagaggccttctactccctctgtcacattgtaagcgtaaccatgagtttatgtgtctaactttaatcgttcatcttatttaaaaaagaatcatcatcatcatcattattattagacgataaaacgtgaatattattttatctgtaatttatgtttttaatttttttaaaaaaaatagataagatggacgatcaaagttggacacagaaacttatggctgcgtttaaaatgagaccaaaggagtatttggg

SEQ ID NO: 16455 - DNA, 13444 bp, Oryza sativa
  unsure (1)..(13444): unsure at all n locations
atccatccctaatataatatcatagcaacccaaaggcaacaccttaaagtcagttttaaaaatttgaccctgagtccaccagtcacaaccagaaatatactgagagcatgatatcacaccaccatcagcaactttaactgaaacaacatgctgtaaacattggataccctgaagtttttgtgccacagtaatatcaatgaaggaatgagaactaccagaatcgactaacatgagtaattcatacccctgtacccagccatttaaccgaaaagaagtcaaggattcagtaccagtaacagcctgataagaaatagccataaaaactggtctacaggttcgaantacagtatcgacggactcatggtttaactgatcgtcctgcaacgcagctaaaagttcctgaacaacatgtaactgaaccgaggagccacacttatgctctctgctccaatgctcaccacacgtgaaacaaaggcctttagcacgcttgtaggatttcaaggcagaaaacttatcagagcgagactgtgagaattcagactgtttcctatcctccaacacagaaccttgaggatggttggacacaggagaaacaggtgcaggttggcgagcaaaatttttagacaacaaaatcggctcaggtttcctgtacacagcagggtgacttccttctagtatttcctcttgcaaaaaagccaacgaacacgctgtatccaaatcttgaggtttctgcatcaaaactccagatctaatgtctttcctcagtccttccacgaacttggtaacaaaataattcagaggcaaagaactatcataagccaacaactgatgcataataccatcgaatttctccacataatcagaaactgaagaatcctgaacaatgtgaaaccactgccgaatcaagaccttctgcctatccttagtgaaacgaagacaaacttgatcaaagaactcttgccaagtaaccccgaccagtttggaacgcaccgattgtaaccaaaaagcagcgttgccagtaaaattcagtccagccacacacacccaattcttaggatgaacaccataaacctcaaagtactcctcgcaattactcttccagagctgacgactatcaccattgaattgcggacaagacataggtggaacattacccccaattcccgaagcacccaaaagagcagaggcaaacgcagactgttccagagcagaggggagcgaagtaaattggggcggagtttgcataccatcgggcgaacccggagaagaaggggaaggacgaggtggctgctgcaccaaggactggagtttgtcgacttgatcttggagtcccaccaccgaaacgtgcaaatcatccacgcgcttctccaccaccggcattcgggattccaccgccactttgagagccaaaaactcagatcggctcttctcttccgacagctcccgatgcttctcactctcctcccgtttcttctccacctcctccatcttcctcaacaagagatcgagcttactttcctaatccatgatcttggccgcttgcttggtcacgtagcgaggcttgtcgtagcacgccgtgattgacgaactcgctcgagatctcgccgacctagttgagggagccgaagcttttgcggaatatagttgccgaagcaacaaattcccacctcacccaggaattacagcaaaatcaagaggaggaaaaaatttcggcaaggctctgataccaatttgttaactacccccaaggacagaggaagaatcgcccaaacagaacaacgatacacacacacagatggatttcaccaacccgacagggttgatgccgccgccgccttcgccgcctagttcatcctcaactcatccaaatgaatacagagttagttttaagatgctttctctctcacacgcaactatcgacagcctggacatggtgctcatatggcccattccggcccactcactctaggattacatactcggtgcctaacaggtcttccttccttagtctgcttaacctccttggtcttgacagtgttctgtagctcatccggtacaactgtgttgctgacaagcaggttcatcacgatggacaagtcttgttgctgtgtacatatatacaaggggtagagcatgtcaagaaacacaatgtaatttgttaccggtactaattgctgtagcacaagctgcatagaacaatgtcaggcaaattataaacctcaactttgagcaatgtcagtcaggtggagtgaatcacattagtactggttcagcgtcggaggagttgacggcgttcagcgtcgccgcgtcgacgcggctgtccatgttgaagctgatcggcaccacctcgtcgtcgacgtagtacgtgttccgcagtgacgcaagcagccgccgcagcgacttggcgcggttctgcgtgatggtgttcaccgagatccgcatcctgttccagtctgcgtgaaatccatagattggttagagctttgatgtagtttttggttgcaacaatggcggatgagagctttgaggtagaataagcttactgggcagcgaggtggggctgagggtggccatccagagaaccttggagatggagttgctgacttcgatgttggctcagcccaggaacactctcacactcacgaacacaaacgccggtgagggagacgatgaacaatggattttacagcgacgaacgccgcggagccgatcgctcctgtatcttggctttattcctcactgaaccttgcaaagaaacaacgaaggagtacaggggcctcttatagaccggtgacacaccgggagctagcctccatgccggccattgcgccacgttccgcagaacccgctcgacgtcgccgtgagccacacgctcgcccggacgacgcggcttcctccgcaagaaccgacgccacgcacaccacgcactcccacgactcgatcaacactgcaacggccatgcaaacaaccatgcagcagccatgcactcgcgatcacgactcaatcaaactaacagaacgcacacgacgcacacatgcagcagcacgacacacacacacactgactcaaccacgccaggaatacaccatgacgtgtttatttccaacattcgacaccaagctcaaggccaacggcgccgacctcccggactacttcgtcctcaccctcctcactgtcatccacgccatcctcccgcagccctccgactcctgcaaccctagctctgcgtcgcagcccgccgaagagtattgcgcagcggccagcggccagcggcagtctccgcccccctcgccggccaacgcctttttccctctccgtgcgcgctcgccggccagcaacgaaggatgccgggagggagagagaggaggcgccggtcgctccctctcccgtcgtccactcgtccgtggatagagaggatggtgggtcccactcttttttcttttgtctaactgacttgtgggccccacattttgtttttattttctatttttatatttttcttccaatgtcacgtcaccgccacgtaggacgaggaccaagtcaaaccagccacgtaggcgtcacatcagccaaaaccaccatcaaaaccgctgagggaccttttttgcaccggttttgatagttgaaggacccattatatctggttttacggttgaaggacgaaaatcggattcgttgacaagttaagggacctttagtgaacttattccagtcaactttgtatatgccattagcccattatactctaaccatgacggtacgtgggctgcttttttggtaggccgtaggcttaagaaaactttttggtgggcctagcagaactgtctaggccggacagcccaacacaatgtcatggcatgcgcgacccacaaaaagtgaaacaggaaacccaaactgtttcttttgccttgtagatacaattcccacctacaagaacagtgctgtcactccgttgaaatgaaaattttcactctacgtccctcgtctaagagccgaatttcaatctgatcattcaacagtaaaactaagtgcaacacatcattatgttgcaaaaccggtgtaagtgaggtttcaagccaatattgagtccaatttagactaacgtgatacctatatggcttatttgatttggttttcatcctacgtgttattgacgtgacacctacctatatcacttaaagcaaaaaaaaaataaagtaaataattaaaacaattatatagggcccattgacagcaaaaaattaaaataaataattaaaacaattatatagggcccactgacagcaaaaatttaaaataaataatgaaaacaatttatatagggcccacatgtcagtgggtgcctattaaaaatatacaagtaataaacctacatgtcactcacctggattataagttgtcgatcgaacactcgaactcaagaattttttttttcaagaaaagctgtatatagatgtgttacatgcgagtgcaattttgcgttccaaagtgcataaacaagtttggaggtttgactatcagtcagggactaccgccggcgtcgagcagctcgccgcagtccgggttgggacagctagcgcgcgaaggcgcctgagccgctgaccgacggcgagctcgcagagcgcgacgccaccacgcgtacgtcgaagccgccgatgtagaggtagagcaggttaattcttaaagtcctccggggtgcacgacggcgtcgcagtcgcagtggaagtccgggaaagggcagcgcagcgcacgggcacctctcctcctccgccgcgacgcggggcctcgctcgcgacgtggctgacgacgacgcaggcgatgcagagctcgcgtacgtgcgcgcacccgtcggacacgcggcggccgtcgtacagaagtacagcagcctcggctcgtcgcagatctctcgcagtggagccacccgatgtcgtcgtcgctgatcgagcggcggcacgtggcgggacgcctccctggccgatcgattacgccgacggcatgcaggcctcgaggaactcctggttgggctccagcgccgcctcggccgccatgtttctgtcgaatgcttgcttttgcttctgcgaggaatgaacacgtttcagctactttgttcatgggaaactgtttgatgctcacaactgacaaattgtttatgtaaccgttggcagatccagctaggacctgagaaggttccgtgacatcactaaagaaatgtgctgaaattattttgcatgtacatgtacatcttcaaaaatccatctttcccaagatattagtattttttgacttcaatacagtcttcgagatgctatacattaaccaataatatctataaaagtaagatgttttaaataaaaaaatattgcatactatgatagtttgttcaatgaaaatatagtaacatcaaatttacgtgatcgatcttttttatttttttcctattagcagtcaattttaaaaatgtttgacttagtactattctaaaaaatacttatatttttatattttaggacggatgaagtaaccaatagcaatattagaaatttaacaagcttagaaattaatgtaccctttaatataaaaaagaaatatactataggtatctaattaagactgcgttcgttcttgagctgaacatctgagatggaaattggagcaagcaattaacatatgattaattaattaattattactataaatttgaaaaataaatttatttgatttttagtaacttttatatgattcttttatgaaatatattgtttagcagttcgggaattatgctaattaagaatgagatattaccttaagcctagatgccggaacaaaaacaacctaagtgtgtgttaaaggcgtgcacttatatggatgcgcatgctaataatagtgcacacacatattttccatgtaataaaattaggattcacccaaaaaaacacattatattcgcagcctgcgctaacctgcagggagccatatataaaatttcgttttttttttatcaaaagtgggcaatctgtaagaaatcgttagctcagcctatcgtgggctgaagtactaacagagagtaacaggctactgggctcatccccttgtccttaaccaagtttctaccggttctctcgcccaaaagacaatatcaacgcgcctcagctttgtccaatcatactcactagtcgccatatacagatgaaaaaaaaatgttccaaatattggtcgatgagaaatcgcgacatatcattatcgtttccgtcaagaacaagaactccgcatatacaaatggagtaatggaaacaggttgaatcgaatgatcgccgactcgctacagaacattactagcaatgattccccagattaagcggacggtctgagcaagtaaggtcgatgaatccgtcttcctcctccgattgtgaagatttgcgaggagtacacttgcatgaatacattctcggattaaaggatgaaccgcagtcgtagcaaaacacagtgccacatctgcaaacaaaatttatcacatgaatgtaagaaatttcatgccgacttaggaagcaccagtgatgtggtggtaaagtcgtgggtgtatgactctacccaccagagttcaaattaatgctggtgctcacaaatattacgcatatatatgtgaactttctaaaaaactttagtgagatcatgtatgtgctcctggtttctatttcttagagcatgtgttaggagacgtattcgcggagatgtgagtgttgtgttgcgtgtgtagtgttgtgtgtgcgtgtaagtttgccgtgtaatcgtaaaaaaatcaaagcataattccataactacgggtctacggctctatttgaatagctgaaagtggtttgatggatcatttattttttttctacagttatttcaaagcataaacaaatgaattataactactgcaaaattgaaagtagctttataaaagcattcaagatgtcacaccccaatccggcaccgccgtacaacagcacctgacaggagcgtgtcgtaggaaaaacggcgtgaaccgcttcctacgaaaccgcgatctcagtaccagtcccaggacatagcgctggtacccacggtgacaaatatgaatcattgcaatccttataataaatagaggacttatttaccttaacttaggttgcattttagaacagcccgagaatgcaaccgacgacacgaacgaggaaacaccaacagcagcagcagcagcggaaccaacggactaacacccaacaccacaggcgacggctgggaactaggacgaaaccctattcttcatttcacttcatcttcatttcaaggtgtaggaactatatatatatttatatagagcaagggtgagtactttcgtactcagcaagtcacgagaatttaggtgtttgatgcaagcttggaagagaggcaaggttgttttgcaaatcctttgttttgaaatcattttgaaattactaagtggtttacttctttctaagtttgggccgaaaagagacttgtgtcttgattcgactttaagagatgtttttcaataactcaattggtaatgtaccgacccccgggtcagatcattacttctcggctcccagagccatttcacttgattaagcggctcccagagccttttcattttctcggactcccagagtccaactgcccagcagcacaacaatccgcttcaactcgggaagcctagtctatgatgcccgtagacatcccgaatcacacagattcgtttcttgaccactcaggtcatccatctgccacataggctgattctggtaacgattcccaaaccacaacaacttttcacaaagcacaggcaaacaaatctacgctacaggaaacacctcacatccgcccatgaccgtgggtacggctgttcgaacagttagttaacctctgcagagggggtacactttacccacacgacattactaacccggatcacccagtccgtgagatcagccatgtcgggagaccctaaggttttcatgacaaggcatttcgaaagccgacacagggttgccatatgccaacgagaggggtcccagaccgacaacaggttaggtcccagaccatattgtgccaggaagcccgagggttctacctgacaccagcccgttgaatccacatgtctcatggcatcatggctcctccgattagctaattactcagccaggggcgtcccattgcacccgtgtggtcgcacttattatatgctcggatgaatttcccacaggaatcggtccttatatgcgaatacaggacagtaccacataggcacaacccccgcatcgcgagttttcacaatctattttgttttcaaacacaccgatgccatatgtcgggttttcaaggctctcaaacacaccgatacaaacaatggtgtatgtggaatagttggtatatgtgctcagagagcacggataccgaagtaccacaaaggtggaacgacaaggaatcagggtagtacaacctacaaaaattagtgcgactactgggtaggtctgtcggtttggcacgcaaaccgaggccaagcaagttaagtgtgtgattctactaatgcaagttgcaaacaaaataataatgattttccaattataggagcaattggtcaaagggtgatttgtcttgctcaaggtcttcacgaagcttcacgtatcttcgagaaaacccacgatcgatgaaaatccggtgaccgcaactatacgcaaacaatcaaaaacctaaacaaaagaccaagaaaaaatatcctatttagactaaataatagtaccattagatagatcacaattttacagaattactggaagtggaacggggtcaatcggatgagcggttgagaagatatggattttcgaagtttattggattttctaatcaaaggaaaaacgatttaataatttattaaaccctttttggaaagaaattaaaggagggatatgatttagacttcctcgggtggctcgggtgcgactcgagaggacaggcacgactcggccgaactaatgggccggccggcccggagaggcggcccaagggggcgcggggagagtgagggagagggagggccggtgggccgagtccaccttgcggggtcccgagtggggcccgcttgtcagtggcgcggctcaccgtggaagcggtgcatgcggcgcgcgctagggttcgggtaggagtggcgcacggattggtgcaccgggtggaccgaaggatggcaggcccacgcgcagccgttaggctctccgtggaccgcgcgcactgagagagagaggagggagcggacccgccttgactcggtcttcaccgaggtggcgctgacgtggcgcctccgtggcatgccacgcaggccggcgagaggaggaagaaagaggccggccgagatggacggcgggcggcgggggtctcaccggagcatggcgcgacggtcttcggccaagggggagcacaccggagtgaagaggggcacgagaggaggcgagccagtggctcggattcgccggaggaagatcgacgacggcggattgcggcgacgcacgccggcggtgagaaaaaagggggaaacggcggaggggcgacaaggattcaactcaaggtggtgggagtatctctgggagtcggggattctgtttccggcgccggatagggtggaggagcaccgaggagggctagcgtcgacggcggcctctaggagctgacggtaatggcggcgaggccatgccaggcgacggcattgctatggaatggtttggggaggccctagggagttcaaggacggtgttggctagggtggtcgacgagctggggcccgacgacggcgcgcgactgtgtgccgcggctgaaaaagcgcaacggcgaggcgcgcggcgcattgtgcggcaggaggaggaatacggtggggagctcaccggtgagggaggagcggtgttggcgacgcggagggagtcgcggcgaggtggtcgcgacggcggggcggcgcggaaccgagagggcgcggccgagaaaaggagggaggcagcgaggccgaaaggatgatgagtgtgtgcacacgctcttggccacggcagtgcggcaccgagcttgacgaggccgacgccgaggctcacgcggccattggcacaacgcggcagcgaggaggcagtcgcggaggggcgggggcgagcagctggcggccggcaacaatggcgcgggtggttcgagcgaggtgaagacgaaacgagaggggagggcgcgggctttataggcgaggaggagaggtcggtttggaggagggaaaccgacattggcggtcaagggagctcggttggtgttcacgggcggcagcggcggtttcgttggcagtgcgaaagcggcgacggtgtggatgtgttgggcggcgaaggcggtggatcgagcggcggaaattgaaccgcgagcgcgggctggcgcggcttggcgtggtcaaagtgggggcggcgaactggcgcgcggcgtcagcggcgttctgcctccgcgcgcaatggcatgggcgtgagagagaggtcgagtctgagagggaaaaaggggaaaagagggagaaaaaggggaggcttgtccatgccgttctgggaggaagagtgagaggggagcgcgagcgctggctcccgtctttggagggtagcggcaatgggcatcgggagagaggagagagaacgagagagagaaaagagagctctctctctctcggccatggcgcacgcgcgagcggcgctcgagggaaggggagagcggctgggagagggaagtgggctgaggggaaaatggcccacaacacccgagggaggcaaaataaacttctgcatagagatttgagttgggaggatattgggattggaatttggattggagagaatttgagaaggattttggaatttaaccttgatacttggcctctaggaacataaggtggagtcaagggaaggattcgaggtgggatttgaataattttggattcgaagaagtatttggcgaggattcaaggaaggatttgaatttcgaagacttgaattggaatagaaatcttgaggtggacgattttgatggcgatgagagggaacaaggacggatttgaattgagatccatggcacgacttagactcgcacataaagaaaagaaatttttgcaatcaggattttgccgaattagtttttaacgtcttgctaaaagcgcggcgttacaatattttagtaagaaaacttttacacaaaatgcattggttagcagtttgagaaacaagcaaatatttctttaaaaaagattttattttctccataaataatggtcagttaccgctaagatatttctctcccttttcagcgtccacttcgcgagggaagttcagtacgtgttcggtcaagtcaacaacggttagtcaaaactaacgaatggaatacgtgtttcagatgagtggcgaaaatttcgccccgatttcgaagtttggaagcaaagtttagagatttgagtctagcgatcgaaattaaagattgaatcgaagaggaggatcggagtagtggtgaatcgatgagtttacctgcatgtcatgcgcttgcacccatcgatcttgtcgatcatggcgcggcagctggggcagcgccgccactcgcgccccttggcgagctgggtcagcgcgcaccgtgcgccgccgtcgccgccgccgccgccgccatggcggtcgtcccacggctcctcgcactgcaggcagaacgcgcgggaacaggtcgggcaggacgccttggacgccgcggcgcgcaggggcagggccgcggccgccgcctcgccctcgagcgccgccatctcgccgcagtcgcggtaggggcaccgcgcgcgcgcggggccgacggcgcgctcgcagagcgcgacgcaccaccggtcgaacacgtcgatgtcgagcagcttcttgcagcgctccgggtgcatgacgccgccgccggagcagccgcccccgcccgccaggaggcacggcacgggcacgctccccgccgcgacgcgggcctcgatgtggccgacgacgcaggcgacgcagaacgcgtgggggcagccgtcggagacgcggaaccggtcgaacaccagcttccactccatgcagacctcgcagtagaaccgcccgatctcgtcgtcggtgagcggccgcacgcggcccgcgcgggacgacgacgacgacggcgggtccagcatggagccccggatcagctcctgcaggtactgctcccggtcgagctcctgcgccgccgacgccgacgccgacgccgcggcgctcgccatgggagggggacgacgcgtacttggcgctaattcttcggcgagaaggaactaggaagtggatggagtggacttgggctagtgcgggtcgtcgtcgtcgttggtcgcgatccctttagcctttaggtgggtgtgtgcgctttttaaagttgggcaggtacagggtacgattggaacggttagagatgagctagatacacaacaatattatgcttaaaggcacaatatttgctaacattacgtatcatgctgtgagtatatttaggatatttaggttgtctataacttccatatacttaaatcaatcaagtgagatcattatttgtaagagttttgtaaaaaaaagtacgtgtagcaggactcttttttttaattattattattattatgcatgtgcacacactactatactcgtaatcccatacttacgcacccaccaattctcgatatcttggcaaattcattacaatccgcatcaaccataatgctaaatttcaacaaatcgtgaagaaaacaacaaattttggttgtgatcgtgatgaaagtcttgaattttctttgtaatagtttcctcagttaaagttatgatagtagtcataacccatgctttactcaattactgaggaatgactcgggcagtgacccatgccacggtgccactccactttcctccctcccacctcctcgccaccatcagagccatccgtcggaaatcttgcggtgacaaggatgttagtggtgtggggccttttctcccatgagctcccagaggttgcgagcacaaggtgatagatttggaggatggatctggccatgatagtgactgtgatggcggcaacgcggttgaagcgacgacaactatgaccaatggtgttgaagacagttccagtagtggatctagcgctggtgatgctagatccagtagcttcgaggctagatctacgtgaccaacgcgtggtagaggaatgctcgcaaggcatagcaatggcgacactgggcaatggtgagaccgcctgcgtggaggtacgggatgggtgtgagcagttgctgtggcaaccccctcgtgccgacaggatgcggtattggtagcagacacggcgataggaggaaggtgggggttgaccacctttgtgtagaggtgttggcgacaactctcct

SEQ ID NO: 16456 - DNA, 3088 bp, Oryza sativa
atagtgatccatgtgttcggtgctcatgggtcaccatccactaattaatctttcggtccgcacaaattactacttcctccgtttcatattataagactttctaacgttactcacattcatatatatgttaatgaatctagacatatatgtgtgcctagatttataaacatatatatgaatatgggcaatgttagaaagtcttataacctgaaacggagagagtactactagtctctccatttcaaaataaatgatatgcccatattattagtagagattaagatgtaagaagaaaataatatagcgtttcttattaaatatgatgtactaattgttggtgaaagggtggttaaagataatataatgataaatttaataacaagtaattgatgggaccaatactacttaaaatagcactatttttttaaaaaaattaaatcctaaataaacaccaattttggggctgaaagagtagacacagcatagaaaagaaaacgaacttttcaattgctaatcaatggttgaaccgaaggggaatttttttttaaaaaagttgtccgatctgtttcgttgcaacatccagaatttatcagctactaaagactaaagagtaaccaacattgttggtttcttatcgtaactcatcctaacttattgattaaatatggagaacacacattttttaaataaaaactactaacactatcagcctacacacaaacccctataacacattttttttccaagggactcctaaaatgttgagaacatatatactcccaccattctcttttatgtgacctccaactccaaactaaaaaaacataggtataaatcagcagctaagatagataaagcacacacacataacagaatccaacacatctaataaatgtctcaattcaaagatgatacaatccgaaaccatccaaccatctatgtctttctttccaacttttcccagcaacccgctggaagcgaaaagaagcaaattgcacagatccacacatcattcaaccacgatcgatgaattaaaccgctaagaaatccaggtaaattcgattaagtaatctagtcgaccgacggatcaaactttaaattaaggaaatagtttggtttagcgaccagtaaacgcatgcagaatctgctgggggcagcagctaatgttcgacattgtccatgcatgcatcagcctccagcttagctccttcttcctcggcgccggcgacggcgagatcgattctgcaggtgatcagggcaccagaacgacgccgagattgtcgaggcactggcatttctccttcccctccagcaccgctcctatctggagcccacaaaggtagcagaagaccatgcggcaccttcaaaataaaccgcttgttaattaaataaaaaatgtatgatatgtgtgttagccacactaatacacacacaaacatatacacaaatctgaattatgataacgcatatacataaaagtctattgctccatgtaatctggcaaaatcgtattcccattaaatatataaacatacacctctgtaaaaatcttcacagcaagtttttgaattcaatgtgcttccatatcttggttcatattcaaatctacgccattgaacccccactaaagccattgaacgccagtttacttactacaattaccactcaaaagttcatttaacctggagaaacatcctaatgtgtacgctaaaaccatatcaaaccaaaactatcaagtataatgaaacggattgagagttggagggagtaaatatatatacaccactgtacaaagatgtaattatcattaaacacgagttataccaaacttctaccatggtaaaaatgtttcccaagcatttaatggtgcaaacggaaaaacaaaggaaccaaatatggattagacacaaactaaagcatgtcctaccttgcaatgtaacccaatatatgttgttaacactttctccctacgaaaatgttggataacgaatctacagacaagttcaaacatgaaaaaacaaatgtcccccctataaaaagttagaggacgaatctacaaacacattcaaagatgatacaatcagatgctttgttttttaaaaaccagatgagtgatgtgcaccaaaccgtatacgctatatattactccctccgttttaaaatgtttgacaccgttgactttttagcacatgtttgaccgttcgtcttatattaaaaaaaattgtgaaatatgtaaaactatatgtgtacatgaaagtatatttaacaatgaatcaaattatatgaaaaaaataaataattacttaaattttttgaataagacaaatggtcaaatacgtactgaaaagtcaacggtgtcaaacattttgaaacggagggagtaacaaaacttctgccaacaacatactactttaaaaaaagcgccttgacaaccaaagaaaaacttgacgtcgaataattaagaagaataattaaaaccatatatttgtgctctctatgctatctagcacatagtactaaccacgtattttaactccctatgctatcgaacgcatctcaaactatatgtgggagatacattttctccaaattatgtactacattttcctcaaaaaaaattgtgtaactacatttgaaatgctcgtgatggattaaatagagtaatgaagcaaatgcaagaacctatgaaatgctcatgatggatcataataaatagtagaataatgaagcaaatgcaacaacacaagaagtgaaatgaagtagacagggaggtgagcacagtagtgaagtgagttgagtacctgcaactcatgaccctgcagccggctgtcctctcaaccagcatcctgcatttggggcacgccttccaccgccgctcgtcggcgagcttcttcaccatggcggcctcgggccccttggagcagtcccggtggtcggcgtcgtccgccgtgctccactccccgccgcacgtcgcgcacagcaggtgctggcacgccgggcacgccgccatggccggctccgcctcgccgctggtctccagcaggatcccgcaccggcggttggggcagtacgcccgccggtcgtgcgg

SEQ ID NO: 16457 - DNA, 4125 bp, Oryza sativa
  unsure (1)..(4125): unsure at all n locations
tcctgcagcccgatgggcggaggccccacttcttgtagaagtttggcatggagaattcaccttcttcttcttcttcttctccggcgatggcggcggcggtggcgcggggtggtggttgcgccacgacgggcgattttgtgaggtattgcaccgggagaggcccatggagctctgggtcctcttgcagctcggcgatcacggcgtcgcggatgacggagtcgtaccagtcgttgtcgtggccgtcttccatgccggcgaagacggccggcgtgtccctgtcggcgagtagggcctgcctcttcgaggaaaccgagtcgttctcgttcgcgacgttgcggtgaacctcttcttcttcttccatgccgccggcggcgcctcctttgccggcggagatggccggggttctgtgttgcccacacttgccggcagagacggcaggggcggcgtggctcccttctcccgtggtggcggtgacggccgccggggtgtcggcggcggcggcggcggcggtgagctggcggtcggcggcggcaatgcgagtccatatccggccgaactgcgcgacgtttgggcgagggtttgcttgcaatgctgccatgaggttttctgccctagcccaacggccattgccggcgccacgggcatggccggtgccgggagcggcacgagccgccatacgggcggcaggacgtctcccgccggggcgggagcgggggccgcccgccagcgatgaggccgccggggcggagtgagagttcagtagacggcgccatggcagcaggtaggccctgtggtaaggtggcggtagagctcgtgccgatgtcggcggtggcggcgccgcccggcggccgcgggaggaaggccgtcgctgatcttgccggtgccggctgctgtctcgtcgccacggtgcggcgcccaccggatcgtaacggaggcggcacgtacagttggacggtccgcgccgccgccgccgccgccggcgcgtcatcatcatcatcgatgacgatgggttgggccctgctcccggcggcgccggcggcgagggaagacgtcgatcctacgcgatccatcggcggcgcgaagctgctccagtcgtcgtcgcccagctccatcagctgcgacacgtacaggtcacgcgcgaacgcctcgtcgacggcgacatcggcggcggcggcggcggcggcgtggtggctgctcgatgctcctcctccagtcgcagcagggtggggttttcctccttccatggcgaattggcgcgatcgatcgacttcgattctctcagagattttctagggtattagggagtcgatcgatcgatcgatcttgaatttcttgacctgcatgagaagaaagaagatgcgaattagggggggatttcttgtttctactcagaaaattaatgtacagatccgaggctgactgtactatctgaatttctatgtgttcagctcataaattgtactattggcgcctatatatatatgctgaataacaggaggtagatcaaagtttattcgggagtagaattgcatatatttccaaaaacacgtgtgcatgcgacttcatcggttaatattgatgaatatatactactcttgctttttgttcaaatattgttgtattttgttctcacttatattaagcaaaatcggcccttgtacaaatggtgtgcacataaataatctgataaaaatgataaacccacaaatacaatgaaatagatcgggatgtggatttagagtggttcctacatattatacacatagttttgcaaatatgtaaatatgcaaatagttgtcttgcgcaagcataaatacggtgaatgcaagtacataatacacatatattgaattgaaagtgtgattaatcagccatggtaagaaatgtcggttaggccaagaattcagtagagaatgatggagcagtggcaatggatctagtctgatctacgatgatgagaaaaaccgagaaaacatgaaggtaacttactagtgactatgaagaactaagggaggaggaagacacagttgccaccggtagacgagccacgccaaaagttgttgagagactagcggtcctcaccggtgtttgtggatggaccgatgggcctcgtcggcaatcacggagaagccgataggcttcaccggtgtttggcggcgataaaggggtagggcggcggatcgggattgggaggcgttagggtttgagggagaaatctataagcttcaatgggagtatatccgattgattgagatccgacagccacgatttatttggtttatgccaaaatctcttggatatatctattagtaccccataaattgtctcttccaacctcctattttaatatctcacccacctacttatttgacttttctcctactcattcactcctattcaacttttgatttctttgaagttaaaaagaaattaaaatctactaaaaaagctatcaacaattttctactcatctacccgtctattttcactcaaacatagaaacctatgcatcttgattcaatagaaagaataattgtttgaacaacgacgatcatttactaagaggttgtgaggaaaagatttagagacaatgaataatgctaggaggtggaagacaagtttccaaagggagaaactagcatgaggtttgtagtagcggtgaaggtcatgtacgccaagattttggtagagaatgatggggggagtggaagttagaagcaacatggaagtaagggcataggaattcacgatggatctaacttgatctacgattatgagaaaaaccgagtcgacgtgaggggaacttaccagtgattatgttgaacgcaagaggaggaagacggttgtcggaggctgtcgagagattggcggccttgccggtggttgcgaagggaccgacgggtcttgccggtggttgtggagagactggcacgcctcgccgatgttggcggagataccgaggcggcgggatgtgggaagacggcggcgggtcgggattggggaggtgttagggtttagggagggaggaatttatatgatcttcgatgggaggagatgcggttgattgagatccgacggccacgatttatttggtataaggaaacttctctagtgtatatccattaatgccccataaatgttctcttccaacctcctattttaattcctcatccacctacttttttaacttatcctactccttcagtcatattcaacttctattttttttatttttttgaaaataaaatcagctaaaaatttatcaacaattgtctactttttcacgaacacagagagcatttgcatgttgattcaataggcagaataattgattaacaactacgatcattggtcaggaggtggtgaggaaaatatttagagataacaattaacgttgggaggacaaagacaagttgccaaagggagaaactagcatgaggtttgtagtggttagcatcacttgctaatgttttggaggaggttagggggcctcagcaagagttggaggtgatgccaattcctaagtgagttggaaagggaaaacggcgggtggatcgctatggttttggcaactgcctctaaactagtagacatcgattaacaccaacataattccctttccaccttgtatgttaatttcttcccaacatacttgtttaacttctcatagtccttcattcttctacaacttctaaaatattcattattctaagaaatcaaaatcaactaagatgcaagctttgcatgtttaccatgtttggctactcttacatctttttattttttacaaacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16458 - DNA, 445 bp, Oryza sativa
aaacccaaaacagcccccaatctccgctgtactacctctgttccaaaataaacgcagttatgagtttccatatccaactttaattgttcgtcttatttaaaattcttttatgataatatttttatttttattagattataaaatatgaataatactttatacattacttaagtttttaaggttctttttaaaaaaaataaataaaacagacgattaaagttggacacggaaactcatgtctgtgcttatttcaggacggacggagtcgtacgtgcaggtatgcttgagctatcatatggctcgctccatggattttgcttgcgtctctcgtctccgtgcaaatggtaagcgagcgacattaatgggcctgtttagttcgagaaaagaaaattcttgggtgccacatcggatttttgatagaatgtcggaagggtttttcggacac

SEQ ID NO: 16459 - DNA, 43793 bp, Oryza sativa
  unsure (1)..(43793): unsure at all n locations
cccttttagaagatgtgcatttaacactagagatccaaaagaacatctggaattaaagtctataggggaacacattgtgcaaaggttgaatggctcagcattagctataaaagcagttggtggtcatcttagttcaaacttcaacaatcaagaatggaatcgagttctaaataagggtctatcaaatgagaaagatatcatgacaattttacgcctaagctatgaatgcttgccagagcaccttcaacaatgtttttctttctgtggtttgttcccaaaaggttattatttcgagcctgatgtattggtgaacatgtggatagctcatgaatttattcaggatggtaggcacacctatggaagtcttaaaagcactggaagaagttattttgatgagttgttatctagatcatttttccaggcgcttcagtatggaggtacagtacattacgttatgcatgacctcatgaacgatcttgctgtccacacatccaatggtgagtgctacagattagatgttgatgaacctgaagagatcccgccagcagttcgacatctgtccatactggctgaaagagttgacctactttgcgtctgtaagttgcaaaggctccgcacactaataatctggaataaagtcaggtgtttttgcccacgagtttgtgtggatgcagatcttttcaaggagttgaagggcttgagactattggatttgactggttgctgcttaagacattcacctgacttaaatcacatgatacaccttcgatgcttaactctcccaaatactaaccatccactatctgattcactctgtagtcttcatcatttacgaatgttatctgtacacccacattcatgctttatggatacaagacctattatcttcccaaaaaatctggataacctcagctgtatttttcatattgatgttcataaggacctttttgttgatttagcttctgtggggaatatgccatatctttgggcagctggaaaattctgtgttggaaacacaaaaatgcagggactagaggtgctaaaggacatgaatgaactccaggggttccttacaattacatctctcgagaatgtgaaaaacaaggatgaagcaactaatgctcagctagtcaacaagagtcaaatatctaggttgaatctgcaatggggctcttgtaatgcatatagcaagtcagatgaacagaatgtgcttaattctttaatacctcaccctgcccttgaggaattgactgttgatggatacccatattgttcatctccgtcttggctggagtccgagtggctatctagattgcgacacatcagcattcacaactgcacatgttggaagttccttcctcctttaggccagataccatctctcaagaaacttcatattgatagaatggatgcattagaatgtatagacacatctttctatgggattgctggttttccctccctggaaacactagaattgacacagttgccagaactagtatattggtcttctgtcgattatgcttttcctgttcttcgtgatgtattcatcagttgcccaaagctgaaagaacttccactagtctttcctccacctgtagaaatgaaagtgctttcatccaacattgtttgcacacagcatactgatcatcgcttggacacatgcattattcaaaaggttagtttaactagccttgtgggtattttccatctttggcacttggattctgaggaaatcgcagacaccagctttgacagagcaaacatgttgaacaatgggcttagagattcaagccccaatcttccatcccttgaaggaccatttattggctggtgttctgattttcaccatgcatttgtgaggttaaatgaaatggaaattgtagattgccccaatgtaacatcattggtggactttgggtgttttcctgccctccagaatttgatcataagggattgccccaaattgaaggaactacctgataatggcaacctgacaacattaacaaaggtgcttatagagtcctgctacggactagtatcactgaggagcctgagaaacctttctttcctctccaaactggagataaaacattgcctgaagttagtggctttgccagaaatggttaacttcttctccctcagagtcatgatcatacaagattgccctgaacttgtttgtttaccagaagacggtcttcctatgacccttaactttttgtatttgagcggatgccatccattgctagaggagcagtttgaatggcaacatggtgttgagtgggagaagtatgccgtgctgccgtcatgcttctatgctggtaaatcgatggaagatactgaaggtaacccatcacgacttgaattttgatgaggataagtttagaaattgatttgttgcaataatattaccgcaacatactaactcatgtccttttgcagatatagctgacgaaatacttcttgaaaatgatatgattgagtggtcaacccagaccagtctactgcatccaactgattctgcagcaagctcttccagttttcttcagtgaattatctgcattgatcaagacttcggcatggccattgggcacaccgcgcaccgacgctgttggccagctggccacggctggccattcatgcctgtgcagctcagccaccctggcatgaaattcatttgcatattccattttaatcgggccaacttatcatgaggtctgtgcattttcgcatctaaacctactcttagagcactacagaacattcaccggtcattgcttacagtttgtacccttgccgtaggatgcaatgtagccatgtgctcctttgaacatcaggagcatggttcttgtggagtttttttttttctgaaacaatcgggtatgtattttttctagaaatcagatcgataatcgggtaaatacccataaacaggacatggcctttttaaccatactgtctgtacgtgtacaatattagtgtatgctactagattgctagagtgatggctagttctcgactgcctactgtttgtcatttacagaagatacgttaggctcattagatgtaattttgtagactgtacattctttgggatgttattagctttgtatctggggttctacaaatacaatggacaggttgatcccatgattcctgtgtaaggtcgtgctatgtgctcagtttctgtgtttagcatcttcttctcaatgtctttgcttaatttttttattctctgcgcaatttcagggacaaaaagaaggaaattttgtgctcgtgaaaacatgggccaattcagcaattctgtttgctgaatgtttccatattgggagagttcagctagagttgacgacgagaagatacccttgaacggaaaattggaagctgcttcccagttgaattctcttgtatgtattctgatttctgagttgaagtctatgctactagttaaaaagatctgaaatagtataatgcgtactctctccgttatatattaattataagtcattttgatgaagcttataaaaaaatttagcaacaatgtttcattaaaactaacattttatatattatttaatatgttttggtagtaagtttgttttgtgttgaaaatattattatatttttctgtaaacttgattaaatttaaaaagtttgactaggaaaaaaaacaaaactacttataatatgataaataatgaaaaggaggtagtaatatgttgcagtgctctcatgttttggggagtgatctgctcacccttgcttttgattcccagctgatggctgatttttttaaatataattctttcatgtataagaaattgagaacattttgtattttgtgcaggctcaggcagtgcaggtattggcataattattcgtgataacttcggctcagtcttgttatcatcctggaagtacattcgacatggagcatcagcagaagaattgaaactattggcttgtcgtggaggtttagctctggccactgaatgggttcatatgccagtagtgctagaaacagattgtttatccgtagttatgcactaaattctcataaagagaatcgatctaaatgatgtcatattatcattgatgtgcaatgtacaaaggagttgctttcagaggtgaagatttgtcatgttgtaagatgaggtaagatgaggcaacagggtagctcatgagttagcaccactggctagcaaaacgaagtattgtgcagtttggcgggaacatgttcctacttgcgtacaaggctttgttctcaacgattgtaataactttgttacctatcaatgaagctctctcttccttgaaaaaaaaaagaaaataaaaagaaactgagaacattattttcatgttcggatatagtatgaaattgtatccgagatatattaatatcgttatgatttgatacgatttggtcttcccttatctatagagagttgattttagaccggacaatttaggaatcaatttggaacaagtgaattttattttacagaaaaaaatgtagagattttatgaccatatcctttgaaattaactactccaaaagatgctttgtcaatgaaatggaaatatctgatgatttacgtcagcgaaattgttgtgagagagagagagagagagagagagaacagttggtttgggctctacttgggccgtgactgggctaggcacacttccacggcgaagcagttcgtctggccggcggggaagccagaaggaaaaagtacaccgaaggtccctgaacttgtcatcgagttacaaaaacgtcctgcaaataagatatccgacgtctcttaactaatcaaaatcagtcacaataaattcggttttgatcccggtttgaccctacgtggcggctgaatcggcatgggacccacgtggacccatatgtcagcatgccacgtcagcctcttctctatttcccctattctctcccttcctcctctctctctctctcactcctctgtggggctttggacggccggcggtggggacgaggtcgccggggcatggaggtccgacggccggccggcaatgaggcggcggcgacccagaagggaagggcggcggcggcgggagcacggaggagcaacaccagcgtcttgtgccgcgtccacaacggcgtgccagcgctggcggccggcaagcaacaccagcgtcttgtgccgcgtccaccgcggcagccgcgaccgcggcgtgccagcgccggcggccaacgaggtcgcgttggcggcgccggacattgctgctgctgcctcccggaactcgatcgagacacatcaagggatccaccagctgggatttatctacggccatcgcagccattaaatcgggaatcaaagcttgcaattttggcatccagcagaaacaggcaagaaattaatctcgtgctacaaatgccatctcatcatactcatctcttcttatctcatccaactaagaggccatagaaaatcagtgtcattctactggcaaatcacaattaggcaaaaaaaaaagcaagaagttaatctagtacagctaccgcagctcgcataagggcaccggcgaggagctcgccggagcgccactgccgccgctttgcctcagggcccttatcaagggcttggtcgccgaccacgacgaggctgcgtcggccgtgcacgcacacgcggccaagctcggcctcgaccaccgcctcgccgtccgcgatgggctcgtcgagctctacctcgcgcgcgtcgagctcgcctccgcgtgggcgctcttcgacggattccccgccggctggccgggacgtcgtttcttgtacggtcatggcggatgatagcggcgtgtgcatcgacaccgtcgccgccgctgcggcgttctcggcgtgcgcgcaaatcgggggccttgcgctgggtcgggagctttagggggatgcccgtgaagaagaacgtcctcgtcccggccgccgccgccacgtcgcggccggccgtcggacctcctcgccccggcaacgacctccccaccgccggccggcctgcccaatccagagagaagagtgggagagagagaagggaggaaaggagaggaagggagaggctggtcgctgacgtggcatcctgacgtatggggcccacgtgggtcctacgctgactcagccgccacgtcagacaaaccggggtcaaaaccgctgagggatcttcggtggatgcgttatatcctgttttgcggtaaggggacgattttgtaactcgaggacaagttgagggaccttcggtgtactttttccaagccagaatgggggaggcggcggcgctggatgctcgctgtcgctggtgacactcgccggccgggagtcccggaagcgcgcgggaagtagaatcggggcgctccagttcaccccacctggcacctggccggcggtgaagcgagcggccttatccgctgcatacggcggcatgttatcctccccggcgacggcgatggcctgtttgtcgtcgtccctccgccgtagtctagttcaacaaggtaagttttagtacttcgttccaattactcgagggcttcacaatggcaaattttccttttttttctaatattagtgaaaaaaatttgctgatctcactggcttccgctcttctgttttatacgggctagcttggtctgaccttaccaaaattctactccctccgtccgtccgaccttaccaaaattctactccctccatcccataatataccatcccataatataagggattttaactttttcttacactgtttgatcatttgttttattcaaacaattattatttattttatctgtgacttactttattatccaaagtactttaaggataacttttgttttttgtacaaattttttaaataagacgagttgtcaaacagtgtaaaaaaaagttaaaattcttttaagtagtttgtggccaactaaacacaccataaacaacaaaaaaaacaataccatttcataaattcttttagtattacccatatatttatatatcttgtaggagtacatcaaatttgtttttttttatcaaatcacacatgtcaacttgaccctgtcaaattttggtaggcaatatcataccacaaaccagcactatatgtctccggttcttcaagatttggaagagtcgaaagccagaaccttccgtgttctgttcgtcccctttgatccagctctgtttccggtttctcctccgggctctggtctcacgacaaaggcagcttgataaacaagaagatattttgggagcgtcttcttcttggaggagattggagtactgatcctaccaataaggtaggtgttcattcactaccgtcgttttatactttttactagttaccctaaacgtttgtttacctgcgacctaggttgatagcttcctagctgtgtgctctcataataccaatcaggcagacatgctccttcacctcatgcctgtgtgcgactgtgcgtacgacgacctatcttcactagtttatcctagaactcgtcgctgtgcggcgaaatcgcgcctaagaactcgatcttgctgcagggattgggtcttttttgtacgctttgtgtttttcttttctgtgaggaattaaggatatttttgtgcttggatcaacgaagtttccgagactgattatttggagcagcatcgaggcataatccacagtttgatccgtatccatggaaggcatatattatctaattaattattaggacgggagatatcggtttgtaggtccaataatttgaatacatgtatgacaaattgtcaaaaggcttcctttttgggatagttttgggactgaagttacttcatcaaagataactgtcttaggccggcctggttaagtgaatttttttatgtgtactggttcaacaaatcaaggaataatggggaatttctatagttgtctatgacaatgatcttacatgctttcgagtattaattatactaatgggcaccaatatgcctcacttctacatgttctccttatgttgttacctttaaataattatcttaccaatgcatattaggtacatcagttgaaagctgtaaggagaaattgaagagccaagacagtatattgagcagcatggccactttatcactagccacaggagttggatgggtagtttctcctgtcatcaagcttatggttgagaaggtccagtcatatatatcaacccagtacaagtggcagtccaatttggaggatgaccttaaaaagctcgagactattttaactgaaattttattggtggtgggcactgcagaaaggcggagaacacttgattgcaatcagcaaactttactccaccaactgaaagatgctgtctatgatgctgaggacatcttggatgaatttgactacatgcttctgaaagaaaatgctgaaaagcgaaaccttagaagcttaggctccagttctatttccattgctaagcgtttggttggccatgacaagtttaggtccaagttaagaaagatgcttaaaagcttgattagggtaaaggaatgtgctgaaatgcttgtcagagtgattggaccagaaaactgtagttcacacatgttgccagaaccactccaatggcgtattaccagctcattttcaattgatgagtttgtggtcggtcgtcagaaggagcgagatgaactagtgaaccgattgttggaacaagcagacatacgtaagtcaagaactgaaggagcaatatcagtatcaccagaggtaataaccatagtcggtactggtggaattgaaaaactactttaactcaacttatttacaatgataaacgaatagagaataattatgatatgagggcatggatatgtgtctcacatgtctttgataaggtcagaatcaccaaagaaattctaacatctattgataagaccattgacctaacaaatttcaattttagcatgctccaagaagaactcaagaacaaagtaaaaatgaagaagtttttacttgtgttggatgacgtttggtatgatgaaaaggttggagggcctataaatgctgatagatggagagaattatttgctcctttacggcatggggtgaaaggagtcaagattttagttacaactcgaatggatattgttgcaaatacattaggctgtaccactccgttctctttgagtggtctagagagtgaagatagctgggaacttttcagaagatgtgcattcagcactagagatccaaatgaacatcaagaaatgaagtctataggtgaatgcattgtgcaaaagttgaatggctcagcattagcaataaaggccgttgctgggcatcttagtttaaacttcaactatgatgaatggaatcgagttctaaaaaatggtttatcaaatgagaaagatattatgacaattttacgtctaagctatgaatgcttgccagagcaccttcagcaatgtttttcattctgtggtttgttcccaaaaggctattattttgagcctggcatattggtgaatatgtggatagctcatgaatttattcaggatcatggacacacctatggaagtttgagaagcaccgggagaagttattttgatgagttgttttctagatcatttttccaggcacttcagtacggaggtacagtacattatgttatgcatgacctcatgaacgatcttgctttccacacatccaatggtgagtgctacagattagatgttgatgaacctgaagagatcccgccagcagttcggcatctgtccatactggctgaaagaattgacctactttgcacctgtaagttgcaaaggctgcgcacactaataatctggaataaagacaggtgtttttgcccacgagtttgtgtggaagcaaattttttcaaagagttcaagagcttgagattattggatttgacaggttgctgcttaagacattcacctgacttaaatcatatgatacaccttaggtgcttaattctcccatacactaaccatcctctacctgaatcactctgcagtctttatcatttgcaaatgttatccgtacacccacattcatgttttatggatacaggacctgtcatcttcccaaaaaatctggataacctcagcagcatattttatattgatattcatacggaccttcttgttgatttggcttctgcggggaatataccatttcttcgggcagtcggagaattttgtgttgaaaaagcgaaagtgcagggattagagattctaaaggacatgaatgaactccaggaatttcttgtaatttcgtctcttgagaatgtgaataacaaggatgaggcagctaatgctcagttagccaacaagagtcaaatatctagattgaagctgcaatgggattcttctaatgcagatagcaagtcagataaagagtatgatgtgttcaatgctttaagacctcaccctggccttaaggaactgactgttgatggatacccaggttataaatctccgtcttggctagagttcaactggctatctagattggaacacattaacatccatgattgcacatgttggaagttgcttccacctttaggtcagctaccatgtctcaaggagcttcatattgatacaatgaacgcattggagtgtatagacacatctttctatggggatgttggttttccctccctggaaacactacaattaacacaattgccagaactggcagattggtgttcagtcgattatgcttttcctgttcttcaggttgtattcatcaggaggtgcccaaagctgaaagagctgccaccagtcttccctccacctgtaaaattgaaagtgctcgaatccatcatttgcatgtggcatactgatcatcgcttggacacatgtgttactcgagagattagcttaaccggccttttggatttacgtcttcattatctggaatctatggaatctgcagacatcagctttgatggagcaggcatatcaaacgatgggcttagagatcgaaggcacaacctcccaaagggaccgtatatccctggattctctgattctcctagcacatttctgaggataactggaatggaatttataagctgccccaacttaacattgttaccggactttggttgttttcctgctctccagaacttgatcataaataattgccccgaattgaaggaactacctgaggatggaaacctaacaaccttgacacaggtgcttatagagcactgcaacaaactggtatcactgaggagcctgaaaaacctttctttcctcaccaaactggagatcagaaattgcctgaagttagtggttctgcctgagatggttgacttcttctcccttagagtcatgatcatacacaattgccctgaacttgtttctttacctgaagacggtcttcctctgacccttaactttttgtatttgagcggatgtcatccattgctagaggagcagtttgaatggcaacatggcattgagtgggagaagtatgccatgttgccgtcatgtttctatgctgataaatcgatggaagatactgaaggtaatccatcaccactacaattttgatgaggataaatctagaaatttgtttgttgctaaatattaccacaaccaagtaaccgactgattcgtgttagtgccaaccttttgcagatatagctgaggaagtacttcgcgagaatgatatgatcgagtggtcaatccagaccagtctactgcatccaactgattctgcagcaagctcttccagttttcttcagtgagttatctgggaatctagcacttgtggcattgattgcaacttggccactgggcacactgcgcaccggtgctgttagtcagcttgtgcttgcccatggctgggcattaactgtgcagataagctgtcataaaattcatttatgcgttccattttaaccaggccaatttattatgaggtttgggcattttcgctcctaaactactctttatgagctgcagaacattcatcagtcattgcttacagtttgtactcttccacaggatgcaatgtatgtgcacctttgaacatcaggaccatggttctggtggagtttcttttatttttttttggaaagaactgagtatgtattttttgtttgaaatcagatggataatcgggtatgcattacatcatatgtatttttctgactagttaaatacaccagagattcaaacatgagatggcctttttaaccatactgtctgtacgaactaatgtacaatatgtgctggattgctagagggatggctaattctcaacatgcctattgtctgccattcacagaaattatatttggctcattactgttgtgtaatatccctgtacattttttgccatgttgcttttgatctagtgatctgcaaaaaagtgcaggctcccagctgcaaaatacaatgcacaggttaatcttatgattcctgtcatcctgtgtaaggtcatgctatgtgctcagtttaagtgtttagcatcttcctctccatgattccatgtctctgctttaattattttttgttctcttgtcaattttcagaaagaggttctggtgctcgtgaaaacatttgtcgggttcagcaattctgttttcatgaatgattccatatgcaaaatgggagagtttatctagagtcgacggggagaagatgcactcgaacggaaattggaagctgcttcataccagatctaggtggcatgccatgacttcagaaattagatttgtaccactgccctcaggtgatgcaacatctggccaccagacaacgttgaaggaactgaacctatgatcttgcattggcctatcatctatggaagggttgtgtgatcttgtttcccttacaaagctgtatgttattgattgctctgatctgttgcagcttcatgatatggatgacttttgctcgcttcgttttctgaagatcgatcagtgccgtcagttgaggtcactgccctggagtggtcttcttgtatcacttgagacattcatcttgtttggatgccatcaagcgctggaggagcagtttcagcggaaagaaggtccagactgggacaagaagcggggaagagatccgggcgcccaatggcattcatcacaatccaacagaattgtgcggattccgggcagaagatcaggatgtggtcaatcgtttcgtcgtgctggtcgcaaagcacacacctcgccgggtgaggaaggcaagcctcgcggcctcagtcgatccgctgtccagcaacgacgatgagccacaagccacatgaagtatcggcagcggtgcggcgttttgttcctccagaccaagttcactgggaatttttctcttccaatgaatgaacattgccagatacgccgatcgagccgtgtaacatcctgtggttgtccaagtccaaattaacttatctggctgattgacgatcagggtcgtggttgagacggcagaccataagtgcaggtattccaagaatctgccccctcaatccgtagcgaacccaacttctgtgtcgcaaagcatcagccaccgatatttgacggcgaatcctcttgggaaccatgtcgtaaatcgacggcgcgatcgatctgatgcttgttcctcccaaccagtgatcttcccagaaaaggggttgaggctgcaaccagatctttttcacgtggaataagttcactttaggtccctctatttgtcgtccagtccgatttttgtcccttgaccgcaaaaccgggtatgacccatcccccaacttacgaaaatctgttaaacgtggttcctcggcggttttgaaggcggttttggctgacgtggcatctacgtggcttgtttgactaggtcttcatctcacgtggcattgacgtggcgcttacgtggcaattatatctcggaaaaataataaaaagcgtggccccacatgtcagctgtaaaaaaataattttaaaatagtggggcccatgtggccccacatgtcagccacactcctctcttcttccctctccctctttttcttcttccctttcccctctctctctccccttcccgggcagcggacggtgcaggtgggcggcggagcaggcgagctccggcggtggcggagggcatggtcgacgctgccccctgaccggagcgccactggtccgcgtgaaggcagatctggggaggtccggcagccagcgctacggcaaaagctcatcaagatgctgctcgatcccaacccgggcacccgcatcaccatccctggcctcttcgagacgccgtggttctggaagacggcgcccgtcctacgccccatcatcgccgacctcgtgccgacgccggtacacacatggcaatgccacccgaggtctgcacgcggttccacctgatctccctgtccgagggcttcgacctgtcgccgctgttcgagcatgaccccgccgcgttgccagggcgagccacggcgcgcgcgggcggcacgcggttcgcgacacgggaggcggcaagcggcgtggtcgcgcggctggatgcgctcacaacgggcggcgccacgcccacgcgcgtgacgaggagcggcgcgcgcggggtgcggctcgccgtggcggccgatcgacgtcttcagcatggcgccgtcgttgctcgtggtggtcctggtggacgtcaagagggatggcggcgacgccatggagtaccagtcgttttgcagcgaagagctccggccggcgctcaaggacatcgtctggtcgcctgcggcgacctgacgacacggcgggacgtcgttgccgccattattgcgcgtcatcgaattgtatccgttgctatccatcggggtgcattattgtttgtgtgagaagatatgactcaacgcaatagattgaattaatcacggagtgcgtacatatataggcataaccaaccatatctactcaaccgacttatagcaacagaatcgggaggataggaattggtcccattgtgttggtgcaccaggaaaccaacccatgggctgcgccggcccgtgaggtgtgctcggctggcttgaggaagacaggccgacttggagctgggcctgcgggaaggtggcttggtaggcaaccggcgtcacgccgattgggccgttcggcggcccattgaacgccgcgccagcaaaaggagcgccttgtggtcgtgggccgagcagtccgcgccccgctggacccggccacatgtggatagtgccggcccaggggttcgcgggagtgggccagccggcctggcccggtgcgcctttgtaacgccccgattttcgttcggaattaaaaatcatttaataatgcatttcctagaaattaaataaaaagttaagcaatttatccaagtgaattattgggagaattaaaattttccctttaaaaatcattggccgggaatattttgtaatattctttgtgccctaatgtactctccggaattttccgtgaattttcggagctcgagaaatagttttaatagcacaaagatcattgcatcaattaaaataaaaagaaaacaaataaaatcccccttcctctctttgggccattttcggcccaagtcttccttctctcccgcggcccgcgcgccccttttctctccctctcgggccggccttctccctcggcccgctcggctctctctctccctcaagtctgctttacctccctcgcccgttttcccctctctctctccccgacaggtgggacccgaggccccacctgtcatcttcttccccaacctcccgtcgccccaaccgccgccatggccgccggattcgccccacgacgccgcggctcccgcgccccaccccgccccacgagcgcgtgaaatcgatcccctccacctcctccacctttccccccactctccccgcgaaaatcggcgccggttaacccctccaccaccccacgtcggcgccccacttcgccggccgattccgccacgtccagcctcgatcccgccttcccgagcccataacaagcacccccgtgctcccctcgtccatttccccttgtttcccgagcccggcactctctccctcgctctccccacgccgctcccgcgcgccgccacacttcggcgaactccggccgccgtttcccgtcgctagggtcgccgccacactgctccgccgccaccgccagctttgccaccgcccgggcaagctcggccaccgctccatttcccccctccacctccgtagcgccgtagccacgcgaaccacctctctccgccgccgccgccgactccagccgcgtcgcgccgccgcctcggtcgacgccgacccgcgccgttgcctccctcagctccgcaaggacgaggaggacctcggccgccgcccctcttcgccggaaatccgccggagctcctccttcctcggtcgccggtgagatccttctcatattgtcgcggtcggcagtcgttaccggtcaccacgcaccagtcctcccctctctaacccctcctttatctacctcagatcgaggccgagcccgtccgccccatcccgagcgacgcccgtcgccggagctccgtcgcgtcgtcttcctgaggagccccgtcgccaccgttccttgccgtcggccgctccttcgccgtcgtgcatctcggtgagcactcccctccctctcccttttcctccccttcgtcggccgcctcccgggcgtcctcgcgacgcgctgccgccgccggtggccgtccgaccgggtcgctgccgccgcgctccggcgctccgtgcccgcgccgttgccggtggtgtcgcctcccccttgccgcgccgcgccgctgctctctcgcgtgcgccgctttcgcccacgggagctgttgccggccgtcgccgcgggtggccgcgccgccgcgcgccgtcgtttggccagctggctttgtgccgtgctgtgcccagtcgcgccgcccctggccgcccgatcggcttgggccgatccggaccgtcggttcccgtggaccggcggtggaccgcctcggtggtcccggtccatggtggaccggcgcccttgtgtcgctgaccggtgggacccgcttgtcggcgccggccccctctcttgctgacgtcagcggcagtccttttcctttgtgaaaatatttaataattgcgcaataattcggtaataattatagatattaatttaatggctcaaaaccttctaaaattcatatctaattcattcgaactccgaattgagccattcaacttgcaaaattcatctaaaattgagctctacatgtttgtttactttttatgtactgtttccttggtttttattagagtttttcctcgttttgcgtgccagcgtgtagaatccgtcctttcagaagatcgcggtcgcgaggaaaagagttcagaaaatccaagtgaagaagcaaggcaagtcacacattccccttgagcatgttgttcccaatttataaatgttttaccgtttgcaaataaatatgcatgttttgctaattacatgggatcagggtttacctatctgctcgcttgtgccatgtttacttgatatctgtcctttgtcaaccgtgggtaataaatcgcctagcttgtgttactttgatgacctagctagaactatatgcttagccatgcttaattaccactagctcagtcgatgggataattgcagtattagacattctagtatcttgttgagccgcgtgctcgagacatctagccatgttttatggtcgtaattatccaactaaaatgcgactaaatggtgggctgtgggtgcatggttttgtgagtcgcacccatggcaattaaggaccggttcacgggaaaccctggaagacttacagcgcttgccacaagcgggagtgggtaaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgattgaccagattcaccgtgattagtctcacacttaataaatcgacccaatgcactgtagtataggtgggttggttgggcctgttcaacgtggtgtagcgttgatcagtggagatctaatttaccttaattattcaacagtgttactgttttgctcaacaaaatattttacaaccgcctttatgcaaatagccacaaacccctccttgtatccccttgcacgtctgcatcgttggtgtggcttgctaagtacggtggttgtactcagccttgctattatccccccttttcagaagtgtagtgcttctgagctgaagacgaagttagaggaccaaggctcagaccccagttgagttttgcctgtggagtggagctgaagccccgctaggatcgcctttttccgctgttgctgcttttgtttctgtgtgaggactaagtgcctcttctgtaagtattttacgctttatttacgtttggaactgtatattacttgtcgttttgtgtaccctggctggtcctggacagggatttaatacgcaaaatggtctggaaatttggggtaaatttctgggcgtgacagccttgcgctggagtcttggggccgcatggtgtgttgccgccgccgccgccgccgccggtgttcgtcccgccgccgctgttgccactgccgccgccgcgacgacggcgattcttgttgttggagctgttgccggagccgccggacgcgcccgcgccgtagccggtgacgtgggcagggttgggcgtcgatggcggcttgcctctagaagcgccggcgaggaggacggtggactgcccggaggggcgactggccttggtgagttcttctaacaagagttgcgagcgaacgtcggcgaaggacgggaaaggacgctgcatggttacgaggctacgcaaggtatcaaacttttcattcaaaccattgagagtagcaagaaccagagcacggtcggtgagaggatcgccaaggtcaccaagtgagtccgccatcgtcttcatgcgccggcagtagtcgttgacggaaaggtcgccttggtggaaggtccggaactccgtggtgaggttgagggcgcgctgctcacagtagccgagaaactgtagctcaagggcgcgccataccgagcgggcggtggcgtcgtgcgacatgacctcttgaagcagatcggaggagatggtgccatagagccaacctagcaccacgcagtccatctggatccattcagcgaggtcggggcggcgctcgtcggaaagaacgtgtgccgtcaacgcatacttgccgagggcgatgaggaagaggccgcgccagcgcgtgaagttggcggtagcgacgtcgagggtgatgggaactagggccttgatgttgaggactgagacggcctgcgcatggagggccgcgagggcgtcggggccgagcgccggcgcagcaggtgggcaccgtgaaggctgttgaggagtgccaggaaaccgcaccgggtcgaggatggcttccagggccggcaggagcaacaccgcaggatccggtgatgatgaagttggaggaggaactgccggggcgggcggagtcgaggaagaaaccggagccgacgtcgaggtcgaggatgaagtcaaggaagagagcaccgtatcggaggtagacgccgaggaggaagcagatatcggcgatccatcgatgttggtggagaggacaaacgcggtgagggcgtcggagagagcggcatgcgctgccttggaggcccggtttgcagcgaggttggcaacggaggacccggtggcagggtcgacggcgctgccttcacggggagtaaaggacgtgcggacggcgtcggcgacggcttggacggcgtcgtcgagggccgcgcgagcggagtcagggaggagggtgggcggcgccatgagaaacgccgggagagaggaagtgtgcggaagctagatggaatctgataccatgtgagaagaaatgactcaacgcaatagattgaattaatcacggagtgggtacatatataggtataaccaaccatatctactcaaccgacttatagcaacagaatcgggaggataggaaggaagccggaaactacacatgtacatatatcacgctaacagtttggtgccgaggtgatgtctggctcgctcgtttgtccgtagcaactcgaagtcaatggctgttgcagcctgctagtgttgctggctggagtagcttgctgccgtggatgtagtagtaggtcggtatcaagatcatgggccttttcatctccaaacggcgagggcggggacacggcggtggaggcggcgaagcaggccatcgccatcgggcacgtggaggctgagagcgcggcgaacggcgtaggcctcaccaccggggagaagggcggcggacggctaggcgagtggcgcgcaagagagagatggccgccgccaccccacacgcctcgcgcgccgtcgcccgccgctggccatgcgctgtccatctccgcgccgcccgccgctgccgtggtccgccgtcgcctgccgtgctggacgccgcctggcgagaggagggaggagagatggggagagccggagagaggaggaagaagaggattggatttggtcatttgagaatggcatgtgaggcccacgtgggccccaccatatttatttttttagctgacatgtgggacccaccatttttaaattattttttttctgtggctgacatgtgggcccacgatttttaatgtttttccaatatataattgccacgtcagcgccacatcaatgccacgtgggacggataactagtcaaacaagccacgtagacgccacgtcagccaaaaccaccttcaaaaccgccgaaggatctcgtttgcccggttttcgaaagttgggggatgggtcgtacccggttttatggtcaagggacgaaaatcggactggacgacaaataaagagacccaaagtgaacttattccttttcacgttgagagaccgccatggacagaccttgccacggtttctcagccgctgtgcgggctgaccagacccagcgagcgcgcatagcgcagcccatcaggtcgaggttgtgcaccctagtcccagcgatgtcagctttgtcagtgtgctgtaaattgtaaaacgatcgaagacatattttcattgcaactcgtctgggaaaaaaaaaagggatgctccatacagttgtaagcatcccgatagtggtgcgggatgtttcttttcttcttgaaggacaatttgattgtgatgttggaagaagacaaaaattggatgctccatgctcagtgttacttaagctttcgtggtagttgctggtatgacctttggatgtgttcttccccattatttcctgactcacctttctctttttccacatgcacgtttttcaaactactaaatggtgcgttttttaaaagtttttctataggaaagttgctttaaaaattatattaatctatttttaaagttttttagctaatacttaattaatcacatgttaatgaacaacaccgttttatgtgtggagaagtggagatgaacccagcctaagagttcgggactgttcactttgatgtcattttcaaccttaccaaattttagtacaattaccaaaaaaatggctatatttagtttactgccaaattttggtagctatataagaaatcctactaaaattttggtaactatgccaaaaggttttttttttatcaaagtgaacaggcctttcttgtatcataattttctgtcaaaattgtatcctaattgaaaagcttttgtacgatagattcaagcttttgcgtctgtcaatctccattgctgacaagtcagcaactgggcataacagtctgttagaagctgaggacatatgatttacatttcttcaaaggggggagagagaaaaaaattgagaagatttagcagatgttcctctgtggtatcaccaactacacatcttggacccttggtgtgatcacaagcgaaaaccgaagcgcaggaagaagaagcagaggttggcgaggacgacgaccgactccaccacccacagcacgtagaacaccacattctcgtacactcggaccccaagcccaagcccaagcccaagcccgagcccgagcccaagccgccgcctccggtgcagcactgccgtggacaccgcccggacacgccgcgaccaccgcggcgacccgctccccgccgccgccgccgccaccttcctccgtatccactcccgcttcctcccgccgctcatcgccggagatgcttctcttctctagttctcttcttcttcttggctgctgtgctggtggtcgtcgccatggcgtgctctgccttcgagctttttatgccggattaacacgcggttttgcggtaaaaagaaatgattcctggaggcgaatcagccaagcaggtgagactttctactcactaaaattcttggaaaatgaggttggtcaagggataaaagtcgcgtggactcgcgcgcccggcagcttcctcctcctgagaggatcatggagtaggtcgccgctcactctcacctgacgaacaccatgggctagagcgcgcacgcgtcgtgggccgtggcgcgggcgcggcgggccgacgagggctgagcccaacgttggaactgctcgagttctcatccaagaaagagatccaaaaaggcccacagtaattttggatcgtattcaatggttgcgatcctttagacccatcataatgtttgggccgctaacatttcaggcccattatagttaggcccatcacgagaaatatccatccggcccgagtagcgtcgtcttcgtcggttcgctcgactcgacgtgggatttgctcctcttcgctgcgacgcgctgcctccctctactgctgccgccgacgaatcccagcggcgccgcgacgccgccggtgcgccgccgcaggtgagggtttcttctcttcgtccacctagtttgccctccccgtaggtattggtcccaaatgcggggatcatcccctagtgcgcgtgagggccgagcgagcagtaaactgccgcgacggcgtgagggtttcgtggccgatgcgagctttgctgcgtgtgcgcaaggtcgcggtcttctcgagggaggccggccaagatcgccggtgccatccgagattcggagnannnnangggggggggggaggggatgcggtcccagatctggtcggtgagcgagttccagatgttttggtcggaatcttgggccgtgaggaaagcgcaggaaggtctcagaatggttggggatgcagtgattgatcttacagctcaaatggaaggatcatttggagagggagcgaattgcaacgggaatagttcttcctgcttttgtttttttggatttttcccattacattcccaaccccaagaggcaagcattattgtgctatttttgaatcctaatccaagaaagtctagtgcattagtagctactgtcctgaatgacattcattcagaaggtacatctcaccactccagttgtctattgaaaatgttaaatgttagacgtgttactattttgagtacaattctaggctacctgttgatcatcatgtgtctaagcctttttttttaatcaactgtgtccagtggtatcaataatcgtgttctcagtgttacattgaaggaggtatttcacttgccgtttatccgtacctagggctagatgccatattttggttgaagatttggtcagcgtgataaaaattttgctttggtggtagtgcagaaacatttttgacctgctgttgtttcaattgacactggatttgccattatttcagtagactatggatatgcaaatccacgttggttctccaaaagcatttgctagttttgttttattttatggcaatggcacttggtgaaggttatggtactatgctaatttccccttattcaagtatatgtttatgatacatcttctcctcagcatatcatgctcagttggtagcttgaatatgtctatctaatggataggacattagtaattggttcctcagcatgttattttccgtttgtttctgagagccaccgtaggggatatttgttaaggttgtagacataagacgtttgagctgacctgaacattgatacattattttttgagtctttttttagttcgtttttgtttatgcagttagcatggcagcgatgaacaatgatctgggaggactgggaggcagacctgctacttcacaagctaatccttttgaaagtgctttatatggagctggacctggactcatccgaagtgggttaggagcatacggcgagaagtttttaggttcaagctctgagtttatgcaaagcaatgtaagtcattggtaaaatttcatcaaggcaaatgtatgctttctatattttgtgtaccacgttgtcatcaacacacgtgttttccccggagacattgaatcttaactttgcttcatcacatggacagatcactcagtatctgtccaatcctcagtactactttcaagtcaacagtcagtatgtgagaaacaagttgaaggtgatcttgttccctttcctgcaccgggtaagatttatccacctttttgtaggtattatatgcttattgtgaaatttcttacaagccatttaccaatttacttccttcaggggcactggacaaggataactgaaccggtgggaggaaggttgtcatacaaacctccaattcaagatatcaatgctccagatctttacattcctctgatggcttttgggacgtatgttgtaattgctggatatgctttgggtgttcttgggaggtaacgacatatttagtctcattcaactttgtagtgctgacttgcttcttctttagtagtaaagaaagaacgctatgcatagtgtgttgagtgacggtaagaacagtagttatgttgagaatttgagaagagaaggatgtgtggagaatggacaaatgctaaagcgtgggagtatctagaaattaacttctgtggtgcactgtttttcttgaatgatgaattcttgaaacatatttctagttcaaccaagtgcccaagtgttaaataatattcatttactcatgatattcttgattcagtgatgcatgcatgaaacacatttttgctgattgcaggtttaccccagaggcactcactctacagttcacaaaaggattacttggctggtttctgcaagtaatcctgatcagagttctactgtacacgctgggaagtggtgaagcgccattgctggacattgtggcctatgctgggtatggatttgctggtacatcacttgcaatgcttgtccgcgtcttctggagcccgtcatattattttgtactgccatggttctcaatctgcaccggagttttccttgtcaagacgatgaagagggttcttctgggcgcaccaaggagctatgagagacaccccagccggaatcactactttcttcttttcctcgcggttgtgcaatttcccatgctcttctggctaggcaacatcagcgggtgatatttcagccttattttagaactacataactcgatttattcggtattactggaataggtttgagatttaggcatatatgtcgttcatattcttgtggaagtggtaaattgctggacaagaagttgcataccaaatgtctgtccttcgcccttgtctgtccggcattaactgaagaccaatggatacacgaatgttcttatcgtacatcatcgctattttgccttctgtatctcatttttgttacttagtcaccgcgatcgccttcaagctgtcttacgacctgagacatgtctgtataaaatcagatgataatgttccttgtcgtgcacttcaattgcttctgaaatgtgattcttcagtggactggggatatgggagtacataggaccaagagagtgttgtgtaattccttacaaactccgtctgaaattttcctacttacaagtcaatacataatctataattagcaaatctaactttttgttcgcttttgtttatgctttcatgggttcgtccaaatggggttttatgcttctccaggctgtatctctattcatattggtggaggttttaaatatttctagacatgtatttgagttgaaacatatttgtctcacattaagaacaaaaactgaaaatgcacgatgatatatggattgaaaaatgtgattgatacaaaagaaattaaacaaaaacaatcacttgatgtatggtggtctgaaactctgaataacaatcaaaccctgttatttcccgccaccactcatattccccacccgtggacctatcctcctcgatcgccggcgacgacggggcagccaatcacgagcaccgcggcgtcgcctgcgcggcggcgaactccagcggctgcttccacgcgtagacgaacgtcaccggcgagcccttcgccaccggcatcccgtcgttgacgaggcagagcccggcttcgtcggcgcggatcttgctctcgtccaccggctcgacgctcggcacgccgccgccgccgccgccggggcagctcaccctgacgccgttctgcgggcacgcgcacccgttggacacggccacctcgtactccggctgcccctccaccaccttccccgtcctcgccgccgtgacggtgatgtccgacagcttgcagtcgccggcggcggcggcggtggcggtggagttgcccgcgcgtgctgcgtgacagctaatgacggcggcggcggcgaggaagaagaagacgacggtggcgttggccatgcatgccatttctgttttgctgattctgtgctgtgattatattctgatttgattttcgtttgatttggagtggaagaaggggattatatgtacagcggattgatcattgatgtggtaaagagtcaaatttggtgtgtgatgatccggaggagaaatgtatcagaatgcactgattttctgccgatcgctactgctgctagttttctcgaattattgccttcctaaagtgaaaaagttcctgtattagttgaaaacttgaaaccagctgattcattcgtcttaattttagaggagagctgaacctattccaaaatataaatcgaacttaattcagcagtaaaccgggagcagctgcaaacgagcgataccgacttacaaaaatcgctatcgccaggctgcaatatgatgatgtggaatagttttgcagctcgccgagtcaagttattgtacctgcttcttagggcactcacaatgcgtcctgaaaattgctacacctggactaccaactggactaaggaacaccaaaagacacttgaaccacaatacatgggacttaaattcgcacctgcaaagtctgaagacacagatggaggctactcggccaacagtgggcatggcacagcccacgttgcccaaatggccaggagggtgtgaaatttcagttttacccccccccccaccaccaccggatgcgagcccacgactcatctgctctgcctcgcctccatcgcgtgccgtctcgcctccatccctcctctcgcgtctcctctgctttccatccttcgctcgctctcctccgtgtgatggcgaggatgaagctccgcagtggctttcagtacgcttgccctagcccatggccatgggcaaccatatcggcggcggcacaaaacatcacttcaaaaaaaagatctttcccaagaaaacatataggaattagatatatattcatcacattatgcatatgtacatcactcataagtactatatttgagcataacaatatgcactcaactcctaaaacacaaaattcacttaatacattgaataattatcgcttatacaccatttatgtaagaataacacctatacatcacatatacacacaaaattcattcaattccaagagtaatcattatttataatgttgtaatcattaaggacaaaaattgaacatcacttcaaaaaatttgatctttcccaaataacatatagggattagaagtttgtaaattaaaatatattgtccagcagctccagtcaattccatcgacaacgaacgacatcgatctgactcgtgcctataacaatatagaacttgtagattgtacgccgttgttgtagccatccatcgtgcaccaccttgtcgtcaacacatctccatcagtaccaaggatccgcccgctccgacttccgattgaacgccatcaatctagtcgagagccgaagccgacaagtcgcatgccatcttcccagccaccgaacgacccgagcgtcacgtctagccatctccccatcgaacgcagctcatcgaaaggcccaggccaccctgcctagagtgttcgaatccatcgaccgagaacaccgatcgcctccagcttcaatcaatcccgagcgtgaggcctcatgtctccttgttgaaagtggctcaccggaaagttcaagacacccgcctgaagtgtccgacctaccgattgaatcgccaatcgcttccgccgccatcaacccgagcaccacgtctggtcatctctctgttgaaagcagcaatcgaacggttcaaaccgctgcctgaagtgtccgattccaccgatcaaattccgttgaccgctgtcgtgctctaccttgcgtccttgtccgtccctggacatcctgtgtagttttcgtggcgtggagcacctccctcgcacctctaccatggatctcccgcaagctctgataccacttgttaaaaaactagtcttgaaatcacattggaaaccaaactcggaagaaaacgtcataggagatccaaacacggtgacgacaccgaggcatgatatttgataatggagttcagccgaggcctacatctccgggggactgattacgggcgctcctccccgatccagcatattacagcgtatcagagttacaatgactcacggccggtcgccgctggcagccgctccctctcgctatgctaagtcgcaatacggttacaacaggtacacccctctatttatgagagatcctaggatagagtctgactcttactctaatcctatacctagtacaactccaagtcctaaactataaccgactacgtttacatattcaacataaactctatcagcatcatcctgtgctgccacttttctatgaaacccaaaataaccttgcttggcgtgagagtcttcactcacaaggaactctccaaagcaacaaacgggtttacagagctgctggggcatggtggttttggcaaagtgttcaaagggattgtgcattcactgggacctcctgaaattgcagtgaaggtactcgaccagtgaccaccctggtgagtttaaggaagaggagttcataaacgaactacaatccatcggtccaatccaccaccgaaacctagttcgaatgattgggtactgcaaggagggaaatcatagaatattggtgtttgagttcatcccaggaggctcccttggcagcttcatattcgaccagccggagatgcctccatggaggtggcgagcggagacagcaataggaattgccaaggggctagagtacctacactatgggtgcaccttcccgatcatccactgtgacatcaagcccgacaacatactcatggatcacatggagaatccgaagatcactgactttgggaatcgccaagctccttaacaaccagcaggtgcactacaccatcaccaagatcatgggcaccaagggctacgcagcgcctgagtggttcgtggagataatatgctgcgggaggcttcctcccgataatcataggatcggcacaatggtgccgctgctaaactgggttgagagccttatcgaggacgggagaatgtctgaagtctcaactcgtgggggaagaagagagagggccggggcacccatggtgttaggctcgagcatggctgatagcgccgagaggtacgcacgtgtggcgtatatggtgcatacaggtggacccatctatgaggccaacaatacgcgaggtggtgcacatgctcatggatgttgcccctctgccagccttatctaggcctcctgacttttcggcattactccacctccacggcggtagcggaacctatcacaagttcacaacaacaccacgggtcttggtctccagatcgagtgagtgaatgagtctgaagtttactatagtctgttgtatttcttgtttgctagtttgctactatgtttatgttccttataagatgtggagaacagaccttatagggttctttgtgtcaactgttaggaagtttccattgctacaattattacttccatgttccattctgtttagatgcctgtgtatgtttatatataagacaactgtcctagttagcattaattacgttgtgtttgtgtctaatgacccagaagttttctttagcctacgcaagtataacaatggaagccaggcgtccctttccaggttcagagttagttggagcatcaacaatatcttaaaccatcctgataaggctactattatactccctccatcccaaaataaacgcaaccaagagtttccacatccaactttaattgtccgtcttatttaaaattattttgaaaaactaaaaagacattagtcacgcataaagtactattcatgttttgtaatctaataacaataaaaatactaatcataaaaaaaattcaaataaaatagacgatcaaagttggacacggaaactcatagatgcgcttatttttgggactgagggactacttttactatatgctccagcgaaattaaaagtactacctactacatacgattaccagtagcccacatattagaactcccgtgacccccgcgtcgcccactcgcaggtgacacggggggcgaaacctagtgccgccccccttcccccaccagccgccgccggaaagcctgccggtgagctaggagggtggcggcggggccttctcctgcggtagcatctcctcttggcgcgggggaggcggtgaacaccggcggcggggagtggtggcggcgagctctctgagcaaaacggcgacggatccacagctgccgtcgccgtatctggcctggtccaagccggatctggccgaagcggccggcgctgtggcgcagcgcgattggaggcggcatggatggcggcggagacggctcgcgaggtcgatgcgtgcaccggtgcacgcaagcggcgcgcaaggcgtcgcccgacatggagccgtgctgtcgttggcggggggcgtcggcgactctacagtgcaacggtggatggggcgacgctgtcctggccgccgtgccgtccgccccctccgtcctgccccccttgcttgagttggcggcagggtcggccggtcgggcggatctgtggcggtggcctagggctgattgatgaagagttgatgtggcttgcgacgttccttcttgtgcgggttgtgtggatttgaatggggaatcactggcgaaagctttgccgggccgttggccggcttgacgacggcggcgcctttcggcgtcgttcctctccttggaagcgttgttatagcgttgaccccgtgttaatacatcttctcatttttttcaatttttttcataaccacttgagtgacatgatgtaaacaacgagggaacatcctctcgagtaatcagagtaatcaaaatagtttcctataaagggagtcgaggagtgcacagtaaaattgcattgcaagtttgcattataccatcatctctattttttaatatatgatgtcattaactttttaacatacatttaatcattgtgtaaatagtatttagtgataaatcaagttacaacaaaataaatgataattacataatttactttaaatgagacgaatagctaaacatatgttaaaaaatgaacgacatcctgtattagaaaacagaggaaatagcaataaccaattaagcctatatttatgtctatactttggctctctttatttacgcttagacttattggcttagcattttaagttacttgttggcttatatgatttataagccggtggatttaatgtcgtaagtttaatggtggagtcatgcatatatctcacataagtcaaaaaagcttctctaacctagcttttggcttaatagtgttagagtggtttatagcttcaaaatagccaaacaaaaaagtcacttgtttgtttagacttagatttttcgacttataagttggcttataagcctaaacaaagagggcctttataccacctctatttttaataggtgacactgttaacttctggacacatatttgatcatttatcttataaaaaaattatgtaattatcttttattttattgtgagttgttttcgtactaaatataatttaggcatgatttatatttgatgtatttgtataaaatttttgaatatgacgaatagttaaacgtgcgatcaaattaaaaagcaattattaaaaaagaaacagagggagtccaagggtgtgaattgtgatgcttgaccttgacaaccacatgagaccacgtatacaaacgacgaaaccgccgtccgatgcaaattttttttatcagctaacgtgtatattgaacaaatgaactatcacgcgcatccgattttattgaaaacattattttataataaaactatttagattaataatcttagaatatgtcacttccatttaaaattctttatattttaagatagagagtacgtactactctatccatccacaaagttacacctatttcacattaaagtttttctaaataagtcgtttctttttttagtctttatacattcaagacttaaatgaagagataaattaaatattttattagaactgaaggagtcatctaaatactcattggttgcatgcttgcattcattctttaattttgtaacatctaaggtgatttaatttctctctggtcttggtgtcaaaagtaatacgtgtaacttttgtggacgaagggagaaacattttttttaagtacgatgaaacaggacgtccggagatgtaaaattcggccaatcaatgcaagttactactacatgactatgaagaaagctggcactggcaccactataatcacaatcacaaaattggtgtgaccagctgcaatagcagcttattgagcagaaatgaagtcattctcgttcgtcccgctgcttctgatcgcactgctgctgcatcaatcatcctgtctgcttcaagttgaagcagaaaacctgacggcaggatcgactctgaggcctcctcactacatcaccagcccgtccggcgacttcgccttcggcttccgcgccctcggctccggccgcccggatggctggtttctcctcgccgtttggttcaacgacgccgtacaggagaaggcggtggtatggtacgcgagggacccgggctccgggtcggcggtgacggccacggcgcagtctgtgttcagcgtcaccctcgccggccagctgtcgctcgccgacaccgccggcagcaacgtctggacgaacgcgaacccgggccagcagtacggctccgtgctcgtgctgctcgactctggcaacctccagttcctcgccgccggtggccgcgccgtggtgtgggagagcttcagggacccggccgacacgctcctccctggccagtccatggccaccggagccggagctacgcttgtgtccaagcgctccgatgccgacttctcggctggccgcttcagcctgtacgtgcaggccgacggcaacgtcgtcctgtacctcaacctcgccgccggcaacgtcgacccgtacaacgcgtactgggcgaccggcaccaaccagcccggcaacacccaggacggcaacaccactctcttcttcgcctcgccggggcgcgtctattaccaggtcaaggacgggacggtgcacgacctgacaactcccatggcgaaggcgaactactaccagcgcgcgacgctcgacccggacggcgtcgtccgcgtgtacgtccggcgaaggagcccgacgagctccacttccaccaccaccgccaacgcgtcgtgggccgtcgccggcatgttccccggcgacggctgtagcatggggacccgtggcctggacggtttctgcggccccaactcgtactgcgtcgtgtccgacgacggccggctcgactgtgcgtgcccgagcggatactccttcgtcgacgcgcagctacggtaccgcggctgctcgccggcgttcgcgccgccgaggtgcgacttcgtcggggacgatgtcgccaaccgctccggcgaattcgtgatcgccaagctgcccaacaccacctggacggcctcgccgtacaaggtatactcctacacggcggaggagcagtgcggcggcttgtgcctgaacgactgcttctgcgtggcggcgctgttcgacggaacccgctgcaccaagatggcgtccctcacgggcgccggacggcaggggagtaacgtcacggggaaggcgctgatcaaggttcggacgcgcagtacccctccggcggcggcggtggcgcggaggagggcgccaccgctgccgtacatactcctcctcggtttctcggcgtttctcctgctcgcctctacgaccagcctcgtgctcctgcaccgccgcattagaagaagaagctccagcgaccatgacatggtgatgagactcttcaccaggaaggagctttacgatgccaccaatggtttccagaggttgctaggaagaggtggcttcggcgaggtctaccatggcgtggcgaattcgctgcatctgctgcactcacctgacactgacatcgcggtgaagaagctcatcgtctccaacgagtacaccgagagggagttcgcgaacgaggtgcagtccatcgggaggatccaccaccggagccttgtccgcatgatcggctactgcaaggagcgggagcagcggatgctcgtcttcgagttcatgccggggggctcgctccggagcttcctcttccaccagcagcctcgacgacggccgccgccgccgccatggacctggcgcgccgaggcggcgctcgccatagctaagggcatcgagtacctgcacgaagggtgcgcttcgccgatcatccactgcgacatcaagccggacaacatactgctggatgacaagaacaacccaaagatagccgacttcgggatctccaggctcctcggcgatgagcagctgcacaccacggtgaccaacgtgaggggaaccagagggtacatcgcgcccgagtggctgcacggcgacaggcgcatcgacaccaaggtggacgtgtacagcttcggcgtcgtgctgctggagatgatttgctgcaggagatgccaggacccgatcaccagccagcttcatcaggatgacaatggcgattgcgatgatgacaccgtcactctgttcgggtgggcagccgggctggtcagccatggtagggtggaggtcctcctgcgcagcgacgatgatgcggcggaggatctggagagagtggagcggttcgctcgtgtggctttctggtgtatcgtgcacaatccgtcgctccggccgacgatccatcaagtggtgcagatgctggagggtgtggtcgaggtccacgcgccgcctcatcttccgagctatacggattcatcgtcgtcctcgttcatccatacggattcacctgctctcaggccaagaggctcttcttgtccagtcgaactcgatttgatttgagggcgtaaactaagctagtactgggaggaaaatgtggtaactctcgaatatcttctcagactataaatttcgtaacataggctgtgttagatccatagtctaaagttttggcgtgtcacatcgaatatatagacacacatttaaagtattaaatgtagactaataacaaaattaattacaaaatccacttgtaaactgcgagacaaatttattaagtctaattaatccgtcattagcaaatgtttactgtagcaccacattgtcaaatcatagagtaattatgcttaaaatatttgtctcgcaattttacgtgcaatctgtgtaattagttattttgatgcgatagggtataaaattttgccaatagatctaaacgaggccatactaacatgcatattggattcatcacattattaaataacgttgatggggaggactcctaatacgcgcagtggcgcaattgcgttagttcgcttagagcaggtacagtaatgggcggtggtagttccacctaggattttgggatgatttggaggagagaggggaagagagagagagtgtgagccggcgactaatttatcgccgggctgcacgcgccgctcgagattgtggggcccaccttgtgctgcctcttctcacagcaaagtgcaaggcatggagaagcatcggccatgccttgagctgcatgcctccgtcaccaactcccacggccaccggaccgccgcccacagcctcgccggcgccgacgcacgacctctgctgtctcccacatccggcgcatggcctccgtcgcccccgcttgcacggtcgccgccgtcttccgcctctgctgcgcggcccaccgccgtcttccgccttagctgagcggcccggccactgctgccttcgccgcccgacacggccgccgccgtcttccacctcagctgagcgggctggccgccactgtccccgtcgtccactgcacggccgtcaccgtctttcgcttccgccgcgtggcctggccatcgccgtcttccgacgtatgccgcacggtcgccgccgtcttctgcctcagccgagcgacccggccgtcgctacccctgtcacccgccgcacagtcgctgccgacttcgcctccgccgtgtggcctggctgccgctgcccccgtcactcgccacatggccgtcgtcgtctttcgcctccgccgcggcccggctgccgctatctccgacgtctgccgcacggccgccgccgtatttcatcgtcagtgataggttatcgaggggataggagaagaagacgaactgtgaggggataggagggagaaagaggatgtgaggtaggagaagatggtgggtcccacgaatcaataaaatatgcgtgttacaatatttctattgtagacattagctacactgttttatatagatgatatggctattttttttggagtcaacagcggtctatattattgaccttgctcttagtacaccggctgcacgctatcaccccgttaacccccctatttctatctccaattagacctctttaatttctttcagcaataaaataataatataaagttgaatcggaagttttattatctaaacacatattaatacaaagttgaaagtttcaaaaattttgaattttcagaagaaaattttaaaaattcagttaaacgtttgaaattgagttcaaactttaaaattccagttgaaaggtttttataaaaaattgagttgaaagtttaaattttggttaacattttgaattttgaggtgaaagttctaaaattttgttgaaattttaaaaataattgttcagaaattttcagtataaagttttaaatattcagttgaaagttttaaaacttggttggaagtttttgaaatttaaactgaatgttaactcactttttcaagtttcaattcacattttttcattggaaaaataaaatgagagcgaaggatcaggcgcggctacacggacaccgcatccgctctactccgtatgaccatatcaatagacagatatgccatgagcctgttgggctcaaaatgttggcacgtagcgaagctgcacaaattagatttctcgtataacgtgtacagctgcactaaatgtctctatcttcaatcggtgaaatttgactcgtcaaaggtagcaaatttttaaggtaggtcgatcagtagtgtactactccctctgtcccatactcccattagagcaagtttaataatataatcaactacgggcttcaaatgatctataaactaatctaataacccattcatacaataattaactataaaactataatacatattaatatctggtctcacatcttatacacacataatgtctggagtccgtcttgcggccggctacaaatatgtagcatgctttcttctctctcttctctcttcacgtcaatatgtggttatagctggcttatagtcagctattgtacctgctcttataattataagtgcagtcataagttttcgtgtccaacatatgatgtttaaagtttcaccgtggccgagtttagttacaaactttttcttcaaacttccaaattttccatcaaatcaaaactttcctacacacacaaacttccaacttttccatcacatcgttccaatttcaatcaaacttctaattttagcatgaactaaacacacctcgtgtttagtttcctacacacataaacttccaacttttccgtcacatcgttccaatttcaaccaaacttttaattttggtgtgaactaaacacagcctttctatgatgttttttaataaaatctagcaaagcatgacacccaaaaagagttcaaggagttcaagggtctgtagcaagttttcaagcaagcaagtttaatactatagccaactactggctccaaatcatctatagttaacttaatagctaattcatacaatagttacatataaacatatagtactacacaatcaatatctggtcccacctatcatacacacatgtgttttgaagtccgtgctgcatccggctataaatttgtagcccgctgctcttatcttttttcttttatctttttaaaataggcagtgtatcctatgcacacaggccctcgcgtgtacacaccgtgtacaccaactaaaaattatcacaaaaaattctaggaaaattcatatatgtactttcaatagtattacatctacgtgcaaagtcgcatcttcaaattcattctacatagagaataacaaaaaagataaaattatgacaaaattgcaatcttaaaactgtcagattttttgttttttttgttacggctaaaatacagtgaatttgacgttaaaattttaaccctaggtgtaatacaattgaaagtatgtgtatgattttttctaaattttttagtgatattttttagttggtgtgtacgtgtgtacacgtgagggcctatgtgtataggatatgttgcctttaaaatatgtttgtagttgacttatctatctatctatctagagctggcgggtcttcccgctagctgattggtggagatgacggcttgtattttcagacacgtggcgtgaaccaacaacgtatagatgattctccagcgcggctgctgttcttctctatccatcgcgtacgtacgcgtgcatctgggcctaaagcacctcctgcataagaagcccattatctagccgccctgcggtatggaaaaggaataagtttatatggggtcccttaacttgttaacgaatccgattttcgttcttctaccgaaaaaccagatacaataggtccctcaactatcaaagccagtgcagatgagatccctcggcggttttaaaagtggttttagctgacgtgacgcctacgtggctaatttgacttagtcttcatctgatgtggtattgacatggcgcttacgtgacaattcaatctcgaaaaaataataaaccttatgagacccacatatcagtttcacatagaaattaataaaaaatggtacggcccacgtggaccccacatgtcattctcagccccctctccttcctcctctctctctctccccttctccctctcttcaactctctctcccctctcctctctagcgacggtggcacggctccggcggctgtggccctggctgcggcacccggcggagaggagctgggcgtcggtgcccatgccaccgcctcctccattgacctcgccgtcgccgacgacctcccgcccaaatccgccgacctgctgctcccgaatggacgcgaagttctgcagcgtgaggccatgctcccggagcgcgtcgacaagttgcagacttgcagcaatttgcaccaatcagattagtgcaatatgatccatagttatctaagaaagagaggagtatgttgtaatcatggcctccagataatgttttatacaccaagatggtaaaagcaagtttaatagtatagccaactactagctccaattcatttatagccagtctaatagctaattcatacaatagttacatatcacactattaatacctggtcatatcacactattaatacatgttcccacttgccatacacacactgcgtcttagagtgcgtgctacagctgacttatagcctgctactgtacttgctctaatataatgcatttggaatgaggcatcagaaaatgcgctttaggaatcaggtcaagaatatccttgatccttaattactctttcatttgcagaacttttcgagtatactcaactgcatcaagaggtatatactctttctaagaaaagaatggcaagataaagagctgacattgcagagtaacaacactgctactccagtaaacactgagaggcagagtgtacatatgtaaatccaactcattttcccattcaactgctaattgccatgctaattactaaattgagcatcgaaaggatcaaagaattaattaacccgtcgccgccgcggctcctgcaaccaacctgcaccttcgcgctggtgccggcgatcaagaagcacccaggcttgctcccgagctcgagcgagacggagccgggcttcccgtcgagccccggcacgacgttgaacatgggtctgagcttgcggcgctccttgtgggcggtggcgagcgcgtcgtgaagggcggggagtgagtcgggccagcggcctcccgcccaaatccgccatctccgcccacccccgcggcggcgccaaccaccacgctgtcggtctcctccaccccgccaccctggcccccaccgcggcgcccaccaccccaggtccggccaccgcgccacccaccaaatccaccaaggcacccggccaaggccaccccgccgccgccggagctcgcccacccgcctcgctcgcctgctccgccgcccacccgcgccgtccgccgcccgggaagacgaagagagagagagagagaggggggggggggaagaagagagaagtgaggacgaagaagagagaagggagagggaaggcaggactgaggctgactccatctgaaaaaatccttccgaatccgcctcggccgatgcatgatttaccaattttggttgttaacagatggagacctagtcaaactagccacgtgggcaccacgtccgtcaaaaccgccttccaaaccaccaagggactttgtttatactggttttgacagttcaagaaccggctgtatctggttttagggttcaaagatgaaattggattcgatgtaaaattaagggacctcggatgaacttattcctatggaaaattaggggaaggagcaaatgcctatgtcagcccacttgccctacatatacacgttcaatagtcattactattctatagtacatttacaaaaaaaaaatgttgaatgcatatatatacaactactcatattcatacatatctctatgagtatttttgaaatattgaactgcatatcttaaaataaaaaacatattttatttcttcgtactaattcaatagacactattaaaaaaatctaatttttggctcggttcactttactccataatagcacgtctcaattttattactctttgtattaattgtcttttaaactgaaccatacatgggatcattattaaagttcatttttttaaaaaaaatgttatggatgtttgcttgaactttaaattgtgatgtttaaattagtcttaagtgctttcaacctacataaacaatgagaaaaaaaataaaaaaaaatgttgagatgtatgtttgtaaatgcatgcaaaatatgacttatctaccctataattcactaacttcaccaactgatctactcattcatcattgtccgaatctaacggacggtattatctgtattcgatcgaacgaccgagattgcttggacgtcccctcgcagatcgctcccacccacgcacgtttctccgcctccctcacagatctcgcttccctcccacacgccacgcgattttctccgccttcctcgccgcctctttcccacaaccgctccacgcgcttatcaatcgcacccgcccgccctctcctgtcgccgcctcctccgctccccatcgccgcctctccctccaccgctccgcccccgatccgtgaaaaaggaagaacgccgccagccgctctgcctccctgcagtcctgcacccaccattccaccaatctgtgcggccacgagtaccaccgccggcacaaggtcttctccaagacccgtcgtcgtcgccagccagcagcaatgcttcgatctgtcaacagtgcagcagccagcaggtgcctacggtaactgaggctacccgggccatgcatttcttcatcatatcttctgttcctttcttcaaagctgaagtcaaaaactgattttggacctactaattggaccatccgttatattaactcattactttttcattcttcataaataaaaattttaatttctggtaatggagattggattgctggctgtcctccatggcatctctactgctcactgagcccactggatcatccagtttgccaccaggtacattgctttgtgtatatgcttccctactgctcgataatatgattcaatggtttaattaatctcctgtatatacggagttcatggtgttttcaacagctcagatttatttggtgtatagtgtgattcagtatctgaaacaacaaactttctctcctcggtcctctcatatcttgatggaggacacaaatggtaccgtaatccatggcatcacggtgtattgtgtccaagttgggaaaaaaatatacatatagttctgggtttttttctgggtggcaactagcttgcacatggtaatagtagctccaaggtattatttcatatcactcttgagtacatgaagagtttttctttaaaaaaaatatagatgtagttgtcgatctgtttacctctgtacaatattcaagcgtcattcagtgtctgaggcattcagtgctgatttatcctagatttagatttggctgtatgtaaatacttaacaaaattgatgtgattttccattggagaaaattgaatctacggtgacacctgacctgctaggcggtgatgctgcccactggtgttgctgaatgttttgtcgcagtgaggatggagacctctttaatcagaataatgactttgcaatcagccagatgacaaactatcagctccgagatatcccatgaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16460 - DNA, 26739 bp, Oryza sativa
  unsure (1)..(26739): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctttgagaaggtccaatcttatacatcaacccagtacaagtggcaatctgacttggaggatgatctaaaaaagatcgaatccactttgataaaaatccaattggtgctgggtgctgctgaaaggtcgcaaatgctagattgcaaccaagaagctctactttgccaaaatgaaagattctgcctatgatgccgacgacgtcatggatgaatttgattacctgattctgaaggcaaatgctcagcagaagagcaagctaagtagcttggcctccagttctcttgccataggaaagcgtttggttggccaagacaagttcagatccaagttaaggagggtcctcaatagcctgattagagtaaaagaatgtgctgacatgctcatcaaagtgattggggctgaaaactctaattcatatatgcctcctcagccacttcaatggcgtgtcaccagctcaatttctcctggccaaattatcattggccgacaaaatgagcaggatgatctagtgcaccgacttctgagagaagctgatggaccagagccaagcagaggactaacaatatcaccaacaccatctataattaccatagttggcagtggtggcattgggaaaactgcattagctcagcttatttacaatgacagaagaatagtcagtggttttgatctgaggacatggatatatgtttcaaatatcttcaataaggtcaaaatcaccaaagagattttgaaatcaattgatagaaacagtgatataacaaatttcagttttaacatgctccaggaagatcttaagaacaagttaacagcaaagaagtttctacttgtgctagatgatgtgtggtatgatgaaaagattggtgagcttacaaatgctgatagatggagagaattgtttgctcctctatgctatggagctaaaggaagcaaaattcttgttactgctcgaacaaatattgtttcaaggattttgggttgcccagcaccattccatttggagggtctgaagggtgaagatagttggaacctcttcaggatctgcgcatttggcgctgaagatccaggaaattatccagaactagagtctatcggtgaatgtattgtccaaaagttgaatggctcagcattagtcataaaggttgttggtgcacatttgaatgctaacctcaacgttgaagagtggacacgagttatgaaaagtagttcatcaaacaaggaagacattatgcaaattttgcgtctgagctatgaatgcttgccaggtcacctccagcaatgttttactttttgcagcctgttccccaaaggctattctcttgagcctgacttgttggtgaatatgtggatagcccataaatttgttcatggtcatataggcacatatgaaagtatgagagaaactggtagaagttatttcaatgaactattatctagatcattttttcaggaacttcagtatggccatacaatacgttatgttatgcatgacctcatgaatgaccttgcttctcacatttccagaggtgagtactccagaatagaaagagatggtaatcttgcagaaatttcaggaacaactcggcatctgtctatacctgtcgaaagagtaaatgaactccatggattccataacttgcaaaggctgcgcacgctaatagtttctgaacgaaggcaggtctctttgctcaaaactttgtctgcaggcggatgtttttaaggaattcaagtgcataagagtattggatttaagtggctgttgcttagaatttctgcctacatatattgatcatttgatacatctcagatttctttatctccaacatgttggataagtctttgtgatccttggttgtgattcttctttttgcttttggatagtttcacctttttcaggacagcatctaccctttagcatatttttcaggtgctaggacagctgcggttagtaggacagcaacagttagcatcttctttatgcctcctttatgctttattcagtttggatgccctctaggacagcatcccattcaaatttcgaattttagactaggagggtgtagcaataggctagcagccagctctggctatatatatgtatccaacctccctcgggtaggtatggcttttgtgtttttgtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcactggttgctcctccttcccctttcccttccccctctccacgcagcagccccccggaggtgcgccatgtccgacgctcggtctcggcgtttggtcgcctcgagcacttggcgtcagcaggacgccgagctcgccgcagcagaagagcgcaggcgagcaacggctcagaccgctgcagcagcagcagcgagggtggccaaactggcggcagtggagttggcagcagccagggcggaggcggaggcggaggcggcggaagatgcggcacgtgcggcggaggtagaggttgagaccttgcgcagcagcatcaacggctccatcgccggcgacatcaccgccgacagggagcttgaggagttggcaagaggaagggcatgggagcgggcagagcggtgggcagcagcccacctccacggcggcggcggcggcccaagggaccgcgcgcccgccgacgggaacccagacgggcgctggcgtgccggcggcagcccggagcccgcacgcggccctcgcaggcagcgcggctctctctcccctgactggcgccatggtcaccacggcgtccagacggtggtcagggactttggtcccggcggtgggtggcctaccctcaccaaaaccaactacatcgagtgggccgcggtgatgagggtgaggctccaggtgcggcacatgtgggaggcagtccggtacgggcgacgtcgactacgacgaggatcggcgggcactggatgccctcatcgctgcagtcccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctgcccttcaagccaggtgaggatgttgatgactttgctctccgtctcaacactctcttgcagaaaatggtgcagtacggcgacgacacctacgacgaggagagagctgtcgagaagctcttccgctgtgtccctgagaagtacaggcagatcgctcgctcgatcgaatctctgctggacctctccacgatgtcgatcgaggaggcgttaggtcgcctcaaggtcgtcgatggtgatgagccacagcctctctcggggcccatcaccatcggcgggaagctcaatctcactcgggagcagtgggaggcctctcagggtgacgggaggaagggggagtcatcttccccgacaggcggccgtaagccgcgcaaggcgcggggaggtgtccagctacggtgggcgcgaagacgtgccgagggtggcgcccgcagaggcgcccagggcgttgccaccggcaaccacaagccggcacgagacaacgcctgccgcaactgtggcaagcttggccattgggccaaagactgtcgacagccacgacgtggccaggcccacgtcgcacgggtggaggaggaagagccggctctgctcctggctcatgcaagcatcgagctacctccagcggcaccggccgcagcggctttcctccaccttgatgagccgaaggtactcgtctccctctgcaacggctccagcaacgacaaggctgatgggtggtacctcgacaccggcgccacccatcacatgaccggctgacgggagttcttcaccgagttcgactccagcgtccaaggctccgtcaagttcggggacgcctccggcgtggagatcaagggtgttggctccgtcaccttcactgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcaactctacatcctcagcgcgcaggtcgcacaaccagtttgcctcgccgctcgtcgggacgacgaggcgtggcagtggcacgagcgcttcgggcacctccacttcgaggccctgaagcagctcagtgctaaggagatggtgcgaggcatgccgtgcctggaccacgtggagcagctctgcgacgtttgcgtggtgacgaagcagcggcggctcccctttccccagcagacgagcttccgagccaaggagcggctcgagctcgtgcacggggacttgtgtggcccagtgacagcggccacaccaggaggacgacgttacttcctgctgctcgtcgacgacctctcccgttacatgtgggtgatggtcctcggcagcaagggagaggctgcggacgccatcaggcatgcgcaagctactgcagaggcggagtgcgaccgcaagctgcgcgtgctgcgcaccgacaacggcggcaaattcagttcgcgtcgtactgcgctgatgagggcattcagcgccactacaccacgccgtacagcccgcagtagaacggcgtcgtcgagcggcgcaaccagacggttgtggggatggctcgggccctcctcaagcagagggggatgccggccatcttttggggggaggcggtggtgacggccgcctacatcctcaaccgctcgcctaccaaggccctcgatggcaggacaccgtacgaggcttggcatgggcgcaagccggcggtctcccacctatgggtcttcggctgcctcgcgttcgccaaggagcttggccacatcggcaagctcgacgacaggagcaccccaggggtgttcatcggctacgcggagggctcgaaggcctaccgcatcctcgacctggagacacagcgtgtgcgcactgcgcgcgacgttgtgttcgacgaagggcgagggtgggtatgggacaaggcggtggacgatggttcgactccgatgtacgacgacttcaccgtcgagtacgtccacttcgagggagctgggggagtaggcagctcttcttcatcgagcgtgtctaccccagcccccgaatctccaccgactccgacaccaacacaccctcgggccacgacttcgactacgacgagctcttcgtcgacaccaccccagccagtgactccacatgctccagcaccaacagtcactcctccaagcacgtctacttcgacgccagctcgtgttgagcgcagcccggtggagttcgctactccgctctcccacgacggggagcgcatcgcataccacgacggtgagcagctacggtaccgtacgatggaggatcttctcggcgaccagccggtgccgggactggtgcctcgcgacctagaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttcatgcgctggctgctcaggaaggctggggcgtccatcacatggacgtcaagtcggcgtttctgaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatgggcttcgagcaaagcccacacgaggcggccatctaccggcggggcaatggaggaaatgccttgctggtgggtgtctacgtcgacgacttggtgatcaccggcaccaaggatgcggaggtcgcggcgttcaaggaggagatgaaggccaccttctagatgagtgatctggggcctctctccttctacctggggatcgaagtgcaccaggacgactccgggatcacgcttcgacagaccgcctacgccaagcgcgtcgttgagctggctgggctcaccgattgcaacccagctctcactccgatggaggagagactgaagctgagccgcgacagcacggcggaggaggtggatgctacacagtaccggcgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccaaggtgtcctggcaaggcacacttcgtcgggtacagcgacagcgaccacgccggcgacatcgacaccagcaagagcacgagcgggattctcttcttcctcggcaagtgctcgttagctggcagtcggtcaagcagcaggtggtggccctgtccagctgcgaggccgagtacatggcggcctccgccgcttcgacccaggcgctctggcttgctcgactgcttagtgatctcctcggcagagacactggaacggtggagctcagggtggatagcaagtccgctctggccctgacaaagaaccccgtttttcacgaacggagcaagcacatccgggtgaggtaccacttcatccgaagctacttggaagaagggagcatcaaggcgagctacatcaacaccaaggaccagcttgcggacttgctcaccaagcctcttgggaggatcaagttcctcgagctctgctccaggatcgggatggcccaacttccccacaagacgacgcacaagacttagggggagaatgttggataagtctttgtgatccttggtcgtgattcttctttttgcttttgggtagtttcacctttttcaggacagcatctaccctttagcatatttttcagttgctaggacagctgcggttagtaggacagcagcagttagcatctcctttatgcctcctttatgctttattcagtttggatgccttctaggacaacatcccattcaaattttgaattttagactaggagggtgcagcaataggctagcagccagctatggctatatatatgtatccaacctccctcgggtaggtatggcttttgtgtttttgtgaatgaagaaaaccagaaaattgccccatctcgagtgccatcctcttctcaatgagagtaaccattgaaattctaacacaacatacgcaaaactcgcttccaaattcactctgtaaacttcaccatttacttgtgttgtccatacgctggcattcatgtttcatggacaggcgacttgttacttttcctaagtgcttgggcaccttgagcagcattttgtgtattgatgttcatcgtatgtgcactgttgatttagctgccagcagccatatgccatgtcttcgagcggctggggaattctgtgttgataagagtaaagtgcagggactagaggtgctgaagcagatgaatgaacttcaggggtcgcttgctattacatctcttgagaatgtgaaaagcagggatgaggcaactgatgctcaactattcagaaagagtcaaatctttaaactgaaactgcaatggggttcttctaatgcttctagcaagtctgacaaagcgaatgatgtgttcgatgctttaagacctcactcgggccttgaggaattgattgttcagggatatccagggtgtgtgtccccatcttggttggagtcagagtggctctctagactgagacacattagcatttctgattgcaagtgttggaagttgcttccatctttaggccaaatacaatctctcaggacacttcgtattgctagactgaatgcagtggtttgtataggccccgagttttatgggactgctggctttccctcactggagattctggaaatgatagagttgccagaattggcagaatggtcttctgtggactgtttttttcctgctcttcttgaggtgtgcatcagaggatgccccaagctgaaacaattgccaccagttgttctcccacctgtaagaatgagtatatatgtatctaccgaagtttgcaggctgcgaaatcataatcgcctggagacatgttttactcaggaggtgagcttaagcacactcttggatatgttgcatcttcgtcgtctggaacctgtgaaatgtgtaaatatcatctttgaaggagcaaacactctggaagatggacttaaagatgtaacaacaaatctgccatcccttgaagagttggttatcaggggatgttctgatctgcagcatgcttttgcagctagtaaacagcgggaagaggatgggaatgtcttttcttcggcatctattcaatgtctcaaaatgattggctgcaacctgacagtggacatttttcttagtgtgtttcagaacattagtttcctttcattgtggataaacgattgcaacatcacttattcaactcctgaacgtgtgttggccatgccaaagtcagtgactggagtacttgagaagctgtgtattttaagctgtgatgggttgacagctttcatgggcctagaaacattcttaaggttaagcacaatagaaattgcaagttgccccaagttaacgtcagtgccagactttaggtgtcttccagccctccagaacttgatcataaagaattgccctgagctcaaggaactacctgaaaatggtaacctaacaacattaactgcactggttgtggaacactgcaacgcgctaatatcactgaggaacctgcgagacctttctttcctctcaaaactggtggtcagaaattgtatgaagttaatggctttgcctcagatgattagtttctcttccctcagagtcttgatcataaaaaactgccctgaagtagtttctttaccagaagatggtcttcctgtgtcccttaattgtttgtatttggctggatgccatccagtgctggaggaacagtttgaccagaaaaatggtagtgaatgggagaagtatgaagtgttgccgttttgtttctttgctgataaatcaatagaagatatcgaaggtaaacatctcccatcctcggattgctgtctgtgaaattcaggcacataatatttgaattttgatgatgatgaatctacaatttctttgttgcaaaaataaaacgtcaattgactgactcctattgattccaatctactgcagagatagccaaagaagtacttatggcggatgatcttaccaggatttccattcagggcaatcgagttcatgcaactgattctgcagcaagctcgtccagtttcccttagtaagctctccgagggtaatatgagctgttgtgatatgttgatcattttgcatcatggccctacgtnnnnnngtgcaactgtgcaggtgctgaaattcatgtgcttgtatatttgttccattttaaaccggactcgtttttcctaaaagacaggaaatcgaacatcgtattaccaatttatcatgctggtgcatttacggatgttaacacattggatgcaccacacactgttcaaccgaataatgattgtgcaactcattaaagttagtcacggttattcctcatcaaggaaattattttttattcttgaaggataacttgattgtgattctggaagaacacattggatgcaccacacacgttgcaacttatgctttattagtatcagttgatgtaacagccctatagaaccgcgtagcctagcccaaccgacgggtgggcccaattacacataccatttcacacttacattttcgtcctcgcttcgtgtaaaagggttaacccgagagtggcatggttgaagagacaaggcttataagttggtttcacctttactaaattagcaatgtgttaataaacatacgcacacagctctcatgggccacacatgccgcatcttaattggaccagaatgtcacgtacacctccctcaaaggacttatgtcctgtcggtccaactcaccacatagccacacaagcatataggcaaatgtacaggaacacgctccctcttagcattggaccaactcacccacataaccaccaagaagataggcaaatgtccagaaacatgccccctcttagcactggaccaactcacccacataaccacacatgcaaatgtccagaaacatgccccctcttagcactggaccaactcaccacatagccacacatgcataatgtccagaaacatgccccctcttaggaacacatgcatacatctcacccacatagccacacatgcatataaactcacccacatagccacacatgcatataaactcacccacgtagccacacatgcatataggcaaatatccagcaacacgccccctcttagcacacgtccaatgctggtgctatatgtcatgccatgtgtctcacatagaagccacatgcgccatgcaccataacacactaacccgcgcaaccgcgagggtcggctctgataccatttgtaatagccctatctccagaaccgcatagcccagcccaaccgacaggctggtctacttacacataccactccacttacacattcgtcctcacttcgtgtaaaagggttaacctggaagtggcatagttagagggacaaggccttataagttgtttcaccttgctaaactagtaaggtggtaataaacatgcgtacacagcttttatgggccacgccgcatctaattgggttaggatgtcacggttgattggttggtctcctagcggttgtatcataatttctccataaattggtcatgtgctgtcattttttttctgtacgattgatttaagtttttgtgcatgtagttactcaaagtcataatgaacgtctgatccatctcttgcaaattacaagggcgttatgatcaacgcgataagttttcccccctgcagatatgcagaattcttatggtttaattgcacggtgatactgagataaataccatagcagacgtagttttgcacttttgctcatgtttatccatatagcttatcaaaaacttaataatactgaatttctgagtaaaacttttatatatatgccatgattaaaaattcaaaagttaatgtagtaaaataaactatgattaaaaatcataaaattaactcatgagatttaaaatttggcttataggtataggcacaattaaaatgatgctcattaaacccagtgtaacagtgcaatatggcaggatcagttatccatgaaggcttaatagttctttgagcactcttgccccagaaacaggagaccatctgttcgtggcatgtcattttactaagcaagtaaaacgagaatctgctaacaacttttcctctagcgtcgtctcctctcgggcggcacgggaggtgcccaggccgccgtcgcccgccctccctccctcctcctctgcctccgccgcccgaccggccgccagtaaagccgcgcagcggcaaggacagcggcggcggggcttcgcttcgtctcgccgcacaagggcagggggaggtctgccggcatcgggaggcagaaaccgcccagatctgcgtcggccagccggagttcgcggggagttaagccggcggtggggcagtgtgctcgggcgcggcctttggcggggatggcggcggagctttggaggcgctggcggcggtggaagaggccgccagatccggcgcggatctggcggggaggtttccggcggcccccggtgggggtccggcgccggcggaggaggtcggcgtcctcagggcgatagcgacgacggtgccggtgccacggcggccggaactggcggcggtggagccggacgacgactgccgaggaggcggccggatccggcggcgacgggcgtgacggcgcggagacgctggagaaggaggtgcggtggctgcgacgacggtcgaggggtggccgggtttggtggtcggctggcgacagcagcagcggcggcgtcggctggcgacgacggcggagggcatggaggcggcatcggggcgttgctggctccttggtggcggagagcgacggtgcagcagcggtctgcggaggcgatgactggtgccggtggcagcggcgacggcggccgtgactgtggaggcggtggtgacgtcggcggcggggaaggagtcgggtgcgagtggctgggcgttcgacaacagtggctgtggtggtggtgactgcgactgcggtcaccggaggcatgacagtctcggacggctagccgagggcgtgggagacggctgcttctggcaggcgcggcatcgttcggtggaggggtcggagaccggcttggcgcagagagtcgcagtcgatggtagcggaggccggctcggcgcgagaggcgcgggcagcggagatggaggctggcttggcgcgagaggcgtggccggcagtggaggaggcgacctaggtgtgaggaggagttgccggtggatgtggcgtggtcttcgacgcatgaaagatggccggcgggggatgccggtgtaggggtcccacatgtcggcaaagcttatgtggtggtggagcatcggtgcgtcagccgtagatttgcagccggtgagcggcgggtgaaaacccagtccggccttggctggaccgacaacgatcctcttgagggcgttgtcgtgctgtctcacccctcaagggtgatagccgggcgaaagcccagtcttgattgagtcccgacggacggcggcggcggtttttccgtcgcttctcttcttgcagacatcgttttggcattccttagggggcgatctcgtctgtgtccctttgttggtctagtggcggtcggtcacgcttagcggtggccgctccggtgctagccttctcctgggcttgtgtgttggcgatgtcggtgtgtgggtggtggtattcttttttctttttcctggttacgatcctacagggttgtaatctcgtttttttttcctgctctatcaatataacttcgcaccgtctcgcgcgagccgttaaaaaaaaatttactaagcaagtttggacctttgaggggtcttccaccgagggtatgccaccttctcaaccacctgatgccatcgatcttgcatcttgaggcctgtttagtttgcaaaaagaaaattttggggtgtcacatctgatgtttgactgagggtataccaccttctcaaccacctgatgccattgatcttgcatcttgaggcctgtttagttcgcgaaaagaaaattttaggttgccatatcggatgtttgactgtatgtcggaagaggtttttggacacgaatgaaaaaactaatttcatagcttgcctggaaatcgtgagacgaatcttttgagcctaattaattcgtcattagcacatgtgggttactgtagcacttatagctaatcattggctaattaggctcaaaagattcgtcttgcgattttcatgtaaactgtgcaattagtttttttgtttaatctatatttaatgctatatacatgtgtccaaagattcgatgcgatggttttgggaaaaaatttggggaactaaaccatgccttggtggctggatgcacgtgcagggcttgacaagctgggcaagaaggcgtttgatgcggccttttccctgttttgatggatgatctggaaggaatgcaatgcgcgagtgatgctccgccctttggtctatgtttttttggcttgtgattgtgctccatagtatcttagcaccttgatactaagattttcttttcatcaactgtgttgttgttcacagcaaccaaatttctctttaatcttaataaattttggccggtttctctttgcggacccgacaaaattttttttaataaattggattaatttgatcgtaccattgtaaatgtgccaattcctataaatatcattacaattcgtctattcgtaaccgcatcactcaaattttacaaagtcggaaccatgccttcgctgtcacattttgcatcttcttcctcatctacacgtggggcccatctgttagattcatcttctttctccatcattccctcttctcttggggcatgtggggcgcactcagaacgccacgggggcgtgaccgtcccggcatagctcccgcgtcgacgacagcgaggcggagcgatggggacgacatggaaggatcgcgaggcgtgcacaatttcgcttcggatttctgttgcaccggagcgcgctgcccaccgatgggtggtgatgttgttgcgagccgtgggaagatgatagattggtggagaggaggctaagaaggagagagatgggaaaaaagagaagaggcggggatggaggaagaagatgaatctgacaggtggtcccacctacgaatggggaagaggaggaaaacatgacgacgatggcatcattctaattttataaaattttagtgccacaactacgaatagatgaattgtaacattttaatatatgacgacgttgacgactattcgtcttattaaaaaaatttatataataataatttattttattgtgacttgatctatcatcaaatattatttaaacatgacataaatatttttatatctaaaatggtccaacgttaaagaaaaccaggggagggagtaacatttatcatctggatatacacatttgcagtggcaatggttcaaatagttaaatgcccgggttcatcgcctggcgctgcgccgccccggccaacggcggcgggcgaacgcctccgtcgcaactcgcaagccgggggatccgggagcgctgcgctgcccgacatggatacatggaacgggagctccggttcaccggctggccggcggcgaggggagcggccgcatcgatcctccgcttacgccggaagcaatgtcttgtgtggtgtcgctcggccgtggtaagggtttcgactgcaatcaatctctccacccgtattttaatgatctaatcaactgcgtagacagcttttcagggcccagcgaagcaaccactacattggcgtcgtcccgctgccatttacgaccagatcgggttcttcgccctggcggctagcgcacgggccatgaatttcggtgattttcaatcgctctccctgtctcataaaaaatacctaacctcatagtaaaatgagacgcatcctagtaccagtggcaaagccagaacaaattgaagggggtgcaccactcaactgtacatgtagtggcacgtagaattttcaagccatgatatataaaacgtacgatgaaatgtgattaaaaattcctacttaaaaatgtaaaatcaagggagccataataaaagagatactcagtattgcatcgaaccattaaataagggtgtgtttttgtgaggagaggaaagtagaagaaagcgtatgattaattaaatattaattattttaaacttggaaaatgaattaatatgatttttaaagtaacttttctatagaagatctttgcaaaaacacacggttggggaagtatgtgcgcaaaaaacaagggatttttctccatgcttcaaaccaacgcactctaaaactggtggagtatgaatactagatattagaatgtgataaaattcaaaagtcagggagctagtgccataacttctcaaattgaaattttagtacttaattaggatcaatatacaattactccactttcctaaatcccaacgtaaatcctaaactagtatgtagaaccattaaaataataactgaaattgaactctatatttaaactttaactctttaaggtttgaagtgaagaattcagataaattgaggaaatacgatgaggaagatctatgcccttgcctctatgtcattaacataagcacatacgggagatacacatgatcaataaaacgataaaacaaatgaacaaagcagtacgctgatgcagcaaattgggcaccaactgaacgcgtgcggccaagtgacctcgcggccgtgcgtccgtcgtcctgccgcgctttggccagccgtcggggggtgcacgtaagggagctgaggggggtgcacatgtggcaaaaacaggatatcaagcactgtacagccaatataacttcgcccctgcctagtacaacgaatttagacgtagagtatatctagatttattgtatgaggttggtttttttttttgggatagggagtatgcccccatctctgcactattcaattcgagtctattctcacttattaaattgttcacactccacactgcaaactaatcatgcgccattgtgaggattctccacctaaccctcaacttggtctggttccgagttgcttagtgctaatgctactagctagaaccagaacacgctctgcctttctcgtgctggctgttgctctttggcctgcttcagctttcagcttctccatggttttctttttgtttgctccagcttctccatggttttttttgtttttgttctgagaggaaaaagggattttatatattgataaggtattattcttggtttctttcacttgatagcatgagttcagcatttgtaggctgtcaaatttttaaggatttctccccatagtaaaacgattatattgaatttacttggtggatcttgatccgtatgtagctcctctttgcttcccaggcatatgagttatctatgtttcccttttgctgaaatacatatggagttaattttgcaaaaccatagatatttttgtcaaaactatagatttatgccgctgtattgcaaaaccacgtactccctccattctaaaatataatggatttttggagggatgtgacgcatcatagtattacaaatctagaacatagtattaccacgaatccggacagcctctctatccagattctagaactagaaataggatgtgtcacatccctccaaaatcgcttatatgggacatagggagtatttagcatatggagttccataattcttgacgtttggacaaaattgagggctatctataacttttaaaatatttagtttgaagaagctagaacatgatatagattattcttaaaagtattttaacaaaattaaatatttcataatttccctcctaggaaattttaggaactgaagtctacttaacaaaagacaactgcagctgagacacagagagtccgagatagctgcaacattagtactaatttttttggtgtctaggggtctactggtttaactaattaatggaatcaaggaataatgggaaattttatatagttccatctctgatagtaatcttacatgcatttgaataatgcggattttatttctgaattgttctattaaatgtactgactaatggacaccagtatgcctcacttcgacatgttttctttatgttcttatatttaattaattatcttatcaatgctaggtacatcagttgaaagctgtaaggagaaactgaagagccaagagacagtatattgagcaacatggccactttaccactagccactggagttggatgggtagtatctcctgtcatcaagcttatgtttgagaaggtccaatcatatatatcaactcagtacaagtggcagtccaatttggtggatgaccttaaaaagctggagactattttaactgaaattctcttggtagtaggcactgcagaaaggcggagaacacttgattgcaatcagcaagctttactccgccagctgaaagatgctgtctacgatgccgaggacatcatggatgaatttgattacatgtttctgaaagcgaatgctcaaaagagaaagctaagaagcttaggctccagttctatctctattgccaagcgtttggttggccatgacaagtttcggtccaaattgggaaagatgctcaaaagcttgagtacagtaaaggaatgtgcccatatgctcgtcagggtgatgggagtagaaaactttagttcacacatgttacctgagccccttcaatggcgtatctccagctcgatttcaattggtgagtttgtagttggtcgtcagaaggaacgggaagaactagtgcaccaattgctggaacaatctgacaaacctgaatctagaagcaaaggagcaaggtcaacatcattagaggtaattactatagtcggcaatggcggaattggaaaaactactttagctcaacttatttacaatgataaaagaatcgaggataattttgatatgagggcatgggtatgtgtatcacatgtctttgataaggtcagaatcaccaaagaaatcctaacaactattgataaaagcattgacctaacgaattttaattttagcatgctgcaagaagaactcaagaacaaaataaccatgaagaagtttctacttgtattggatgatgtttggtatgatgaaaaggttggggtacccataaatgctgatagatggagagaattgtttgctcctttatggcatggggcgaaagtaatcaagattttagttacaactcgaatgggtattgttgcaaatacattaggatgtgccactccattctgtttgagtggtctagagagtaaagatagctgggaacttttcagaagatgtgcatttagcactagagatccaaatgaacatctcgaattgaagtctataggtgaacacattgtgcaaaaattgaatggatcggcattagctataaaggctgttggtgggcatcttagttcaaacttcaactatgaagaatggaatcgagttctaaaaagtggtctatcgaatgagaaagatattatgacaattttacgcctaagctatgaatgcttgccagagcaccttcagcaatgcttttcgttctgtggtttgttcccaaaaggttattatttcgagcctgacatgttggttaacatgtggatagctcatgaatttattcaggatcgtggacgcacctatggaagcttgacaagcactgggaaaagttattttgatgagttgttatcaagatcatttttccaggcacttcgatatggaggtacagtgcattatgttatgcatgacctcatgaatgatcttgctgtccacgtgtccaatggtaagtgttacagagtagaagccaatgaacctcaagagatttttccagaagttcaacatctgtctatactggctgaaagagttgaccttcttcgtgcctgtaagttgcaaaggctgcgcaccctaataatttggaataaagaaagatgttattgctaacgagtttgtgtgggagtagattttttcaaagagttcaagagcttgagattattggatttgactggttgctgcttaagatatttgccggacttaaatcacatgatacaccttaggtgcttaattctcccaaatactaaccgtcctctacctgattcactctgcagtctttaccatttacaaatgttgtttctacaccggcattcatgttttatatgtgcaaaacatgtcatcttccccaaaaacctggataacctgagcaatattttgactattgatgttcatagggatcttactgttgatttggcttctgtggggcatatgccatacctccgggctgcaggggaattctgtgttgagaagaggaaagcgcaggggctagaggtgctgcatgacatgaatgaaaaaaaaaactagaatattagggaaggacctaatatcaaataattaggaggggtgaggctttgaacccaggtcgtctagcccaccaccttgtggagctagccggaagacccctgggcatttctcctgcatgacatgaatgaactccgagggtttcttatatttacatctctcgagaatgtgaaaaacaaggatgaagcaattgatgctcagttagtcaacaagagtcaaatatctaggttggacctacaatggagtttttctaatgcagatagccaatctgacaaagaatatgatgtgctcaatgctttaacacctcatccttgccttgaggaattgaatgttgaaggatactcaggctgtacatctccatgttggctggagtccaagtggctatctagattgcaacacatcagcattcatgattgcacatgttggaagttgcttccacctttaggtcagttaccatctctcagggaacttcatattgatggaatgaaatcattagagtgcatcggcacatctttctatggagatgctggctttccctccctgaaaacactagaattgacagaattgccagaattggcagattggtcttcaatcgattatgcttttcctgttcttcacgatgtactcatcagtaggtgtccaaagctgaaagaactgccaccagtctttcctccacctgtaaaaatggaagtgctcccatccaccatcgtttacacacagcatactgatcatcgcctggacacatgtattactcaaaaggaggttagcttaactagcctttcgggtatttttcacgtatgtcaccaggaatctgtggaaattgcagaaattagctttgacggagcagacatggtgaatgatgggcttagagatctaggccccaatcttccatcccaccaaggaccatttatctgctggtatgctgatttacaccgtgcgtttgcgagtttaacagaaatgaaaattgttggttgccccaacataacatcgttgttggacttcagatattttcctgtcctcaagaacttgatcatacaagattgccccgaattgaatgaactacaagaggatggacacctaacaaccttgacagaggttcttatagagcactgcaacaaactggtatcactgaggagcttgagaaacctttctttcctttccaaactggagatcagaaattgcctgaagttagtggctttgcctgagatgtttgacttcttctccctcagagtcatgatcatacacaaatgccctgaaattgtttctttaccggaagatggtcttcctctgacccttaaatttttgtatttgaatggatgccatccattgctagaggagcagtttgaatggcaacatggtgttgagtgggagaagtatgccatgttgccgtcatgtttgtttgctggtgaatcgataggatatggtcaaggtaattcacagcagcttgaattttgaaaaggataggtctagcaattatttgttgcaaaaatattaccacaatccactgatttgtgttagtgccaacctattgcagatatagctgaggaaatacttcgcgagaatgatataatccagcggtcaattcaatccagtctactgcatccaactgattcttcagcaagttcttccagttttcttcagtaaactatctgggctgtcctccgaagctgtaggcctgccggtgatcacctacagcttcatcacatctacctgtgtggctgtgctgacctggccaaaaaaaaaaaaattccacctgtgggttctattttaatcaagccaacttattatgaggcttgtgcattttcacatctaaacctattatttatgcattacagaacattcaccattcattgcttgcgttttatactttttctacaagatgcaatgttgccatctgctcaccaggagtatctttcttgtggagttattttttcccttttctttggaataatcagatatgtatcacacaatatgtatgctggcttttgagataaataccggagattgaaatgacattttgagatttgagcatatcacattaagttgagaaaactcggcagccttttttgcctgcatcatggtctttctaaccatactttctatgctactaatgtattatatatgatatactgctagtatgtgatcatgagggatccaagctgcatttatagaagtcgtagctagttcgcaacattcttactgtttgtcattcacagaagtcatttatatcatttacagaagttatactaggcttgtccgtgtagttgtagcctgtttattttgctgccatgttattagtagctttcagtatgaggatcagcaaaaagatgatggtccccccttgcaaaatacagtgatcactgatcaggttgatctcctgaatcctgggtaaggtcaattttgttgtctgcccggctttttttttttggttgtctgctcaattttcagggaaaatacctctcggctcgttaaaacacttgccaattctgatggtttttattgcacggcgtgatatatagctagatatatagcttttgctcgttaaacccgttataatggcaggatcagtcaacaggcaacccaatcctccatccgttaacatatacgagtatatgattcaagaaataggtaaggcagaagaaaatttaagaaacagctgagcaaatcaaccaagcagcaaccttttcgaactatatttgacgaagcgaatactttgccattttgccaactgacctatttctgccacctctttagtcgtaactacggtatggtcttctatgtttacataggggagatttgctctgaaccagtaaaaatatcttacggtaccaaatattcctctcaatatattcggcccacaaatgaacttggcccacctaatagccatcaaaggattcagcccaccactgataattcccgttaacaaattcagcctgcgagataatttggaccacctaataaccatgattgaatttggcccattactgaatttgcccccacttaattctcgtccataaatccagcctactaatctatttggcccatcagtttccagtaacgaatcaggcctactggattcagcccatctctttctcctcaacaaatttggcccacgtgttaaaaaaacaaaacggcccatatacagaagagagtgaactcatgggtgtattttttggcccacgagaacgtggccgacgtggccaccggcggcgggcgtacgcctccgccgcggccggcgcagaccgggcgaatactccggcgaggtcactggaggtccatggcctgccctcgtgagccgggatccggggggcgctgcaccgcctacgtggtgcgggtgctccggttcaccggcttggccgggcggccgctggcggcggggcgggcggccgtatcgatctacacgctttgtggcggaagcatggcttgtttggcgccgctccgccgatcgccgtggtagggtttcgaatgcaatcaattgctgcatcctttcccccattttctatatggatttcgagacaccacccgtattttaatgaattgcataatgtgcataggctttttcagggcccagctaagcaaaatcatacagctgcctttgaagactagatcggcgtcttcccgtgtggctggctgctggcgcgcttccgaccaaaccgcccagggattccgtgcatttgttatgtagaaaaatatatgtgagaggaagattgagattaatgggacaattgtggcttggtgatttagtgaccaatccaattctctaaagataagtaaagaccaaatcccatcaaattagaatcgatcataatctggtataatttatttattgaattagtgttcacatgacaaactaatcatgtgctgggggaagaaaatgacaactgtatggctcaccatttaaccccatcttgctttggccaatgcccaccactttgtcaatccccattgcttgcagtatcgctacagcttctttatggtttcttgttctggaagggaaaaaagaatttatgccataatactgatcaggtattattcttggtctctttcgcttgatagcaggagtttatgccataatattgatcaggtattcttcagagtttaaaggcttctaaatttcgaaggatttgttttttgaagcaggagcagtgctattcattagcttgacggaagtttatttacaaggaaaaacaaatcaactaagacatgtacttagaattgaagttcaacattgctacgctattgcttcctagaaggtttcaatttcttccttgatcatgaagcgctcatctaccatcttcagttgatgttcaacaattttcctatttgtctccttccattattccaaactgtgtatgttcctattgttattatcctccttctcctgctttatttttcctaccgtcagtgcattcccatgatgccagagtataaccataatttgttggatagagattaatgtccagccaaacagagatcttgggccaaagttgtttggagaatggccattgatgaagcaagtgttttgctttttcctgtacttgatcacataattgaaaaatatcatcattcagaaatcatcttgcttgtagtttgtgagctgttaatattttctcctgcaatagtagccacatgaagaacataaggttttgttatgtttccaacctccagatactagctaggcatgtttgctgaacagcgcaacaaattgtactctataatctgatctagcactgtggattccagaatggcagaatgatgtccatttccaggttatggagtttggatggtcattagaacttatattttgcaattttatccacaagtagaagattgccaggaagttaacatttttacttctatgcaatcctctcatccttttgttgcctgtaaaatttcgaaggatttctcagcataataaaactcacaaaatcgaaattttcgaaggatttttcaggacatatgaattatctatgagtgtgctggattgaagttggtatccccagcagttcatgttgtgcccatgcttttgttttgtttgggctgtataagactctctatttgttccttttggctttctccaaaaaaccgggtaattaaaattacctgttatctaaaataagtatgatttatctatgctttacttggtcgaagtatatatgttgaacctaattctgtcttttgattactcaaatagattttgtgaactataaggaacttgtgaacctgtgtggttttgcataatcaatatgattgcccttctgtctggactgtttcacggggagaggattatttatgtctcagtaacagttgctgacaattgaatttgttggtcccaatcatagtttagtatctttgttctgaaacacctaaatcaggcttacacaagcttttatattttacacattgggctcctaggttgtttcatcctctctagaaattaagcttctgaaaattctttgcatactgtgttttcggctattttggtccccatagttataacaattcattatttatgatatcatgcagggaatttctgattacatggctgagttttcagcaatgagttctgtaggatggattgtttcacctatcattcgtaaaatggtttctgtggtgcagtcctatatatcaagccagttcacctggaagtctgagatgatgtctgatctcaagaatttggagtccactttggtacagattttgttggtggttggcgcagcggaaagacgaagtagaaaagacagtagtcaagtgatgtcattgcaccaaatgaaagatgcagtctgtgaagctgatgatgtcttggatgagtttgactatctgatcaaagaaaagattgaagacctaggcatgttctcatctgttctctctattggcaagcgtttagttagcattgataagctcagatcaaaattacaagaagttataaaaacactgggcagagttagagcttccgcagagatgtttgctcaagttatggcaggggaggtctctagcttcagtcagtctcctgagtatgctccagcaagagccacaggatctcttttgcgtgaagatacaatttttggacggaagaatgagattgatgaactagtaagtatattggtgaaggattgtgatgaacatttgtcttatgattgtcagttatttaatacagtggtgcattctattgttggtgttgggggcatcggcaagactacactagcacaagctatttacaatgatgagcggattactgagatttttgatctgaagatatgggtttgtgtctcccataattttgacaaaactagactaactaaggagatcatagcatgcacagctggcacagaacatattgaattggccagtttcaatttcagtatgctccaagaaaagcttcgagatagactgatgtgcaaaaggtttcttctagtgctggatgatgtgtggtatgatgaaagagttggagagcacatgaacagagaaacgtggaaggagttgatagctcccataagaaatatatatataagttctgaggctttagagagaaagagaacaggaagcaaaatactagtgacaacccgggcc

SEQ ID NO: 16461 - DNA, 2063 bp, Oryza sativa
aattgaggaccaaattgttgaaaacctaaaaggctcagctctagccattaaggtgactggaggccatttaagtggcaaatacaacgctctggaatggaacaaaattcttcagaaaagtgtactcaaccctaatgacattatgacaatcttacgctcaagttatgaaagcttaccaaattatcttcagcagtgttttacgtactgcagtttattccctaaaggttaccgcattgatccaaacaggctgatccatatgtggcagctcagggttttgttcattcagacagaaatatcaatactagtctggaggatattggcagaggctatttcaatgatttgctacagcgctcatttttccaagtgttccgatgtggagaccaaatttactatattatgcatgatgtattgaatgatctggcacttcatgtttctgggggcgaatgccataggattgaacatggcagtccgagtgagttaccccatcatattaggcatttgtctgtttctgctgaactcctggaaaattttgtgagttttggtagtttgggaagattgcgttcactactagtttttaacaagtcttggttttgctcaaaactcagcctcactcatggtatacttgccaagctgaagggggtgcgggtgctggatgtaagtggctgttgcatgaaacgcttgcctgatgctgtgtacaatctcattcacctccgtttcctagctatacagcggacatgttacacactacctaaaacaatttctagacttcatcatctaagggccttgtttgtacagtatcattcatgttattcctctggaaaatttagctcacattgttcctctcacaaacttttgaatctttcatgggggcaagtgaacatagctggaggttgtttcagtcttcctgaaagcattaacagactcagtaacttggtgcatgttgatatagagaagtcatatgctctcatgctaacaggcatgcatcaacttccatgtgttgaaggttcaggagaatttcatgttggcaagaaggggcaaagtattgttgggctgaaggatctgaatgaacttcgtggagagcttgcaattagattgctggagaatgtgaaaacaaaagaggaagctgctaaggccaatcttgagctaaagaagcacataagaaagctggagctagaatggggatcgggtgaccatgatggtcacactagcaatggttgtgatgtgcttaatgtgctaaagccgcaccctaatcttgtcgagctaactataagtggatatccaggtgctacttctcccacctggttgaattctggttggctgagcagtttgcaattgatttgcttacgtgattgtaaaaaatgggaggtacttccacctttaggggatctaccattgcttaaagctcttgaagttcggagaatggatgaattaaaaatactagatcaggagttcttgggccgtaaaggattcccctcattggagagactgctgctggaacgcttgcccaaactagaatggagtattgtagagaacgaccagttgtttcctgctctcagagatctctcattttctggatgcccaaggtaagagaatacccgacctatgtgcgtaccctcagacatattgctatacttgataaggaacaaatccacttcaaggtttttatggacaactttgaactcacaagatcattttgctgcctgttgtcaagcttcttctatgtcttgcgtgttcatcacctagagtttgttgaaaagctgaagatctacgtagatcatttgagagacattcctaaggtagccttcaataatatgaagcaactcacagagctcacaatatttggtttaggatcatcttgggagaatacataccccataattagcacattgtgggatgaggatggggttactgtgcttcctacatcacttcaacgtcttgaactaataaagtgtcagtgtgcgagcaagttctttatccaagttgctgaacaacctcgtatgcctcacacactagaccttggaccttgtgatacaggaggaatgccatctcaattatcattaagcatg

SEQ ID NO: 16462 - DNA, 517 bp, Oryza sativa
aacattgtcctaaacgactttctttacgaatatgaatggagtatctctgtaaactcccaatacctccttaggaactgtccttcagtcagtgtcgtctgtcgtgtcgtccccttccttgatcctctgctctctttcccatccagcctccgggactccggtctcgcgtcaaacgcggattgatcgacaaggagattggagttctgatcctgccaatcaggtatggcgtttgtttcccctgtaacctagcttcattaagttatcctaggactcgtcgcgccgccgcgaaatcgtgcttaggtactccagtggcgcaggattcagtccttataatatcctctatttttttttaaatttttcggaggaaatacagatacttcgggttttcgggatagtacttcatacatgaagcaacgaagtttttgagaacttagtttatctgggcagcatgggccatggaaagatactccagttgatggttatttggatttcggagagggatctgctatcattaggaatg

SEQ ID NO: 16463 - DNA, 285 bp, Oryza sativa
agggccatgatgcaaaatgatcaacatatcacaacagctcatattaccctcggagagcttactaagggaaactggacgagcttgctgcagaatcagttgcatgaactcgattgccctgaatggaaatcctggtaagatcatccgccataagtacttctttggctatctctgcagtagattggaatcaataggagtcagtcaattgacgttttatttttgcaacaaagaaattgtagattcatcatcatcaaaattcaaatattatgtgcctgaatttcacagaca

SEQ ID NO: 16464 - DNA, 554 bp, Oryza sativa
aacacttctgcttaaacacctggtcaaattttacaaagggcaggatctgccatgggttcaactgatctggaattcttattatgactccaaagtgccccatttagtttggaataaagtctctttttggtggagagatatagtggctctgtctgatatcttcaggggaatttcaaaacgcttcatcaggacaggatcctcagctcttttctgggatgatttttggaatgacaagattaggtgcactgcattcccagctttgtgtatggttgctttggatagatccctctctgttaatcaaatgtgctctattcctcttgaggattgctttttgctgcctctgaacacccaagcctatggagaattcatcattctagaggaggaattgtcctctctctctttgcagaatgacaagggtgatgattggtctttcatctggaactctgacaagtacacaaccaagaggttttataagctcactttctcaaatgtgcaagtgccaagaccttttgtttggatctggaaaacaagatgtgtaatgaagatacaagtttttg

SEQ ID NO: 16465 - DNA, 639 bp, Oryza sativa
ccgagtattgtgtgcgtatgggatgcggagtcgaatttggaaggagtccaaatttgatatgagtggttatgtaaagtttatttcttgtacgagagggtttcctaaggtgtttaggacttctagtatgagtttggttcgtgcctttagactgcctacctcgggtataaatagagggggagcgtgagtcttcccggtatcgcttttgagagcaattgagttgatagttgagttagggtttcaagtttagtcgaaatttttgtaaggagcactatttgtgcactttgtaacaaagagagaatcaataaagtcatcatccactttaatagttcttcgatttgtgtttcaccgggtttcggtggtctaactggcgacacactagcggtcagactggcggcatcacagctgtcagaccggcgggtgaccttcggtcagacaagcgtcggcaacaagcaacaggagctgacctctgcggtcagaccggagatctaatcttggtcagaccgacggcaacctggcggtcagaccggcaggacaacttctgtcagaccgcgatccgtcgaattcgagggtacttttatttccgctaaaagtttccgggctttgggtataccaactattcatccctctctgggtggctta

SEQ ID NO: 16466 - DNA, 10410 bp, Oryza sativa
tttgagacgggtcaagatggagaattgcaagccaatttcaacaccaattggttctacagctgtgctggatcctgataaaaatggtgaagctgttgatcaaaaggaatatagaagtatgattggatctttattgtatctaactgcttctaggccagacatacaatttgctgtgtgtttgtgtgcgcgctttcaagcttctcctcgtgcttcacatcgtcaagcggtcaagcgaataatgaggtatttgaatcatacacttgagtttggaatttggtattctacttcatcttctatatgtttaagtggatattccgatgctgattttggaggttgtagaattgataggaaaagtactagtggaacatgtcattttcttggtacatcattgattgcatggtcttctaggaaacaatctagtattgctcaatcgactgctgaatctgaatatgttgctgctgctagttgttgttcacagattctttggcttttatctactttgaaagattatggtcttacttttgagaaaatacctctcttttgtgataatactagtgctatcaatattgctaagaatcctgttcaacactcacgcacaaagcacattgatattcgttttcactttttgagggatcatgttgagaaaggagatgttgagttgcagtttttggacaccaagttgcaaattgctgatattttcactaaacctttggattctaatcgctttgcttttcttcgtggtgaattgggtgtaattcatccttttggcatggtttgagggggagtttgtacctcgtggttttatcaagcaataatatgacaatgaaaaaattgataaaagagagctttgtttatgcatatggtattttcttgtgcatgctaacaatattttgaaggtgtatttgtctatagcatagcttgtatgtattctagtcttttcatgagatttagattttgcttttaagggagatgatgcataacacttaaattctacggcctttttttgggggaaaaaatttttaaaaacaaaatatgcaatgttgatgctagcatatggtttgatttataaatgctctatacatatgctttattgacttgttattcctcaaatacctttatttgctcattgtgaaaaagagaataaaaatataaaaaaatgaataccgaatccttggaaacagtcttgacgacaaggacgtattcgatgtgagcaaaataatgggtgccgaatccctggaaacagtcttgacgacagggacgtacccggaataaaagagaaaaatatgagcaaaaaggctcaagaaaagaaaaagttcaaaaaattctctggttattttgtgctaaaggttatttgagaaagagtgataaatgcaataggtatatgtgtttagtgtttcttcttcaacctatgtgcttgttaagatgttgcattataaatcgtatgaaatcatgaattttgattgttgattcaagcttcattgtaaaatctttggttcatggttatactttaatgcatgcttgttctgttatagatgggttcattttctttttattgcaacacatgacttgatatgctatatgtatgctaagctcttgaacattaatgaacataattcctatgcttgatgaaatcattgtcaaaagggggagacataatgtgaaaatttttggatttttggagaagcaaagtgaatttttgagaagagcatgtttttggttcaattgggaatttctttcttttaaaaagggagagaagttttcttttggatttttgagcacgatgtgtacatttgtacgaagtgtgctttttaccaccaaataccaaaacatttttatggatttgccaatgtgttcatcaagggggagattgtaaaatcaatggtgttttttattattattctgtgatgaacaattgggcattggaaattattggttttgttatttggaatttatttattcacgaagtggttttggagatgattggatttcacaggtgaatatacagatactgctgtgattttatgtagaccggtcagaccgggctctggtagccggtcagaccggcgtgtaatgcgccgtcagaccggcgcagcctgcggtctgaccggccgacactgtgtcggtttcggtttcgggttgtttatttggatatccgagtttattccatgattatgacttctagatggatactatacgcatgtaatactattgtttactgctaatgagtcaagttggagatagcttggtctcggaatatggtttctttgtttgtttcatgtgtaggtgactcgatgtctcgggagagtatttgcggtgatggaccgggagtcggcttggggataagacgacgtccgtggtggtcagagatcatgcgggatacttaggctagagttgatgcacgtggttgatggagattccatatggcatacgatggaggaattgtgtgcgtatgggatgcggagtcgaatttggaaagagtccaaatttggtacgattggttatgtaaagtttctttcttgtactagtgggtttcctaaggtgtttaggactcctaatatgagtttggttcatggctttaggctgcctacctcatgtataaatagagggggagcgtgaggcttcccggtatcgctttagagagcaattgagttaagttttgagttagggtttcgagtttagtcgaaatttttgtaaggagtgttgttggtgcactttgtaaacacagagagaagtaataaagtcgtcatctactttaagagttcttcgatttgtgtttcaccgggtttcggcggtttaaccgccgactcatcggcggtccgaccggcggcaaggcggcggtcagaccggcgggagcaaggcggttggaccggcggccgcagcaggcgcgacaggcgacttcggcggtcaaaccggtaaatctataccggtcagaccggcgacattcgagcggtcagaccggcagatcaatctcggtcagaccgacttccatcgatttcgagggtaacttttatttccgctaaaatttcttggtttttgggtataccaaccattcaccccccctctggttggcttagttcttgtgattcgatccaacatggataaggagtgtgtgttgggttgatgaatgatgaggagcgctgtgctcattaagtatcttgtctcctccagacaggatgccatgatgtaggtttgtgtgtattcatgtagcttgagtgattttcaaaggaaattgcaatctcattgtaatttgagtatgctaatggccaagaattgtcttaaaaagagggaagcaatggagtttgtgtatttttgaatggtgtgttctgcacttgtcacaaacagtgcatatacctctatagataccaaatattctagaaataattaaacacaacacttgcacacccatactcagttaatcttttaggtaaaataggctgtccaataagcaactctctccaaagatgtaccccaacaacagttctggcactcagtaccacaatgcaacaacttggctagtgataggtttcttgcttttaggattaaaagcgaaggccaacccaaaattagctatcgtaagttccccatcttcattattcaataatccctccaatttatattataagtcattttgactttttccaaataaaatttgatcatgattgtaaaaattgcagtgccaattttgtaaaagaaaatacatgtccatttttttagtaagtgatcttaaaaaagtgaaatcaaagattgcaaacaattttataccgtctatgagatctttcaattccatgctaagagcgacaagctcaatacaagtgaaaattaatcctatcaattgattttacgtttgctcaattttggaacttataaatatcaagacttcaccacagtttttttaagtagtcaactaggagaatccaagcaagctctgaaccatatgtaaccaatttcaaatcattagcttaaatatggttctatcgaagtataaccattgacaattttccgagaatgaacctttcttgttttagtgccatgtttgatatcaacaatgttcattattcgagaaggcattctatgttagacattaaggatctgtttgaaacacaagattgagaaagtgaaaatagaaaaagacatgattttgataggatgacaagtgtaaaaacataggattgcaaaaacaggaaaaacatgaatgaccgttacaatagaccataggaaaaagcaaaaacaattagaggagagataattaaagactcaaattaaagtttccatgaggatgaacctcactctagcttttttccaaaacttatgtggctccaagcatcaaataggaaaaatttcctataggattcaaatttgataaatttctatgttcttcctagaaatcaaggggctctatagctttaccctaggttgattcatgagccccaacataggctgcatattctatgttgagtcctattgaggttggattattatgaaattttgtatttcaaagtcaatcatttctaatgtgaataggtatctgatctttcaattggttcgatttgttgacatgaagatattcacattttgaggcttccgatcagacgatcatcacttgtaatcgctacaccccgcacttctcatcgttattgaccactctctcataattgacctcactaggaaggttatgtcctataaacattcaaagaaattcacaagaacaaggaaaagtgaaatctgaattgcagatgaacgattagcacttgaaattggggttgcacaaaccgaccttgcggcaaaactgcatagtgacagaacaatctaagcaaaacctaatccctaaatacgatgatggttgtctagcagtctgaggtcgtccataacaaaggctaactaaacatgactcaattagaacacccaagggctaaactatatttggaccgaatgaggtatgttagttgtttcgcagatttcgagaagctcaggtggaattttgacgtgagactataaccatctaaaagtagagttaaagacctatccaatctggagataatattggcaaggggatgatcataagaaaaggtgcagacttgctagatgggatattatttgccaatccaaatatcagggtggtttgggggttcataatctggagatacaaaataaatgttttttgagtaaatggttgcttaagttaataaatgagcaaggggtttggcaggacttattgaagagaaaatatctttataatcagtctataacccaagttgataggaaatagggtgattcccatttttggtcaggtctcatgaaagtcaagagtattttcttgaatatgggttctttgattgtgaataatggggaacaaacaagattatgggaagataaatggttaggtaatgtggcttttaaagataagtatccatcattatatgctattgttagaaggaagaattcttctgattgtttttcatggaactttaatcagaatggacggttctctgtaaggtcaatgtatctagttttgattaacaatggctatattgaaagggataagataatttggaagcttaagatgctgcttaagattaagatttttatgtggtacttgcttaaaggggtggtgttaactaaggataatttagcaagatggatttggaatggtagcttaagatgttgtttctgtatgaaaaatgagtcaacacaacatcttttatggattatcattatgcaaagtttttatggagagctgcacagttctctttttgtttatacctccctattagtatatctcatatttttgatgggtgactgttgggggtggacaagaaaaggagtaaacttatattggtgggagcttctgcaatatgttgggctctgtggttgagtaggaatgatatggtttgacaaatcaccatctatttcttatatgtaggtaattttcagggcaacatattagctccggttttgggcacaactacaaaggtgtgatgaatacaaaggtgtgatgaagacggtgagtttttaaaagttgtatgtcgtaagcttgagatgacggttatgcagctttttgccaattatggatggagattcacaaatatacttcaataatgtgttctcctgatcttgtattggttaaatttacctttgtgtggtcatttcattctatcatttttgaactacactcgttttagagtgctagattgtaataatgggttgtagctctttttgagcaaaggccaggatgtttattccattatctaaaaaaagacctatccaataattatttatgggcctaacaaatgcttctggattagcagctaggtccattttaatttgatgctgccaggagggtcgaattcgagtccgaaacatgtaaaatactatctcttgccttctagcaccttagtaatgtagtgacatggaaaaatactttggggggggaggggggggagaacttcagatgttcctaatcaacttcattgatcattcattgtctccatgtgtatgctcacctttgcttgataaatgctaacacttctgaaagggaagatacataaaattcatggtgcatcattctatgtccaaacatatagaaacaaaacccaatataaaacacatgcacattttatattatcgtgttgatgtggaacatgggaatggtcatatctaagccggtgatgttctcatcaattcaattctaggaactgtgcctatgccctaggacaaattttactggctatatttgtgcttgagtccatcttcctcctttctgctgcccattattttccaatggtcggaatgagaagtactataatcttcactagaaccattcttcaacacgacgacatacacgagactggtatggccatgttcaatttagattattgagcacattattgtcaaggattatctaataggctatatgtatcaattaaatatttcaataaataaacttaacattaaaacaagtggtctaagcacaaagtataaggaaataaacataataaatggcttaaaacatatttttttttgaagtgtggagcagatgatccaattcaataatctggtgaatattgttaagttaatgtatttctaccttgggccccacataggacttaagagtttagagaagtggttagccaaaaggctactaaggattgattgtaaggaaaaaaaatcataaccgctcaagagcaccatatgaggaaacaatgtgttattgagatagccttttccaaaaagaagcatatataactgttaacgccaaaatttggtaagcccaaagtcttcatcggcctagagtcagtatcgtcttcagagtcttggaatcggccaatgggagttgtcaagtcgccagcagttgtgttcttgatggagtcggatcaattaaaggaagcttatctagaagagtccgagttcaaggaggatgcgacatggcagtttatctattaattaggcagtatttgttagttcccttttatctttaggaaggtgtgtttagtgtccgataaggactttatgttttccttttatctctaggaaagtttctttcttgtcctataagaactagtatttacccatgggtataaatatgtacacccagggttattgtaatcaatctctcgatcaatacaactactctcggcgcatcgccaccctctttaccgaggtttttatttatcatctgacggaacttggcacctgacgcggggctgtatcggctttcgatatccggcgaaggggtaactcctacgttccgccagccctggtgaatttatcggctacgttggtgttgttcaaggctgcatcgcttcgatctcttggatctctctggtttggttgatatatttgcctacctgatatctcaattctatctctaattgcattgtgtttagagacgtatcggtttagttgggactgtctcggttaggtccgatcttctgtcttagccgatatatctctacaatcacaatgttgttgtaaatagatttgttatatccatcacattagacagatctatcggctcatcgagtattagattatcatatacaatctcgtgctgcatcggttaagttcgacctactagattgttgttgataatataaatcttgttaagccgataggttcatgctagtgttttatcggggtgctagccgataagttatctggacgttgcatcggcttataaggattacatacaagttgggtttagccgatcgtaacaaaggtttcactgtttaatctaatcttgtggattttatgacatcggacctccagccgatatatactttaaccttcggatcaatgcttatctgtcatatcattattagccgattggtttctattggattatattattgttatattttattatcatcagtcgattgtcttcatatcattatctacattgaacatatagcctattgctcaaaaccctatcgacattgactggaatcggcatcggctattatcggctatcggctggaactactctatcggcttatcagccaatcggctcattgatctactgtttacatatcttgtcagttgaaggatcaaactgactggcacgcccgcacctcactaagatttggacctgcacaggagctaagcagatctcccaggccagtgtgtgtttttcgcgttaacaataacacaaaagcttcaagcattacctcgtggattcaaaaccttagaatactttagggtaaaaactgaagcggtttccacaaaattgtgaaatatttcttgttgggcgtaagaaccaccaacattagggtaataaattctttaattctatcagattaattgtccatggatttcgagggttggtacctcttataattaatattcacagctcaaggaggggaaacaattcattgcagtacaaatcataagttgatttgtacatttattatgtagattttatatctatttccattaatgagtacctcttataactctttctatataatggagttccatatagagatacgatgctcctacatttcaagatgtctaagcataacctaggattatctatccatgttatctatatcatgtttgctgctcaccaaatcctgggtggaggatttcatctgaccaaccaagatgtgaatatggtaggcctatgtttattttactttttagtattttccattatgaactttgatcgttttgttttgacatgagcataattgcaaactcatgcccttttgatgatagaggaagtcaaattggaaagtgcaatttgtttcgatgtatcgatacatatatggcttccttttctaaatcttctactcctaccatatgtggtttatgatgaaatttaaccaagtgctaataagagtagtttgcttacttcatgctataaatgccttttcatcttcagacaaggtttggaaaatctttgcaatcaaaagttggtgatgccacaaagtcatatgtaagtatatatgcacaaccattgtgttttattttatccttatagaaattattttccatgattttttctctctatttcttttgcttgtttctacagatggccatgcatcagacatatgaggggacctactttgggtttgttgctacattggatgtgtatggatttgagattaattatagccaaagaatcatatcatcagtatggattgtcaacagaggtcccaatgacaacctagaagagaatgcaattaggattggatggcaggtaagcagttctccttgaaaaagtcagtaatcttatgtttatgttttgttcgttttcagcattaactatatcacattttttctaggtttttcctgaattgtacggtgactcacacacccacttcttcacttattggacggtatgattttctctacaactcaaaaattatattgcttataaaacatgtgtggccattgacctttttttttttttttgcatttgaaatagagggactcataccgaactacagggtgctacaacatgaggtgtccaggttttcaactcacacttggatcaaaaataactcctggtgatgtcataagcccagtatccgatgttgatggagcgcgacaaaatattacaattaaagtgtctagggtaattaactactccctccggttttattttaattgacgttttggacaatgacacggtctacaagatacatgtttgatcttatttttctattataatatatataataaataaatgcatgtttatttttattatagtactttaaaagaaaaatttatatatattgttctagttcctttaaactaaatatttttaaagttatcgatggtcaaagttataaaagtttgacctcaaccttgtccaaaacgtcaattaatatggaaccagagggagtaaatatatatactacaaagcataacttccatttatatactccccccttccctaaatatttgacgccg

SEQ ID NO: 16467 - DNA, 7209 bp, Oryza sativa
ttttgaataagacgaacggtcaaacatttttaaaaaagtcaacggcgtcaaacattttgggatggagggagtatattgttaggcatatgtaaatgctatgatcagtgctagctagtgaactaaaaaaacatatataaactcaatttacttttttttaaaaaaataatgacaggaaaagtctactggggattggtggatatactatggcttcaacagtgctccaacagttgtgggttatttcccagctaatctatttaccaacttatctgaaaaggcaactagcattttatttggtgggagtgttttagcagtagaaggtgcttcaacccctccaatgggcagtggattattgccatcgatcctgtctgacaaggctgcatcaattgaggatattttattagtcgatgaagatggcaaaatcgcaccatttgatgtgaagacgatcaaagacgagacctcagacctttgttatgccatgacacctatttttggtgaaagcacttcaaggtgcttatatggaggccctggaggttgcgtcgtcggttaggcagatttggcttcaactaatttttggcctctgttatgtatacatgttctttttcattgttgtcaatggaaccagggagttccatatatggagaaagataatttgaggccgcaccattggttgtgaattttaaagcataatactaattttcatattgtctgatcataatggagtatatttttgcatgtctaattcggtcgtttacattcctcacttattttaaaccaagtagtttacttgtagaaaaaaaaatcaatactagtcagcatgcacgtggatcctacgttgacatatgagaatatatcaacgttgacagttgttaagtaccgatttcgaccgtcaattatcttaacaaataaatatatagaactagcatttttacacgcatatttgtttcaaataatttcccttggagaatattataaatacatggattggctaccaaatgaaggagaatgagccaacatgcaaagaaacatatttccggctaatcacaagagtgcacacagattgaagggcccatttagcacatacttgacaaggaggaagagcatgggagacaggggatcgccctgctagagcccccctacagtgtaggaaatggtggctcggtaccccgttgaccagcacctgggaagaggagcaacggagaatcagggagatccaatcacgccatcgactgctgaacacaagataggtaagcaccttgagcaggaacagccaactaacttgtcaaaggccttcgcaatgtccactttgaggagcagatggggcgtgcgcctagcatggagtgccttggccgcaagctggacatagcaaaagttgttatggagtgaacggcctttgacataagcacttcgattaaccgccaccagctcgttgaggtggggagtgaggcaggacgctaggaccttagaaaacagcttgccaaaactgaagatgaggtttattgggtggaaatcgttaacttgaacaacctcatttttcttaggcaagagagagatgagggcatcgttgagggaggcgagaccatggttgttcgccagaaagagggtgttaagggcaaccagtatttccacttgatcattggccagcaagatttgtagaaatggcttgtgaaaccattatagtcaggcgccttatctaaaagtagctgcttgattaccgcccacacctcatcctcagagaagatgttgtctaggccagcaaagtctaccgaatagagaccaagagagtgggggtcaagacaaaggtctcgctcgatgaacgtccccatgacactgcaaaagtgagtagaggcaagcgcgctggcgcgtgatgcagttcctctgccgcctggccttagtgtgaagatggaaaaacttggtgctgccgttaccctccttgagccaaacaagacgcgaatgctggtgcgcaatggtatgctcaactgaagcaaggtcaaggcacttcaacttaaggtcatgccataaccaggactccaatggagagatgggcgagactcttacatgacctcgagccgaaatataagctcttctccattagcaatcgaagatagacattgcccacgtgctggtagctctagctctgcaagcacttagctgtgttagagaaaccccaagcgagtgctgccattggggaagatgggccggtagttgccactcgtcctacacgacttggaggaagccgtcgaacttaggctagatcgcttcaaagtgaaagcgatgtgctttcgacgagaatcgcaagagtaaaggagtagagcacagtgatcagagataatggaggaggccgcttgaaggagacaagatgggaaaaactcctcgcaatccgtggaaaagaagacatgatcaagtttgacgatcgtgggggaatcgcgctctatgcaccaagtgaagcgacggccatggagtggcaattctcggaggtccagctcgtcaatcagccgtgaagcggcccatcatgctacaattgaggttcatgttgttcttgtcctgggcctcaagaattagattgaaatcactcgcgacaactcatagccccatacgagaagagcacaacgaccgaggctcgtcaagaaaccaaagtttgtccatctccccctgtggaccatagattacaaagagccaccagggggtaccgtcagagtggtgatgaaccaacgctgtttgaagaagtcagcatggtgaatgttggagatagactagacggcggtccgccaagcaagcaacatacgcccactccaaccgatcgcatgcaaaaatgaatggtgaaagtccaggcctagcatttccaaaataattcagggcgagattacatccattttggtctcctctagatagagtagcaagacacattcatcacggacaacaacttggtgggcacgtgagttcagaccctgcatgttccacaccaacacattctcattgcatgatcccatagaggaggagccatacacagagagagagagagggggggaggtaattagtcgtagctagagaagagcgaatacatggcaatgacgtgatcctgagagaatagtgcgttgtaagctgcaaatgcctcggccgagacaagaccctccttcagcactagccctagcttgcgtatcaggttgcgctacacacacgagaccgtgttactgggtccagcgagcatgagcttggccgccatcctcttgttgcacttctgcgctacccccacgactgtgacaacaagtgctataggcgtgggtggtgggagcagcaccgaaggcaggggcttggagaagctggcgaggaaggcacgctacgcggtgttcgccacgatcgagggtgggagcaaatgtgtcatcgaccggccgtcaaagtcgaggactaccacggacacgtcgaacaggacatgtcacaacctgaatttccgttttaggatttataaattatttaataaattattaatagaatttatattaaatgttcattaatttacaagtgaagttaaatgtgggaaataaaatttcctaaatgtaaagcatggttggatttaatttttattaaattctccatgattaattatactctctgaaattttctcggaattttcggagctcaattcctaatgttaataatacaaagaacagtttagcaattatttaaataataaattaatcattaaatgatctggatattattatattaaatactttgagtgtccaagtatgttcaacatttttgttggaattatttgagtattggaagtatttttaacaattgaaagatcatctcattggttaatttatttggaaaagtaaataaaagtcctcctcatcagcttgggccgaatccagcccattccctcctttcccctctcccttcctctcagcccagacaaagtctgtttaacctccctggcgctacagtactccatcttcctcctccagccgactgtctcccgtgccgtgcacagtaccgccgattcccttccaaaatccggccacctcgttgctcctttttccaaattagttgcgggaatggaattctctcaatctcctcttccttttccccaagaaatacccaaatgtttctatggaaatcctttccaatttcgcggttcaacctttcctttttccggcgaagatctaaactttcccgagtttttcccgtcgttgtgggctcgataccggcctcccatggctatataaaggaccccctagtcgtcctctacctatcccctcaagtcccgtccgccgtcgtcgccggaatcgctctccccgcgctctccctctctctccacctccggccgccgctccagccgccattcgccgtcgccccggccgtcgccctcctgtgacgccacctccctcggcttcacagtgaagagctctaccccggccacccgttcttttgcgccgaaccccgccggaagtcgccgtcctcgtgaaggccgaaccgttgccatgttttgatctccggcgaggccctgctgctcatcccgtcgtcgccttcggtcgccgtcgcctcctttgggttcgcagctgcgaggtgatggccgtccacccctccgttgtcgccgcacatcgccggaaagtcgtcgccttcgaggacagtacctcgccacccttcgaagctcgtcgccggccatctttcgttgccattcgtcgtcgcgtaagtggtggtaagggtcactttgatcccctcttcctcccagtgccctccgtttgcattattgtaccgttgttcgccggcaaccgccgctcccatgccgttcgccagtgtaggtttttccctagggtcttaatccaatataatctaatccgtggtttgtctagcgttgtcgtctccatgtgttgctatcggaacgttgtcatcatccctccctctccgatcgttttggatcggtgagacgtctatcattgtctcattggtttagatttcaacccatcggccgcgcttgccaagccgcttcgtcgcaaccgcagccgtgcccgttgcgttgttgttcgccgcgctgctgccctagcctgtgcaccgtcgctaccggttgtgccgttgttgcttgccgtcgccgctgcgctagtcgcctagtcgccgttgtgccctccctgccacagtcgtgttgctcctgctgtgcgttaccgcttgaccgctagctgttgtttggccgttgctcgtgtgtgccaagttgttgccgtcccgctactgcaaccactgagccactggtcgccgtgctgtgattgtgtcgtgccgtgccgttgctgctatagtgtgtcacggccgtgcgtcacttaaatctagccgccgctatcccgcgttgtcgttgttgtggtttgttcgatgccgttgcccggtagccgagttgcaaagcctaaggtgcatccctaaattcctaccggcctatcgtttgccataccggggctttaccatgaatcgtgtctagcccaccggtttagtcgcagccgttgttgagttgttcgctcgttcgttcgtccgtctggagtcgtcctttagtttagagccgttcagagccgccagtttcgttcgccggtttcggttgatcatttgggtgatcccgtgtcacgtagaattgactcgttgagtcggtatctcgtgaggttcgcttgcaagattaatcttagccatccaaaatcaatataaatcatttcctctcttttcagtggcatattatttctttttaatatatgtcatctaccaaatatagtctaatctatttccggaggttgctttaatcttttatctcagttataaatcttttgtaaattgtttaatcaatttggaatagtcttttctttaataggcattaattggaattaatcttgtaaaattcataattaattcatatgaagtcagaatgaggccgttcaagtctcataattcatctaaaattatgacctacatgtttgtttactttatatgtattgtttatttggtttttattagtcttttttctcgttttacgtgttagcttggcgtttccgtcgtttcgaaggatcgtaagtgcatcggaagtattcaagaagattaattgaagacccgttattgcaaggcaagtcacacagatcccaaacacaattcctttgagcatgttgattctatatttaaattctctatttatttcaactgtgtatttatttttgaatgtcaccgggtggtgtgaacctattcctttgttatggccagtttgcattgattaccctatttcttgattatctcgggttataatttgactagttggatttatatattagttcaactagatgtattagatataattgcttagccatgcttagaaacattagcatacaattgggataactaatgtttcactactacttaatgatggacatgataatggtagctcacgatggtcaatcgtgattggttaattaattaatgtgccaactaaaacttgataatggtgggttgtgagcacatggttttgatggtcgtgctcataacaattaaggaccggttcacgagtttcggttgtgaaacattaaccgtgtcaaccacaagccagcgtgggcaacggctttacctattgtatagcatggttcattgcggggcaccagactgagaagtggcggagataagtccacgggggtcgctggggagtccatgccttgtttataagggggtgattatgatccaggaatggtgcgctgtggtggattgtgttgtgcgtggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttcttaccataataaatgatgctataactggtaataatttgattagctcctggtttggaatggtacattcctggtttggagatagatctgtacagccgggtatggttgttcaggatggttgggcttgtgcagcatggatgtgctgttcagtgattgattaatattgatgattaattactctactgttttactactcttaaatgtttgctaaatgctgcttttgcaaatgagccatatattatgccatcctttggtatccttgtgcacttgcatatttgctgtgtggcttgctgagtatgtca

SEQ ID NO: 16468 - DNA, 14957 bp, Oryza sativa
catcgacttgcttcttgacttccgccaactcgctggctcccattctgtaaggcctcttgtggatcggtgcagttccaggtaccaagtcaatccggaactcgatatccctttttggtggcattgttgtcagatcgtccggaaaaacctctggatactctctgactatgggaatatcctccagcttcttagtggttttctccactgctacctcttgttcttcaccagcagcctggtttaaactgatccttggcttctgcagcactggagactggaaggttaccacctctccttttgcattggtcaacttgatggtgcggctggcgcaatcaatcactcctctatgccttgtcaaccaatccattccaagtatgacatctaggtccttggattcgagaagaatgaggttggctggaaaaatcaacccttgaatttcaactgtcacagctgggcagtagtgagttgtggtcatgccacctccaggagtatgaactcgcattggtatcttaagcttcactaaagataacccatgtgcaccagcaaaacgcttagaaatgaaggaatgagttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggttggttacaattgaagcagagttcgggtttttctcccaacctcttgggctgttctggcagagctggctgagctggctgatctgactgagctggaatcattaatagacttggagtcgggttgaggctgctgtgactgccactgttgttgttcttgttgaaattacccgggtggtagggacggtgctgtcggataatcatggtggaaggtccaccctgacgtcccatcgtgaaacgaggcttctgacacttcccctggggagtcctgaactgggctgccttcctcttacggttcattttgctacactgctcctcttgacggatggccttgtggacctgcttctcaaagtcctcataatctctagagatcaactggttagtcaattcatcatcaagaccagacaaaaacttctcctgcctctcggcatcggtacgcacgtcctcaggggcgtagcgcgcgaggcggttgaactcatgcaaatactctataactgttctggttccttgttgcagggagcggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcataggcctcgattgggttggtggtgcttgagaaagtgggcggcttgacacgaaggaattctaacagtttggactgaggaggtggaggaccaaactgcaggttctgttgctgctgctgtgcttgctgctgcacctgttgcaacacctgatggtactgttgctgcatctgttgcatcatcattgtcatcatctgagtctgattgtccaacacctgagcaattgttgggttctcgggcggtggggacggactgttgtcagatgcaccgttggcacgtgctccattgatcggctcttcgctgccactggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggaggcgactctgaagctcggggcggcgcttgcaatcgagtaggactgacatctaaagtagacaagggataggaaccaattcatgctcaaatccaaattaaacgaagcaacaaatgactcaaacgaataactgaacatgatgatttttatgcatagaacatttttcatgaacccaaataaagacactaatgcaactaaacaataaattaatgcatagactagttgcatggaaaatgatgcgcataacattgcccccatcgaatatagacacgacctaatgcataacccccaataaattcccgactgactgtcgaataaactccaactaaaatttttctaaagccctagactgagctaatatttttttaaaaaaaaaaatccgatccgaatgaacgaccaagatttttcccgcaaaccaaagaggcaaaactccaaattttcccaaaacaattccaggagcaaaaaggcatatgcagatgaaaaaggggttcagagggctcttagggtttccagttggcttgtcctacggtcaaggtcggctctgataccaacttgtcacgcccagaaattctcaaaccagaatttctaagctgaatgtgcattaaatccctgtccaggaccagccagggtacacaaacgataattgttgacatccagatccacgtcttacaaaaatagaaaagattacaaatgcagcggaaaagataaaagcgagctaaaccgggaagcttgacttcagcagcgagcggctccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaagctaggggttcttttgcataaagctagcatttaaaaacagtagttgaaagcagtaaaacagctgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaactatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaattgccatgggtgcgaccagcaaaaccatgcacccacagcccaccattcaatgtattttaattaactaacaccattgcggtggcaccaatctaaagctatgccaatagacaaagtctatgtaaaaatgtgatccccattagtgtactagttgaactaagcatggctaagcatttcctaaaccaacatctaatcattttgatacccaggttatcaatggcatatggtaaacaataaatggttgagtaataggacccatccctcattacattgtaaaagaatgcaacatttaatagaaatgcgggatattggtaaattgggtacaatatgatcaaaagtattgcatgactttccttgctctcgcactgatgagacctcagcaaagtcttcgagaaaccgcggatcgacgaaacggccgaaacctacgcgacaaacaaagcacacaagcaaaacatgctataagactacagaaacaggaaacaaaaccatttttaatggattctttgcatttttcttgatttactgagacttgaatggacttaaacggagctcggatgaattacttatgaattttagaagataaactgtgtttttactaataaagaaaagtccttaaatcaatttattgcgcaataaagcccagggctgacgtcagcgaagggggggggcggcgccgacaggcggggcccacgggtcagcggttcaagagaggggagagagaggcgccggcaagcgggcccactgggcagcggctcaaaggggaggggtggtccaccggctggtgggccccaccgggcagcggcacagggcgggagaggggcgtggctgctggcttggcacggctcaagccggccggccatggcgaggcgacgacggcgcacgaccgccggcggtgcggggagacggcggcggacggcgcgaaaggcggcggcggacggccggagcggcggcacggccaaaggcggcggcgcacgcgtgaaggggagaaaagggagggggagggaggcatcggccgggctcagctcggcctcaaggccgaccggggcgaggcggcggcgaggcacgaccaccgacggcggggaccggcggcgcgggaagcggcggcgacggccgaaaggtggcggcgcatggccgaagcgcggcgatgcacgtgcggagggcggcggcaagcggtggcgctagcggcgagcggcgtgggctcgttaggagacacgggaggggacggcaaatggggaaaacgagagagggagctcgggagagtgatttaatgggcgaaggaggggaggacgtggccgggaaccctcccgatttagccggcgacgtggggaggagagagagaaagaggggtgggattcgaaatcgaatcccgccctctcgagcgcgcgcgcgggccgggagatgcgggggaagaggcggcgacgtggggaggacgcgggagcggcgcggcgtgggcgcgggaagagcggaggaggcggcggcgtggcggattcggcggcggttgccgtcggaggcgggtggctggaggaaggggacgacctgacaggtgggccccacctgtcagcgttccggagagagggggaaagggaacgggccggcccacaaggggaggccgagcgcgggcgacgggtggactgggccgacggcccaagaagaggaaaaaggaaaaagaaaaagaagaaaggattttcctgggattaaaattgcactttggtgatttttaattggttaaaattatttccaaggctctgaaaattccactaaaaatcttgttaatgcattggagcatggggaactcaagaaaaattccaccatgccaattccaattattaattgcatttattagttagggaattagctctaggttaattaagataatttcttcgggcaatttatttaacaaatttttaaagcaaggagagggggaaacttcagggcgtgacacttcgctagaccgtaattccgctgcaattttcttttcttttgtaagtatgtaacgttattatattgatgaatctgtatattaaattgtcagtttgtgtacctcggctgattcctggacgaggatttaatgcacaaattagttcggaaattactagtgaattttcgggcgtgacaggacccgtcccccacaaccgaagatgaggggtcggccggcagagttcccggtggcaagggcaagaccggcggccatggtggtggagatggagcacgcccagagcccctgaaacccggactagaccgaggcgacgaaggagacatgccgattgctagagggcgtccacccgtcttcaaggcgccgtcagccaatgaggcagagagggagagagttgatgttgtctccatcatgggcaccgcgccattgtcgttggctggtgggtatggagaagcctgaggcgttgggggagccgcaccattgtcgttggctggcggtaaaaggaaagccagagcacgtcggggaggagagagactccggaggcacgaagccagtgatggagccgatgatgtcggttgaggaaaagccggtggcctgtcgcccgtcggagacgctgcaccaggtactgagatggtggccagcggtccgcccgtcacagaagccacactatgacgacggagaacagtagcctgacggcgtcatcggaaaggagagctagggtcgacgcacgacgacgaccagagtggctggcagagcgtcgatggcaccatacaccagaggaatcggaggtccgttgctcctcgctagcgtcacaccgtaggccgtcggaggagcacgcatcgtttgccgcggtaggggtgtgcattggagaggagagagctgccggcgccacgctgtcccggtgagccatcgtcatgtcccctgcagcccttggtccaccgccattgggcctgcacgaggcgccccaggcgagaccgcgcacagccgaggtagactgttcctttgcgatagcccaatatgcgagggtggcccaagtacaggggcggcccaacaggtggcccgaggagtgaagatggcccagagagcagagccaacccaaggagagagaacggcccatcagatggagatggccgagaagagccagcggctcagcaggtggaggcggcccaaggagaggtggaggctgagggagtggggaagctgcttctcgaagcccggtctcgactcacatgggatccggtgtggcactagacacaatggtcggtgccacatgtcggctcgccattgcctcctcatggggaagaccctggtcaaaagaaggaaatggaaaaacctcccatttttagcaccaggcaagccgccggcgagggcgaatctagagcacagagaagccgagtgcacacttaatttacacaaggcactcaggggttgtagctgttgggcatttgggcagttcgggctgcacgtaagcaatttggccttcatgagctgcctgcagcctgcaggctgctgggtagctgaagttggtacgagtattttttttctagagtgcacagaaggtggtgaaaattactaccttcgtttcaggttataagactttctagcattgtccatatttattgtttcaggttataagactttctagcattgtccatattgtccatatttatttatatagatgttaataaatctagacacataatacaatactagaaagtttaggaagtaggtgcctgctaatatgattcatcagtgatcagtgcataaaaacctataatgtttgtcaaattatatacacacaatagcgacctcgacaaactaatatttagtagtatatatagtataacaaatgatgtcctccatacatgccaacaactaggaggaggacaccaaagcatgcatatatactcaaaacacatcaaaatacaagtaatgaaacacagccacactgtacaaagccaaacagacaaagctcatcgttcgatccgatcatcacttgccgtctccggggacggcggcggccgtgtcagcggcggcgccgccacgttgctgggaggagacggcctggacgaggtggtgcacggccttgtcatagctaacgaaccccatgaaccagaagtcatgcgagtccaccgtcacgacgtgcacgtacttctccggcgggctctccttcatcgtcaccggctcggcggcggcgaccttggccaccgggatcatcaccttgtagtagctccacgccgtctgccccgagggcgccgcgaaggagagcggccggtcgctgcagaacgcgacgctccggtcggtcaggtacagcgtgccggcgacggggcccgtcgccgtcgagaggtagcaggcgaacgtcttcctcagccgctcgtcggcgccggcgccggcgaacgtctgcttgtagagcttgtcgaagccgccctcgctgagggccttcgctcccaggctcagcttccccatcgccgcgtccgacatcgacggcgccgtcttcactgcaaagaggagcgaaggaagaagaaggtgacacgtcagcaacctgttcgtgacacgtgtcgctggtcaaaggacacgtggcacacgtgatctgaagcagagaaggtaactctgctccggcaactagaagcatcagagtttgcatctaattttgcatttctgttgagtaccagtaattactccctccgttcataaaagatgaaagatatatttatttcaattttttttatcaccaagaaaaaaattaacctcatccccagtctaacaaaatagaaaaaaatctatatgcatacaagaattaaaataacagcttagtttagattaagaaataatttaacacaaagactacacaactataattatctcttttagaaaaactaaaaattgaaacattcttaacacttttggactttggacagatggtgtggttctatacagttactaatcctagttgatatctttcaataaaaatacatcaatattcaaacttgtttcctgaatcagactcaaaaatccaaactcttgatccaaaattaaaagcttgttactgccacgtgtgggcgtggctggtcaaatcacacgtgagcagaagctttggcgcaagaagcagagtaaaagtggtaatcctaatcaatttctcctcaaataaaagaacaccaaaattaaaactgtcttttgtaaatcagactcaaaacgggaaacattttaagcaaagatttgagagttttggatcacttacggttgaaccagatgttggaggcgagctcctcggccttgcggctccaggtgttgaagaagtcgaggatgtgctccatcgggctgtcccctctctccggccgcccccgcggcggcgccgccgccgcctcgcccatgatgacgtagggcgggagctcctggtcgcccctcgccgccgtccaccgcgccgcctgctggttctccgggtgcgccccgggcgccgccggcgggcccatctgcctcgtcccccacttcgccgcctccggctgctgctgctgctgctgcggcggcggcggcggcgcgttccccgtcgtctgaggctctgccgccggcgccggagccggagccggagccggggcaggggcgggggtggtggtggagtccttgccgtccatggctgggtgagtagctgtagctacgagagatcgatgaggaagaagggaccgagagagagatggatgatgctggaattgtttggaaattggaaagagcagagatgaattggatgagcggtgtgatgggtttttatagcgtgggccgtgctgtcggtttggatgattgggatgtggattttcagtatgttccttattgcttgcatttttatctaaatatttataaaaaaattaatttttaataaagatagattaatataaaatatgtcactacataaacgtatagtcaaaattaatttctacaagttgaaaaaaataaaattggaaataattatcggatatttgtagttatattttttttacaacttgtaaaagttgaatttgtgttagcatatttgtgtaatgatatattttatattaatttatcttgtggctttttaatattttatctataactattaacatatacaaaacgagaggacatataatcgagggatgaaatcacttttccggatgattggcttatttgtggagaggcctcctgtttacctctgtacagaatccgttgtctaaatttaaattttgaaatttagttgtacaactgattttaaagtattttttatcaaaatttattttttataaagatgtgtaaatcgctaagaaaacatatatcaaacttttatcaataaaatattgttttcatgacatattaacagtatttggctataggggacggagccaattgctgcggctatcaagtttaatctggtaattacttaattcttttaccattttaataaatttaaaattaaaattttacaatttcaactataataactttaaaagtatttagtttaatgatcctagaataatatttattagacatgttcgtaacgtgcaataataaaaaactatttatttattctatattataattgaaaaaacatagtcagagactcccagtgtgtacttatgttgggactataaattttggaggccaagtaattattatctaaaacattagtatgaaaccggagactactgtattaaacacgaaggcccgaacgaagggcccgtttagtaaaattttatcccaaattacattggatatacggatacatatttaaagtattaaatatagtttaataatgaaaataaattatagattccgccagaaaactgcaagacaaatttattaagcataattaatccattaatagtaaatatttactgtatcaccacattagtaaatattcgtctagtaatttcctgatgaactatgtaattgattttttttacattaaatattttatgtatgtggtagcgtgaaaagttttgtttggaactaaaaaggccctaaattggcaaactttaaactagtagcacagaaagtgaaataaggaaatgattaattggagagagtagtctgagtcaaattgattttcttcgcgagcaagaaccttcgaggcgcggcatccaactaatccacgaggatgcagcgggcctacgtggacacccggaagcttagcccaggcgacaacgtgtcctccatcccccttcttttctttttccttccgattttattccttctgtgaagacgccgtcgtcagattagcgttgctcctctctctctctctccaatgtgaacaactttttcttctggaggcgtcacgcggtggcggttcggccggcttccacgtgtcacgccgcaggaaaaagagaaagaatcgaccatcacctattcctaggggtgggcatataaaccgagtaccgaacctgaaaaaaccgaaaccgtacattgaagactgaacactcggtcatcgtcgtttgtttaagcatagaaaacaaatggttaattggttaatttgatccataccattgaaaatatggctattcagaaaaatatcattttaattcgcctatatatagccgtgtcacttatattttacaaaattaggaccattccattgccagtgggttttccgtcttctccctcacctctacgtgggacccacgtatcattttcgtcttcttcctccatcctcctctctttttcttctaccacttcttcgtttcttctttctgtgaacacaagtagagcacaaggaggaaaggagcagggcgtcagtcctcccagcaaccacagagcactggaatctttggctctttgcagtgtagcaacgcaccctccctgacgagcttcggactgaccgcggattaatgctcaagcgctgcggcaagctgctgagcagcatccaggcgttcacggccggcgacgactagtacccaagcctggtgtccatggtcgacgcggcgacgttcctcgctgacgagctctgagctgagatgaggcgcgcgcacaaacgtggaggtagatcgagtggctggtgttcaaggacctcgtcgtcgtgcagatctctttctcatcgtcgtcttcacaagaagagtgtgaagaaagaagcgtcgccacctcccagccaccggagcaccggcgccccactcctctcctctacctgtgaaggaagaagaaacgaagaaatggtgaagagaaatggaaagagaatagaagaggaggatgaagaaaaaagataaatctgatggatggttcccatgtatagatgaaagagaagctgaaaaacttaacggcgatgacatggttttaattttataaaatataagtggcataattataaataatcaaattgtaataatatttatctgaataccattaaattaacccaaaaacaaaagaccgaacatactacgatcaattcggtcatcatgcctggctaaccgaagagaccgacaaaccgaacaaacaaaatggcccaataccccatcaacccaattgaagcaagcaagcagcccaatgggccaatctcaactacaccaatcaaagtagtccagatccaaaccctagggcctaggcagttctctgcagggcgtccagatccaactccccagcgccatgcctcagttggctgtgtcttccgccgagcgtgtgctactgctaccgcgccacccccgacgcgcccttgttccgccatggagccgctgtccaccgcgccacaccgtcgcccgtcgccggccgtcgcggctatgttttgccgcgaagctacctagcttccaccgcgctgctgtgccgcatggaatcatcctacgcagcagagggggaggtcttcactcttcagcggtaagaagatgtgaggctgtacatgttcggtcaactcgatttagaccgaggaccgaaccgaactatcggttaaccgatctgtcggtcagtactcttctataggtgagttcggtttccttttctcaaagaccgatctttttaaagaccgaattaaccggaccgacctttcggtctacaccgaatacgcaccactagctgttccattccctctattttgggccatcggtccgccaagcgatcgaactggcgggtcggcaatgggtaaacaatttttctttttttttttttttgaaaaattcacttttactctcttcactgttggctgtatcttatttatgccccttaaccacaaaactgattatattgacctctcatctattaaaaaagcagtgcaaaaaatgattcccacagttgttttaagggtgtttttcgcttacgtggctcgttgagctgatccaactgactaagttagcatgtgggcccacatgtcagtgtcgcctcctctttctcttcctctcttctctctcttttttttttctcccctagctatcctctgactccgagcaccatgcctctcccatacggtttttcaaaattgatggccacgaagccctcatccaagccgactactcctgaactgacatcgttaccaaatgatctcatcttttcgcttatgcttatgcttatttgccaaaatttaaattttcaatcttaaatttaaatttgtagttgattttagagttttttcatcgaattttatttttcagcctttgcttttatatcgctaacaacacatacatagtttctggttaattggttacaaagtttataattttttttctacgaggttgtagccttttataatcttcttttgctgcaaatactattcttcctttataaaatacactactaggcaaatgcctggtagttttctcttaaaaaagttttatttataaattattttttatttgtaaatatgccatgatgtgtttgaaaaaccctactggctgtcagtgcccgagatcaagtcgaacaatacggcttgagatcggctacaccccttcccctggatcaacatacagatttttttagataatgggaaggatcaacatacagatggaagacacggcgtggtgactaactgacaacggattcaaacggtgctgcatatcttctgacaacatggtggatcgacatgcccagacagctacacgtccggaggcaattcaacgactaccagcacacaaggagttcaatttaggagattagaatggcttaaaattaatctattgattttatagatatagccaacatatatctacacaggtacacaatattttatatataatttaccgtacctattttcagatccatacaatattgtcaggtgcgtaatttattatgtttacctaaaagcatgttttttttacgatatctgttatgcgaacgtctcctatattaggcctatacggtctaatagtgggggctcgctatgtttttctatagaaatcatgcttgtttatggtttacataatacatgatatttcatccgaatatgctcatatatcatgattatactagaagatttagttttttgagtacgcatttggtattctctgctatatatcttgccttctagaaaatacttttcaggaacaatcgagcattcgagtagacagtggtcgagtacaccccgtcgtcgagaactaatgcggagttgtcgaaccaaatctaccaacaaaaaccgatgacatatctcacatctaacactggtcatgtccggactatttgtgaaaagggtgttgaggacaatctcttcacgaaagttgtcagcttgatcatccgacatgattgcgaatggacatccgatatatatgctactagttgggtatgtgagtcatgctggccacatgatatgtacacgtaataaccaactctagcacccctaaaagtggtcgagggatgactatgtctggtcctcgatcagcgttgtagcgatctctcaccacctatcaaagttaccttcgggtggccgagaaatgactttttcgacggagtagatcgcgactaggtatttgtagagtatggggatcgttattaccaaggtatacgcaagattgaggtaaaagaggcggagacatggacttttatacaggttcgggccccttatatgtaaggtaatagcctgtaacgccccgattttcgttcgggattaaaaatcatttaataatgcatttcctagaaattgaataaaaagttaagcaatttaatcaagtgaaataatgggagaattaaaattttcccttaaaaatcattggccgggaatattttgcaatattctttgtgccctaatgtactctccggaattttccgtgaattttcggagctcgagaaatagttttaaagtcacgaagatcatttaaccaattaaaataaaaagaaaacaaataaaatcctccctcctctctttgggcccctttcggcccaattcccccccctctctccctctcgggccggccttctccctcggcccgctcggctctctctctccctcaagtctgctttgcctccccagccggcctctccctccctctctcttccgacaggtgg

SEQ ID NO: 16469 - DNA, 19045 bp, Oryza sativa
aaccaccccacttcgcccacgtcgccggagcccactccgaagaccgttgccggtcgattccgccctccgcggccatgatcccaccgccccgagccaataaaaacgatccccgtggtctcctctcccatttccccaactttcccgagctcccggcgccctcgcccgctctcccctcgccaagccgagcagccgctgctcgccggagttcaccggccgcattttcccgccgccccagccaccaccgcgccgcgccgtgtgtgccgtcggcttcgcctcgccgtgccgcgccccggcctccactccttttcccccaaaccaccaccgaaataccaccccaccgtgaaaaccgagccgccgctcttccctccgtctccagccgctccccgccggcgataccgacctcgcccggtcgtgcggctgcctcccacagcgccgccgctccgtgccgcatcccggccaccggcccactcctcaaatccacccccgaagcaccattcccgccgcaaacccgagccccaccactaactgccgccaaccggccgcctcttgccgccatccccatctacctcacgccgcgccaccgcctccaccgcattcgctgcatcccaccgcccctcggccgtggctccgccgtggtcgggcgtcatcggaacgccgttctcgtcgactcccgtgccgaccgccgccatcctttccgccgccggtcgcctctccgtggtcgtctcgccgtcgccgccctcggtgagcactcctctcccctccctctttctccccttggccggccgcctcccgtgcttgcgcgcgccgtgccgccgccgccggtggccgcccggcccgtgtgccgccgtcgcttcggtcccggccgccgccgccgccagctttgtgtgagcgctggccaggccgcgccgcccggctgtccccagccgtccgatcggccttggccgatctgggccgttcacgtggtggacgcgcacccgaggcacgtgtggaccatgtccaccatgcgccctccccctttgactcgctgacgtgtggggtccgcgtgtcggcgccggccgccccttgctgacgtcagcgaggaccatttcctttgtaaaaataaataataattgcgcaataaatcgagtttaattctagaaattcatttaaatggctcaaaatttctaaaatccatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaagagttcggaagattgttttgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgacccaatgcactgtagtacaggtgggttggttgggcctgttcaacgtggtgtagcgttgatcagtggagattttaatgttactttaattactcaacagttttactgtttgctaaataaaatgttttacaaccgcctttatgcaaatagccacaaacggtccttgtgttccccttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgcctttttccgctgctgctgttttcgtttcggtgcgaggactaagtgcctcttttgtaagtattttacgctttatttatgtttggaactgtatattacttgtcgttttgtgtaccctggctggtcctggacagggatttaatacacaaaatagtctggaaatttgggctaaatttctgggcgtgacatagccctactcttgttagctgaagccggtgttgctcttattcatcgaaatcacgcaagtaaaatatttgggataacctatcttgtcgtcgtcgacttggcggcatggaacaccacacgtagtagacgatgggatagtcttcctcctcgaatgcaaacttgacgagatcagagatagtgctagatctctcttgtctacctctgtggcaccgaattgggtatgtcttggcttatctctgatgtcgatgtctggcagcgtgtattggtgtctattctgactgagcgtcccccctctcctctagggggtcttgtatttatacccacagatgtcctcttgtccaagaaaaactagggagacaaatatggatacgattcgagtagtctttgtaattttcaacttgaactctgcttctccttccttatccggaataccttccatatgcgaggaatgattctttataagacttggtatatggtggaccccgtcgagcttaacccaagattattgggtatgtgttatccataacattgacagactagacatgttccttggctagtgttgaagcaatctctcatcatctatcagttgtcttaggcatctggtcctcgaccagcgttgtagtgatctgtcaccacctatcagagttgcctttagatggccgagagatgactacgcctggtcctcaaccagcgtcgtagcgatctctcaccacttatcagttgccttcaggtggtcgagggatgactacacctggtccttgaccagcgttgtagcaatctcccaccgcctataagtagcctttgggtggttgagggatgattacgtctggtcctcgaccaacgttgtagtgatctctcaccacctatcagacttgccttcgggtgatcgagaaatgactacatctggtcctcgactaacgttgtaataatctctcaccacctatcaggattgtcttcgggtggtcgagagatgagtacacctggttctcctgtggatttcctttaaagaaaacatttcttacggtatttatggccccgaaagaatttattcatcgagtcgctttaccttgtttaataaaatatgcatcgcggttatatgcagtgtgagcggctgccacctccacccacagtttgttagaacacatgcttctgccgatcgaaagggtgggaagtttcacatggcttttggccctttgcaactgcatgccaccaaacagagagaggggaatgaaaactttttcccagcaatttcaccggaaagcaaaaaaggagcacccaaattaagtacactaacaagtacactttgcatgaattatattaaaccacggatgggattatttatgccgccggcgtgtgggcacaatggcgcacccagtacaaacaagtttatcttgtttttgcacgattctcacatggatcgatttcttttgtatagtttaatttagacttgattactatctgccattccctgacaggacttttttatatcacttgacatattataaaaatcacatcaaatatagctacagtatgattataatgtaagtataatttaaaatgcatataactataatgtaactcatgggaatcccatgtaagtacacagaaaaacgcaattgtagaggcaagtgcgtgcgcgggatcgagttccgcagcgatgcgacttttagtttttttctctcgtagaatgattttctttctcatctaactaaagataaatctaaaaaaaaacccgatatatcttttgcaaaattatttgtaaaaatgttagcactaatgatgttgtaaaatcagataaaactaaaaaagaatctaatgtcgtctagggcatacaaaatcgtacgttagaataatcatacgtctagaattaatcattaatcgcaacagaaaatcatacatcagaaaatctgtgtaccttcacccaaaaatctgtcaaaaatctatagcaaaatcgtttcctgcatggaaagaagtacgggtgaacttccacaaaagattgaacatatatagacctgatacatcgtttagccctaaactttgtgtattgttcacttaaaccaccccaccctatactcttctccaagcaacacgaggaagcactagctagttacacaaatttaaatccgtgtcggtctaccacggctggaagaactactaagtaaaattttcactactaattcacgagaaaaaccagtactagaatatttagggtttataaaatagaccttcttcccttttgttcttatcttaactagcgcgcggttagcatcattatattttctcccatataatatcatatatgttttctctatgtattattcaaatatattaaaatgacaacataattttaaattttgtactaactttacgaaactactaatatgtaatattcatattgtatttgatatatgtgttagttattaattatttttaatatcaaattttagttatttgtaaattatattcctatatcgactctagacttgtcttcaatatttcttttttaattttttttttcatattttcattatctgtaaattgtagttctatatagactctaggctcttcttccaatattatttatttttaattctgaatttttattatttctaattgtatttctaggtggactgtaaaatcatctttcaatattcttaaattcttaaattcgaatttagttacttctaaattgtattcctatattgactttagacttttcttcccatgtttttttaatttagaattttagttatttgtaaattttatttttatacgaactctaaactctacttttaatattattatgtttattttgaattttagttagttttaaattcatatatagactctatactctacttctaatattccttatttttaattccgaatttctattatttcttaattatatttctatatgaactctatactctacgtacttctaatattccttatttttaattccgaatttctactatttcttaattgtatttctatatggactctatactctacttctaatattccttatttttaattccgaatttctattatttcttaattgtatttctatatggactatagtctcctcttccaatattcattattttaattccgaatttcaactatttctaaattttatttttatatggactctgtttttctttttctctaattaatatgagaatttctaggcagcgagagcgaacgtggaggctcctttttctattcctttaataagttaatagatttattcttaatctcgtcctttccttacacattgccactgccgctgctttcctagtggccgcatctgacagtgaggaggctagggatcgatgtcagatttgataaccctagcctccccactgttcaatgcccctctattctcctatccctctctactcgccaaccaccatccctcaactatccacccggttttgatttgccctaacacattatcattctcgattcttggaccaatatatagtgatagttgtcattggctttttctgtaccacatgcgtattgtgggtttcgaaacctaacagtatttgaagttttgaaaccggtagtgattatgattttttcaaaggagaaagaggaaaagaagaagaatactttatgactcgtgtgtttggtgtaagagggtacaaataccgcggctgatatatatattcaccactttatttggtggtgtagcattgtttatccgcgacttccgcgtagagtggaatatatataatttcatgcacgcacgcggacctgacctaactcctcgatcggtcgtagcttcgttctgtgacctcatcatatcaagtaagctaccttatgtgtactatttatacagtggttcattagccagtaggttacaagaaaatccttttcacgaccaccattatattgatcgagatgagaggattgcaggccgccgtgctgttcacggcggtggcggcggcggcggcgccgacgaactgcaccacccgctgcggcgacatcagcttcgagtacccgttcggcgtggagcccggctgctaccacccaggcttcaacctcacctgcagcagcaacgacaccaggctgttcatgggcgacggcaccgtgcaggtgctcgacatctccatccccaactccaccttgcgcgtcaacgccaccgccatggcgttcgaccccgccgacgacgtgcagcgcggcgtcatcaacgcgacgacgacatggcgcgccgccgccgccgccgacgacgacgggggcccgttcgtcgtgtcgaggcgcaacacgatcgcgctgatgggatgcaacgcccgcgtcgacctccgcggcggagaccgccgccacagcgacaacctggtcagctcctgcaccgccgtctgcccaccggtcggcggcggcgacgacgccgcggctcacgacgacggcgacggcggcgacggccacaccatcgcgatcatcgacgcctggaacggcaagtgctccggcgtcggctgctgccaggcaaacatcatgctgggctacccttcctacaccatccagatcaagcagctgcaggagaagaacctccatagcttcgacttccagtacatcgcctacatcacggacgagacgctgaatttcacggaagagatcgccggccgcatcgccactccggcggcgctcccggccacgctagactttgtgatcagaagcaactcgtcgtgttcgacgccggcgaactcgacggccggcggcgagtgccgcagcgaacacagcttttgtgaggattacaagggtggtggtaataccctccttgggtatagctgcgtctgctcggagggttaccgaggaaatccctacgttgctggtggatgccatggtacgtgtgtgctcgctcggatgattaatgttggtcgttttagggctcgtttggtttaaatgatttctatatgaaaccttaggacatctatcttctatcttctatctattatcttctatcttctatctatctatctatctatctatctattatatactaaaagtccattaatcttcctacaaacgctcttaagccgccacttggcgctctaataaattagagaaatcaaagaaattctgagaaaaaagaaaagcatctatccgttgattttaaaatagtgggtccactattagaaaccgtcagattaactatattgatcttaaaacgtacaattccacaccatccgtaggtacgtacgtacgtacggttccatctccctccctcctttttcttttcatatatatataatcgagataacagttaatatagttaaattttatataatcactagcaaaagtgcccgtgcgttgcaccgggtgattacagagtgtgtatattgaccaaaagtgttgtttggtttagcaaaagtgcccgtgcgttgcaccgggaagtttacagatcagaaaaatatgcaattaattaaaatacaaattcgctgaaatatttggtatttttaagtaggtatgtgtataattaaataaatttacaagtaaaattctccattctccatggttaaataaaatgacatggttaaatttaattttattaaattctccataattagttacgctctttggaattttattggaattttcagagcttaattgctaattttattaatacaaacatcatttaacaattatttaattggaaaaagaaagaaaatactttcttataggtttgcttcgaaataaacatattcaatagaactataattgtaatgcttctgaaaaaatgagcactaaaaatgtacttattctctgtttttcggctcgagggaccaacaatagacttatttccgacctatgccggtcggcccacggccttttgcgcatgcgcgggcgcacttttcctcccccaggccgcaacctgggcttgggccgaaaaagaggcctcactctcgatccctcttgggccgatttcggcccggacgacaccggccgtccgatctctaaggttttgatcggacgaccgagcgtcaatagtggggaaacaaaacccactccctctcagccgcggaaccctagcccattccccccctcccatgtcacttcgccgccctctcctccgcgcccccgagcggcgacggcgacgacggcgcccctcccccaccaccgatggcggcggcggcggcacccccaccacccacggcggcgtcggcggcatcttcccccaccaccggcggcggatctagcgggaggggaggcgccccgcgagcggcggcgacggcgacggcgcccctcctcccgcgagcggcggcggcagcaccctcccccaccaccggcggcggatctagcgggtggggaggcgccccgcgagcagcggcgacggggcccctcctcccgcgagcggcggcggcggtggagtcctcccccaccaccgacggtggcggcggcgctctcccccaccaccggagagtgccctctgcagccgccgccggcggatctagcgggaggggaggcggcggcggcggtgctctcccctccaccggatccacagcgacggcgacggcggcggttcggcaacgacggcgacggcgacggcggcagcggcggcgacccccttcgatctaattttttgtttttatttggatatatgtgtgctagcggcgacccccttcgatctaattttttgtttttttgcaaagtgctataaggctgcatgtgattctttgttatgtgctatgattttttatactatgtatgtatatatgcacttgttctcctggtgatgctaaccgaataggacttggtataattcaaaccaagtcctattcgcccaaacagaaacaaagtcctaatcagctcaaacgaaaacagatgggagtttgtttcctatttttgtggaatcggacatattcttttaccgcgttgatgaatcggattcgttccggttttttttcacccggtttttttgacggacgatggaagcacctcttattttttaagtagtagtagataacttatatgattatattatgatatatctctttccaaaataaagtttacaccactatatttttacccattaaataaaggtatacgtgaaccctttatgtggagcattattttcaaataatacactatttaaataaagtttataaagtttatatcgttacattctgtacgcattaaactaacaaagaaatatattaactaatttatacttaaacgtgctattttagactttttaataaaggccggattaattttacgagtctttacaattatttgtaccataaattatatatctatttttatttttcaaataaatatataattttaatatctatattagatttattgcattctagacctacatccatcttgagtgctccactaaataaaagaaaatattaaaatttgtcattgaaaatcaaaatatgctagcttattttttaatgaaactgttaaacccattaaaagtacattattagacatctaatgactttctaccaacttaattaatttcttcataaaaaaactttattaattcctcacaacatacacgtgggggctatttacatatacgaattgatcttgatgcttttgtaaataaatgatattttaaatttaaaagataaataaacgatcttaaaatgatcatagcatctaaatcatacatatgattgctcctagcactcctaaacacttctaagtcgctatgtggcattctattaattacaaaaacactcatataatcgaccatcggtttccacttaaaccgatggacccaatttttataccatcatatctatcttttcggaaaaaacaaattctatcagaatctctgtctggctcactgcataacatgcatgtgtgcgctcctgtaccttttaaaccggtagaaccattgtttgtaacaagtgtttattcatggtacatgacattttaaaaatattactgtgcaatgatatttcgacgttattgtattcttgctaggttgcgtggagcctctcattcactctacatgaaatgttcataggtagatcgcctctcaaaatatatcaatcatattaggctatataaacccgtgcattttttgtgtagattaatgtcccacccaattcatcctttaacatattatgataatatattatacaattaaaaaaataaaaacaccttaatttttattttacacttacttttactttcgttgacatgttttctaaaaaaaataaatctaccttttttttaaatgatgaagaatattataaataattacttatagatactacttatatttgatataatataaatctaataggttagaatattattaaagaattaattaatgctgacaaaaataatgtatggagaaatcgtggcagatgttctcctgttaaatgtcgcttttataaatacctcaaacttggcgtacgacgcatgcccgcgcgaatgcgcgggctaccttcctagtttttttaacaattgttggaattgaatccttaggatttttttcaacatatatcacttgtttcataagaatggatcttaccaaatttctaaggatggtagtcttacgagcttattttataccctctccgagctgataatacttgtatcgttttagacaagagtaaggtcaaactttaaaatctttgattatgaatcattttaaaaatatttgtctttcaaatatggtgactatatgcatagattagtcttaaaaagtactttaataaaatcatatatatttttaaaatatttttatacatattataataaaaaataatggtcaaagttatttttaacttttttgaagaccgtgcccttgtcttaaacgacaagtattttcaatccggaaggagtacggttcttaggatgagatgaaaccttttttggaaaaattcctaaggaattaaatagatgtgatattctaatcctttactttacgtaatttcttgatttggaaatcctatgagccaaggattacaatttcgatttcacccaaaatttagctcatttcggttctaccaaaatccctgaaatttctggatttttgggccaaaatttcttgaaattttaacataatttaactgaatttgactaaatttgcaaaattctgagagaaaaaggaaatcttggccgagataatcacttgccgggttggaaattttgaaccaaaattgcaatcctgctatgaaccgaatagggcacttagaatgctcaactatatatgtcttaattaaatactacctccatttgtttttgcccagtttatatctacgcaatcttcaatacacaatttatcattactttctaactatgtatgtttatgaaagctttaaaagtatagtaacaatataagtgttttttatgacaaataatatatcaattaccattttctcttctctaatgttttcattaaacaatcatttaaagtttcaaggtttggttgcataaagtaattttagatgacatctatttaagaatattagtactaacacaagttgttttagaacttttatgcattatcttttctgttttacctatgtttgatttttctaaaaaaaaatgtgttaccactctctttagtataaatgatgagcagtaaggttattttccttctttcgatctgtgcatacatttaaaaggactgtttctgtcaaaaattataaaatacttacatttagaatcagaggaaattaatatcctagtcattggtacgtccctttatttcttcaggttcattaatgtttcaatgactcgcctaactaaaatatacgctcatgattatttgttagatatcgatgaatgtcattcccctggctactgttatggagattgcaagaacacagaaggagggtatctttgccagtgtcctctcggcttaacgggcaatgcttcaattccaaatggatgtaaaggtataacgacttaactaagtagcgggagtattcagttaggcatcatcaagtccgattgtttttttttttgaaaaatatggcgccataaatatagctactccctttcaaattatataacttcgaccactaatttgtgctctccaatgtttaataaacatctctaatattacaatatatattatgtttaataaacattttaaatattacaatgtatatttttaataaacaatttctaacaacatgtatatgtgatccctccgtttcagataataagtcgttttgattttggttaaagtcaaactactccaaatttaatcaagtttgtagataaatatatataataatatttacaacactaaattagtttcattaaatctataattgagtatattttcataatatatttgttttgagttaaaaatgttactacttgtttctaaatatatatttaaaaagacgatgagacaaacttttgaaactttagtcggatgcttatcaaaatgatttgtgtttgtgaacataggaagtagttagcttgctagagttttatgcaatattggctccccatatatggctatgttatttactaatctggcttttctcttgacttgttatcgttcttctttcccatgattaattaatttggtcatcatatattcttctatgttatatttcttctagacattgatgagtgtatgcacccggaatcttactcatgctatggacaatgtgtgaatacgtttgggagttttcaatgccattgccacagtggaaccgagggggatccaacaataagaggagggtgtattaagatcaagcattctgtgtcaagtaccaatattgtactccctccatcaaagaatacaatccaagcattcaaatcttataaagaagattacaattatagagtactactttctatccaaacacctctcgttcaaattttctccatcttagccccaaccaccatcccactcccaaccacctcttatttactacaagacatctaagatattttcctttcctactagtttgtcttttgaatgctatgattgtattactgttaggacaaatggagtaacaaacacacacacacacacacacacatattacttatttatttatgtatgttcttgatccaaattcttgaattctttcctttacgaattttcaggtttaacaattggtttgggagttagtggtggcataagtattttaaggaaaaggctatacgtactaacttttttttactaaattcttactaacactgatgtgtcatgctatgagtccatctagatttttttataacttccatctacttaaatcaaacggttgagatgattgttagtaaaagtttagtaagaaaaatttagtatgtgtagcattgctcgtattttaattatggcactttctgcacctttcatagtacagaaaataaagctacataaggtgaaaaggatgaaagagatatttttcaagcaaaatcatgggctactcctgcaacaattgatgtcacaaaatgcaaatattggtgaaagaatgatattgaccttacgggagctagaaaaagcaacggacaattttgataaaactcgtgaagttggtggtggaggacatggcattgtatacaaaggaattttagacttgcattttgttgccattaaaaaatcaaggattgtagtgcaaagagaaatagatgattttataaattaagttgcaatcctttcccaagtgaatcatagaaatgtggtgaagcttctaggatgttgccttgagacagaagttccattgttggtttatgaattcatttcaaatggatctcttgatgatcatcttcacgtcgatggacctatatctctatcatgggtggaccgaataaggattgcacttgaagttagtagagccttggtctatctacactcagccgcaacaacaccaatattccatagagatatcaaggcatctaacgtacttcttgatgataatttaacagcaaagatatcagactttggagcttcaaggtacattctaattgatcagactggagtgactacggttgttcaaggaacaattggttacctagatcccatgtactactataccggtcgtctaaccaacaaaagtgatgtttttagttttggtgttcttcttatagaactacttacccgaaaaaagcctatctataggactgatagaggtgatagtcttgttccacattttgcctcactactggaagaaggcaaattggttgaaataatagatccccaagtcaaggaagaggagaatggggaggttgaagaagtagcaacactagcggcaatgtgtactaagttgaatggacaagaccgaccaacaatgagagaagtggaaataaggcttgaaaacttgcgagctaaaaccaaacatgctccatataataaagaaccaagtagatatgaagtatcccgagttgcagggcattgcatatcagctagaggggacatcgaagaagtactaataagtagacacagcatggaagatgagatgttgtcgttagaaaggtatcctagatgatatcgtgtttccgcgtctctaatcgccataatattgtttagtagaggaatatattgctactttctacattttttttcctttgtgtaatgctcttttgtaaaaagaagaaaatgccatggctttgtttcatgttacaaaaaggactaaggccactctgtatacattaattggatttgaaagatctatgcactagagttgccttgtaaggggagattggaatatctatgatcctaagagtgcggtgattgttttggtgattaatgacaacccattgttggaactaactatttccatgagttggtgagattaggttaagttccggcatcaagttaaaagattaaagctagaagatggacattataccttgatgaggagcaagtgaagatattgatgatgcggggtatgaaatggctatctatggcaaaccggtgaagagaaagcaaagctaggctagaagatggacattataccttgatgaggagcaagtgaagacattgatgatgcggggtatgaagtggctatttatggcaaaacggtgaagggcaagcaaggctcggctacaatggaccatgcggggagaggcttggcaccgatggaccgaatccggtagtgaaaggcgagtgaaggctttgtcatgatggtcatgatggactgtgcgaggccatttgaagctatgagtaatccgtatcaattataagaagaccgcgagatggaatgccgaggatcaagaggatgtggttcttcgatgaacatcaagtcaaaatccaaagtgggcattgatcaaggcaaaggtataattgatttgggactaatatgcttaatgagtgtaggtgagaatagtcccaatagtgaaatggcgttgacgttgacaaccctcaaggtgaagcaagaagatgacattcctagtggtgtattagtcccaggttgcttagaagtggactaggatgtttggagacccccccaaaacatcaaaatcaaagcggcgagaagactcggagctgagttagactagtttactttttcgctttgagtttaggaaaaaccgtactattaagaggggttccaagtgtggttctgagataacacaattgctcttagtggtgtccaagtgttgaaatatttttaggagctgtttttgaaaatggctctactcggaacagagagtcccacccggaggttctgtccggaacttcctagcgccgaggtgaggttgaaaaatttcctaagtgctgcctggaagttcctggcacttttacccgaaacctcctggcaggtttccagttcaaacttgtgagtaacggctagatgacgtcacctagccgttatatatatggatctcgtccccaggtcaccctttggccattccacgttagttcttgtgttccctagcttgttctagcctcttccaatgtgattttgcttcctccacccaaatcttgtgtacttcttgagtgagagagtgattttgagggtggtggtgaggattggagaaggttttgaaggctaggatgacttgagcacttggggtatctcgttgggctatcatttgaagcttgttactcttggagggtgacctcctagacggttaggtgtcgcccgtgagtttccaacaaggttgtggattgacccgggcaagtttgtgagggtgttattccacctccgaaaggaaacggaatacacggtgagtgaattccgagctgaggtttaggaggtcgttttggtagagcaagcctcacttgtggtgttctcttggtgttcaagttggggatcttagtggtcacttgaaaccaaagagaagtacctaggggtgttggcttgaataccggagacctcttcctaggcctttgcttggtgaggcaaggggttaatcaggatccggctctttggagctcctcaacggagacgtaggattctcggtggagaatccgaacttcgggaaacaaatcgtttgtctcctctcactctctttatctttgtgattgtgatgcttttctccttatttgcctagttgtgctatcatgtctcccattgtatgatcacttgtgctatcttgtatattttcatgtgtattactcttgtttgagacatgttgtacctctctatggtttaggcttccttgtgatttaatttacttgttgtgaggtgcttgaaatagcaattcacaactgcccggaagttcctaggaagatccccagaagttccgggcagctttctctgcttgtgagaaaaagctgccaggaagttccggaccttttgccaggaagttccgggcctgattttaaccgctgcgatttgaagtaaattttagaaacacctattcacccccctctaggcgacatcaaggccctttcaggattaatcctgtgttatatgtacaaaataatctgacaaatatccttcgtatgaattgtgaatataaaatacgaacattaacaaaaatagaacttttttccaatcttatttatatcactgaatgcatggatataatatctaaacataccaagtaaattaggtatcattttcttttgaatgttcaatatatttagtattatataatatagatatatagagttagaagcaaaatacatgagagatagaggaatgagatcctctgaagacattttccacccttcctgcatgacaagagatatgcggataagctaggtgagtggtattgttacaaacaaactgagaactgtgaatcaatttgtccctagcatcatgcgcctgtcagcctttctattgatctttcttggaatccagttcacctgtagatgatttccttgtaccgcacactgcatttcactgagtattggtctgagactccagtgtctgggatactcctggaaatctcctttactgaacgttgatgcaattgtgctataatctgtaacgtggatcatatctgcaaagttcaaaaattatttgagcaattacggaggccaattgtagagcaatgagtgagttcagcttgaagtggggacattcccatggcacagttcgctttgatgaagaatgtattatgatcatcagggtgatggaaaataacaattccaatgcataatctgcgatctatgtagcacctatttcttacaggaattgaaaaggaataatttacaggaattgaacaagaacactttcaaggaaaaaaaaaaggaatatatcaaatccacccattagcacattgttaacaacgaaatttggtaagccccgaagacatcatcggcctagaatcagtattggtttcagagtcctagaatcggccgatgagaattattacgtcgccaatagtcagattcctgctatattcggttaaggaaattaatctactaaaggaagcttatccagaagtaaccgagttcaaggaggatacggcatggcaagttatctattaattaggaatagtttgttagttcccttttatctgtaggaaagtatgtttagtatccaataatgactttatgacttctggattacttcaacaaaacgagcgaattcctcgtccactgacggtttcatactccgttgaggaaacggcagcaaccgtacgtgtgtcgcagtactcctgcggcactgtcttttctagctgaacttccttgtcagccgaatcactagatggcgcttctttggcaatctcgttagttcctgcagggttaggatatggcagatcacgagtagacttacctcccctcgtcgtgattgccttagacattttcaacggaggagtcaggttgccccagaatcctcccagtttcatttgcagggactaaggatgccaattgagctagctgggtttctatcattttattaaaactcagctggttttgaaaagcagaagcgaagccatct

SEQ ID NO: 16470 - DNA, 2103 bp, Oryza sativa
tttgacagtgtgcatgcctcgctgacgggtctggagtcgttcctcgctccaacccatattggagaccatcttctctattagatcaacggctccttaaaccgttttagagaagaacgctcctccagctgccgcgtccaggtgatcacgggacatcggggtgagtcaattttaaaagttctgcaggatcagccagtcgtccatcccatgatgaggacaagcggccacgtactcttgcagaccctcccatgcttcaggaatagactcatctcttgtctgctggaaacttgaaatccttccacgaagggcattggttttgcccatcgggaagaatttcgagaggaatgtcgtagagcatttgtcccaggtgttgacagcagcacggttggcatagaaccactcttcgctctcccgagaagggagaacggaaacagtcacagcctgacggcgtcgggactgacgcccttaatggtgtacgtgctacagatctccaggaactgttgcagatgagcattggcatccttattaggcttgctatagaacgggctagcctgcgccatcgtgatgaggctagacttcaagtcgaaatccacgtctcccatgttgatctgcggcccaatggccacattgtcagcagagggagtagcgaactcgcggagagtcttgttagccataatcttgaaggtcggtggtgctggtacggctggtttctctgttggtagagtttttttgcggagcaacgactcgcggcctgacgctccggaagaaagcttctggattttctttgaagttttccggcaagttgaaactagtcatgcactaccctgttttcacaacaaaagtgaaaacaaccaaggttagcctgcaaaggaaaatgattacacacaggtaaatataaagtattagttcaggtaatctctattatgaatcttccccggcaatggcgccagaaatgcttgttggtatttcttaacgtcattactagaaatataattcccagcaatggcgcagaaatacctctggtatattatggttacagagttcatccgcaagcgcacggatataccattgtagcatttcacccgagagtattccaagggtatcgtatttattttatcccgtggaaagatcatgtagagagaacttgattaatattttatatattacttgtgataattatattctaagcagggttaagataatccaagggtagagtgacacacaagcattagctactcattctcataatatattatctaagctaagtgggaagaagagagaaagaaaatctattcctatacttctaatatacatagtatacatgcattctagttaaccgatatactagctaataccctctatccgatgccctcctggtacttcgagaagccacccctgactgccgagttccttacgacagcccgtcatgaccatacaatcggggctaaatacggaggaataccctcctcaggaattaacttaggattatatacaggcgcggaggaatacccgtactgagctgtcatcatcagcggcccacctctcatctgtagcatataaccccaaataatgatatcccgtaatctagacaccatgtctaaactaccagatactactctaatatcatcgtcatgacatagagtaattgcataagcaaatattatacccgcaccaaagcatctcccagataagctagccatatattcaatataacatgaacataatgtaaagtaggtactcatatactcagaaagtatttcaataccataaatgtatatagaagagtattctaataaaagtacaaagcttacaaaagaggaaaggaaagctactagagccatacccgaactcttccgaaggcttccggactcctgatttctactctatttctattccaccagctagatactactaaactaaacttgagagaaatgagagagctcttgcttgaggtgtgtgtgtgaagtgagaagaggagctccttttataggcaggtaatgacggttgtgacggttggaatggttggtaataccctccaaccgtcattggggatcaatcccagctatccatccaaaccctgcatccatcggtgccacgggaggttcg

SEQ ID NO: 16471 - DNA, 4095 bp, Oryza sativa
cgaaccatgggctggcccaacccagcccatcttcggctggtggcctcctttgttgttctcctccatagacttgtaaattttggcccagtgtgtcgtgtcatttctgatttcttggcctattcatacataagtctggttctcaacatcgtccgattgatttatcgtctgtgttgatgtcgagtctcctccactttattgtcattctctgcaaaaggttagtataccctatactagtggaatattattattctaacagatatatgcattgcaagcatcacttgttctcctctattttggtaatattgacggtcgaaactgatcgataacgaccgtcaacaattatttacatgtgtgatgcgagcaagatttcttttatgtatactatgtacttagtatactcttcaaccaatggagaaacaaatattttctatcttaatttaagagaacattgtaccaaaaaagatatataaaactacaatattttccctatgacattggaaaaatattgtggtgacttgtacgctaaagcacaatatcatcttggatacctttccaacactatctcgtcttccatgttgtattgcctacttactgcttccgtagggtcccctctacttgacatgcaaggccttgcgatttgagatacattacacatacttggttttgtattatctgaagcaagtttcatcttcacttgcaagttttcaagtgtcatttacacttctctcattggctggtcttgacggttaaaacagcaggagaggctcctactgcgcaaatatattaaaaagagaacggcaaaatacaagggaaactgtacagagggaatacaacaggggggaagaaagaaagaagaaaagaccgcctgaaacgcaagctagttaataaatgctattaatccatgattgccacaatggtttttctgtctcctttactctatgcaaatgcagagtaaactcatccttgaaatcagccttccatttgccaaattttgcttggataccattgaagatcaggtcatttcgcctactccagagatgccagcaacaaattgccaaaacttccataaagaagggatgagggaagttcctatatgctgcaatgatcatgttcatgaaattcagatttagatcccagattatgccgaggaaatgccaacattgttgggcaaaggggcaggcaaagaagagatgaagaaagtcttctgtggtcgagttgttgcatgtaacacatgaagctcccccttgggtattgaaatgtcttcgttgcatcagctctttagtgtttaatctgtccaataaaagtagccaaagaaacactttcaacttgagtgtgcatttgcttttccagatgagagtcaagggaatttcaggttgaatatgggtgaaaaacaggtcatagactcttttcggttgataatggggagagttccaaatgtatgtccattggtcttccatatgatttgagtttaaagtttgaagagtgatagaaagaaggtggcattcctgaattgcttggatggggagaggagtataaaagatctcatctaagtgattccgagatttgaaacctttgatagatatgtccttatttttggcaaatgagaatagggtgctcagataatcctctaaaaaacgccctgaccaattatccttccaaaaaggtgttgtgtcaccatgttaacgactaaatttggtaatatatggactaggtttaacattggaatcaaggcggattcggcaaggagatggattcaaagaacagagtatgcatcggctgcgacgacatcggctggagtttgcattggctgagatggatcggacagaggacagccgatagaggtgatgcagccgatttcagtggcgatggcttcggagctgttcgtcgagttatcatatacacgttgcaatctttgttagttacatcatatagcttgttatcggctgattctcattgtcgggaagtgaccgatagtgttatgtttcgttattaagttagattatatcgtgtatctaccatcttttagagattttcatcatcttgcttagatcttatacttatttttatgcttaatgttgcatcggttaagttcgatctattgagttctatctataattgtgatatctagcctgttttatgattatcaagagagatagtatcggggtttcagccgatcttacctgatttagccattttatatcccctgtgcttgattgttatgctaagtctgccctttatattaagatctcatttcattacggtatattaggctttttgtttaatatattctgcttgtcttgatatcttagtatagagtggtatcagagtattagccgatacatgctagatctatctgatcggctatgctataaacatttatataatctttgctttaatatatatttcgacttaagtgatttatactgtctcagcatggcgaccgatctaccccaatcacttggtttaaatatgtatcgaagtaaagattatatattgttaatatctacggccgatcgagtagatttagttttatcttatttactcatgacagccgatcgattccaatgtgacatcggctcaaagataaatgatatgtcatcggcaaccagccgatcggctatcgtttatggatttaactatggttttcttgtttctttttcttgttgattgcataatcaaatcaactggcacgctcacgaacttaaaggcaagattttggacctgcacagaagttaagcagatctttcaggccagtgtgtgtttttcgcatcaacacaccaagaccaactttaaccaaagaaatggctcgaaaaattggagtcaatctgagtacatccttccaccaaaaggatcccttttccacatggcatgcgggggcagaacagagtttgagtaatacttgtcccaaatcaggttaacccatggcagatcctttttattgtagaacttatctagatgcttgagtagaagagctatgttttgtagctccaggttgatgactccaagacctcccttctttttaggctgacacaccaagtcccaagcagccaaggaatgaactttagcattaggatcccttgatttcctccaaagacagtgcattcttgccctgtcaatatgttgaataaccttctttggaagtttaagcgaacatatatagtatgtcggcagggaggaaagtactgagtttaccattgttaagcgctgaccatgattcaggaaggccgctgtggaagggagccttctctcaattctgtctactagaggggcaaaatcaattattctaggtttggttgaacccattggaagaccgagataagtgaaaggcatagagcctatgaaacagccaaaggtgcccgcaagaatttccatattttgctcatccacattgattgggatcatacaagatttatgaaagttaattttcagaccagtggagagggagaagatttgaaggagacctttaagacagaaaatctctttttgatcagctggcaagataatgagggtatcatccgcatactgtataatggggaatttcgcaccaggttgtgggatgggctgagacagaatgccagagtcatgagcagaattgattatagactgcagcagaccagctgccatgacaaaaaggaaaggagagagagggtgaccctgtctgactcctcttttgcatttgaaatcttttcctgggaccccattgagcaggatagaggtggaagctgaggataaaatgtttttagtccagtttacccaaatctcattgaaaccctttgctctcaaaatttgtaggattattacgtggtccaccatatcaaaagatttttcaaagtcgattttaaggatcacaatctcttttttgctttggtggcattgatgaatatactcgaaacaccatgccaaacaatattggatggtcctccctttcatgaaaccatattgatttgggtgaatgacgtacatgatgactgattggaacctatttgtcgtaatcttacatatgaacttaagggaggagttctgtaaagcaattggtctgaagtcatttggtgattcagggttagacttctttgggattaaggtgatgaaagagtt

SEQ ID NO: 16472 - DNA, 4913 bp, Oryza sativa
  unsure (1)..(4913): unsure at all n locations
aggtgggaaattttattccttctgtacctgtcagtagcagaggcttgaaaaaaggagggattttcatcaccaaatttaacccacctagcagtatatcgtttcctccaaaactcatttttgtatttcagaagaaccaagatatgattctttagaattgatctaaagttccattcatgaataagaagaggcctttgttcctcgatactgtccaaaaacaccagaacttcattgcaatttgtgattagagtgtgcaaattggatagccttttactccaaaatttcagctttcttttgagattttttagttttccattcaggattactgtctgattagagcttctgacattagtattccatgactgttgaacaagatcttgaaaacctggcatatctacccaaaaattttcaaacctgaagaggttggctctaggaactgaggtttctatgctgattagacatggagcatggtcagatatgtattttgatagagcagtagctgaagtgtttgggaaggctaggttccaggcagtggaggtgaacacccagtctagttgctgtaaaagaggttgatcttgcatattactccaagtgtaagccatacctgtgagggggatttcagtcagacccacattgctaatgatctcattaaaaagcataatatcatttacatctccaccaggaaggtttctatttttaactgatcggatgaagttaaagtctcccatgaaaatccagttctgattcaaatccacttcgaggttatataaccaggaaacaaaattatttcgtaactcacccgcacatgggccatatatatttgtgaggttccaggtttcatgtcgggatgaggttgaaaaaactgcatggttatagcaaaggggagacaagaaattagagtgctagtaaggacactactattccagattatgattaggctacctgaagcaccagaggatggctgaaaaacaaacttgtcaaagcgtctagggcaaaatttttgcaggtaggaatggtcgaacacttcttttttagtctcttggaggcaaataactgaacaagaggattctgcaattttttcagataaagccagccacttgtgggaggagtttattcctctgatattctaacaaaggatgttgcaggatctgttgatattgttattcatgggggtagaactgaaaagagagatttaccgacgcagataactatgaccccgcaccacaaactccactgaacattcagagaaaaccctttcatcaaaccgagtaaaacatcagaagcacaacaggagttatcagtagacaaatagcagcaacaagagttccaaagccatttcacatagcagtagttccataaccacaaataataagggctccagcaaaagagaatagctaccctattacatagcagagtagcaaagctccacagagcttgattattacaaccatttggaaaattcattttttgggctgagagagtttgtcttcagctacttcctcaggaagcagcccacaataatccaccccaatcttctgcagctgttagaacaggaatgggaggggggagccccttgccggcttcaaacttgaatttcttgatgggctgcactttggatttctttttgggcacatcaaaggccaggtccatcttgtcttggcccaggaatcttgggcttctcctaaggtttgcagaggtgattggcacctttggtctggattttcttggcttgggtgtgattggagctggttgagaagcctcatcaataactgaaaactgaagtgctctgacaacagggttatcaatccttgaagtcttttgtctcttggctgggctaggactgtcaccaagagcctggaacaatgaaaggttgactgagatattccagcgagtagagacaagggaccatctttgaaacatggctacagagcggcatagggggctgacatgacagcagaaggggcttaaaatctccatttgctactgccaaacaaaagacctcaggtagcttaatgataggcaaagtaggaattgggagagcatagggaatgatctgctagcccaagtgctgctgctggtccaacagaaatgttgagattgtgccctcagaggaaaaatcatgcactgtgatggagtcttgctgttccccagggataggttccactaacatatcattttcatcctgttgctccctcatatgatcaatctcatgttccagcccattatggttatgcttgatatcatgatttgcattattcccccagttgccttgatgcttatgctcgttgagatgagggtttgggggaatcatttcccagatagttggaaggtcctcatctccaggcagcagatcagtgggctccccctagagaacaaaaacatggaaggtccaggactgaccttggcccccataagccatggcgtcactcataaccagtttacgaggcatatcactgacaatcttatacctggctttcaccaaaaccctcccgagaaccctgtcttgataatgccagtctatgaattccccaaaaggttagtggcttgaacaatgatttgtcgagttttcatatgaagcggaatcccaagaaacattagccaaccttctctagtgaaagggaaattatgccagtttgctaactgatcatgttttacgaaccaagcatggaaccaattacccaagagaacaggctcactagcaactagaacatccctagccagggcggaggagagttgcacaatgcagagagctagtgggtacctttggatcctaacaacatgcatacgatgctaatgctcaataatatttgcaacttcatggatcaactgaccgagaaaatgcacagggggctagggatcagtgactacggcagcaaaattttcatgtgtcctgtgcacagtaccttgaaaggtgaagtcggcccgaggcgagcggccattccaggggatttcgatgttggtgccgtggggaagaaacagctccggccggaactcggcatcagggaggttcgccatgggagatggagaaggaagcaggagatggttttctgtggcggagggagggagatgacactgtttggcaggggaggtagtgggagagagaacggaaggcgaagcgactgaataaggaatgaggtcctttgatttctccgtgaaagtttccgaggcctttttcctccaaaccttcctaacccgcgaaaggcaagagtgggccaaatgtccataattgtggcaggccttacagcggaaggtggatcgacaattggtgctagagagacctgaggaagagcaatctttcatacgatcaaacgaagcaccattagcaagaagcagtctcttgaacactgagggtttgcccacatgannnnnnnnnnnnnnnnnnnnnnnngaggcataagattgctgaaacccagaaggacgcttgtgcttggaaaccaaggtccattgatttgcttcttctaattgccaagataagaattccttgcgccaattcggaccaccattgctccataagaaaaatctgacatgaaaatccttgccaataaaattacgaagagaatagatatgaagccccacccttttgttgcaaaccaggaaggataaactgttacccttgagatgatgaacctcaaaactgtgaggagtgccaccaaggcaggattaaagagcaatggccaccaatttagtggtgagacgaaaattgaacctcacaaaatcaaccaccaacttgaaaggggtagagcctaagtggggagagaaatgaataggagaactgaaaaaatccagaatttgggattcgagagccttgccatagtcaattccaaccttccgggggagagggagtaaccagagcatcatcgtcccctcccctcccatcaagtttatctcttaaaaaaatagtaagtctagcatcatgttatattttaaaaaccttatccatcggctggtcttgtccattcaacttagtacacattgccgctagttttgctacttctttgatacttatcttcaccttccataacttgaagatctattatttcaaacaactttctttctcggagtagcgacagaaaatgtaaaacaagactatcaccattcatcagttctatatgtgggctagttttttctagtaagcggttctataagaagaacaccaaaactaaaacatcacttttatctgtgttagacaacgtgtataatagtacatgggatctaagtagccaattgttccttgaatgactgtagtcacctcagtttgattaatcgggatgtaccttgaagctccaaagtcaaatatctttactattaaattgtcgtagaaaagtatgttggatgtcttgatatctcttatggaatattggtattgcagtagctgagtgtagatagaccaaagctcaagcgacttcaagaccaatccttactcggtcatcccatgatagagaaactggcccatcagcatgaagatgatgatcaagagatccatttgaaataaactcataattaaccaataatggaacttctatacctcaaggcaaaaacctagaagctttacggtatttcaatgattaacttgagaataaattgcaacttcatttatgaaatcatctatttctctcagcactataatccttggtttcttaatggaaacaacatgcaagtcatgagttttatcaaagtagcaaccaatgatttttcttaaaatatctctctttcatcttctttaccttatgcaactttattttgtatcttatgaaggggacaacaagtgccagaattaattttgtatgtttgcaacataatgtagcacatgtgttttgtttacaaaataatgattgtttcaaataaataaatatataacaactagaggccgattttctagtgtactatactaagtgggggcattggccctcgcactt

SEQ ID NO: 16473 - DNA, 26546 bp, Oryza sativa
  unsure (1)..(26546): unsure at all n locations
ccacttagtatagcacttttctcccttttgtttacgaagaaaataaatagttagtagcaatatatgccttcactagacaatattatgttcgatgccttgatatctctatgaaattttagtgattgtagggtctgaatgtagatagatcaaggctctactgacattaagtgcaatccttatcgggtcatcccatgatatagatattagtccctaataatgtgaagatgatagatccatttaaaacgaattcataaactaacgttgtaacttctgtctcaaggcagcatcccaaaaacttcaccacatttctatgattgacttgagaaaggattacaacttcatttataaaatcatatatttttctctacactacgatccttgattaatttcttaatggcaacaacatctatgtctaatattcctttgtatacaatgtcatgtcctccaccgccaacttcacgagttttatcaaaattacccgatgatttctatagctcctataacgtcaagatcatttttttcaccaatctatatttcatttttttcaacttatgtagttttatatgtgttatgaaaggtgcggcaagtgtcataataaaaatatttacgtcacctctaactcctaatctgatggtgaaaccaaaaaaaaatcataaaataccaaattcaggaatttctataaataaacatgcataaattagcagtatatacaatattgttactcctttcatcatctcataatataaaatgatttcgtgataccacctaccaacttttgcaatagtttatattgaaagtgaatgaaatcgattggagcgagagagaattgagcgatagaaattgtagagtgaatgagcgagaggtctctttattgatcaatgcggtacaatatatatagaaggggaaggggtggcaaccgtagacatgatggttgggaaccatcgcgtccgttgccaaggtgcgccgattgggaaagaaggcgcgattgccttcggttgctatcccatccttttacatggatgaaatcaccaactagttatttcataacactcccccttgatcgaattcactttgatcattgctcatcaagtgttctagatatctgtagagataatcttagaaataattatagttagtatattaaatacatcacgtaaaactcctcaaaaacccagcgggaaaaataaggagaggactgtgatatataattgactacttttagatgtttatgagtaaagctcatagtatgatccaaaaatagtataatgtctacaattatcttgttgagcaaccgggttttgggttttgggccttgtaattgtgttgttcaaaagccagatcgagttgtgtcgcgactccgcccaaatcgactgtttatccatacctatcagaagatcaagacctatcttcttcatcagttggtatcagagtacagttacccattaggtaatttatcgtccctattgacgaaaaaatcgaacacaccggcctaggatatctgcttagctcctgtgcaagtccaaatcttagtgagatgcaggcatgccagtcagtttggtcctgcaactaacaagatatgcaaatagtagatcaaaacagccgatcggctgacaagccgatggagtagttccagccgatagccgataatagccaatgccgataccagccgatagcgatagggttttgtgctatcagctatatgtccaatgtagataatgatataaaggcaaccggctgatgatgatgtaataaaataacaatataatccagtataaaccaatcggcaaataatgatatgataaataagcatcgatccgaaggttaaagcacacatcggctggaggtccgatttcatgaaatccacaagattagattaaacagtgaaacctttgttgtcatcggctaaatccaacttatatgtatatgcaatccttatgagccgatgcaacgtccagataactcgccggctgaaaccccgatgaaaccctaattggcaatcaagaagcaggctaaagattatggttctaggcacgacttagtagatcaaacttaactgatacagcactaagtatgaaaagaaacataatatctagacaatcaagccgttgactgagttttcagggtggtagatgtctaagctaatctaatctagcaacgcgatttagccgataccggcagaaactctaaaacgagaagcagccgatagagctaaattgatatgctaagactagattaacagagacatatgataaataggtaggcaaatatatcatccaaaccagagcaatccaagaggtcgaatgtactgatgcagccttaaacgacgccgacgtagacgatacaattgcctagaccggcgctacattggacttatcccttcgccggaacgtaaaaacaaaagtagaaataaaaagggtagcgatgcgccgaattgtattgatcgtagcgatagattacatagactctgggtgtacatatttatacccatgggttgatacaagtccttgccggacaagaaagaaactttcctaaagataaaaggaaaggataaagtccttataggacactaaacacactttcctaaagataaaaggaaactaataaactattcctaattaatagataacttgccattccgcattctctttgaacttggtctcttctggataagcttcctttagtagatcaatttccttaaccgaatatagcaagaatccgacaactgacgacttgacaactctcatcggctaatctcaggacttcgaagccgatgctgactctaagccgatgactactccgggcttaccaaatttcactgttaacagtcccataaccaaaaaattgccataaaaaatatttattatttacctagacaatttgagccgttgcattgttctattagattttgctatgttgaattctagattgcatcgtcatgtcaatgctagtttagttttagttttagattttgctttgtcgagccaaggagacatagaggagtgattgggaaaggaatcgctgggagggagatgagtgggggcggcagagcgagatgccggagagggagccgatgcgggtgcactcgcacgagagaggtgcaatgcggtggggccggcagagcgagatgcgggggaaggaagatggacgcggatgcagaatggggtgtggatcaattagattagatcgaacggttaggaaaaaaatgatgacgtggaagcaccaggaagcagagaatttctagtagtgggatgatttgtgtagctatataggattaaactcccaaccttattcacagatgcatgcgctgatgccgtcatgcgcagctcagctaactagcttaggctctagctcctttactttccaacgaaaattgctaggaaaggattttcatttcctctcactgtttgaaaccccacacctcagcagaagcatatgttttacgtgggtggcactgagtatatggcctcattgtttggcttttttattttatttttttcatctagtttatattacatcatttgcttttgagtcattgaggacatgtatacaaaatgtttactcacaaatgatctttttttgagattgaaaagaaactaagtagttggaaaggtaaatatatgccagttggggggagactaatgttgattaattatatgtttatgatttctttttttaagatttcaaaatgagttcttcaaaaaaaatgattattatagatcatgcttctttttggcaaggagatgagcacaagaagaagtataggcttactagatgggaaattatttgtcaacccaaacatcaaggtggtcttggagttcataatcttgaaattcaaaatcaatgtcttttgagcaagtggttgtttaggctcataaatgagtagggcatgtggcaggtctattgaaaaggaaatatctttataatcgatccttaagtcatgttgagaagaaacaaggggatttccatttttggtctggtcttatgaaagttaagagcaagtttctaaatatggggtcctgaattgtgaataatggtgtaaaagtgagattttgggaagataaatgggtagtgaattattcttttaaagataggtatccatcgttatatgctatagttcgtaggaggaatgcttcaattgcaaatgttatgtcttctgtcccactgaatgtttcttttaggagaactttagtaggaccgaatttaaacaattggcataatttatgtgtgcttcaattgttcatattcatttttcagaggagaattatatttttagatggaatttccatcaaaatggtgtattctcggttcggtctatgtacttagctttaattaataatggcaacattgagagaaataagattatatggagacttaagatgcctctcaaaattaagatttttatgtggtacctacttgaaagttgcttttctccccctagtgggttttggtgattaatgatgaataaggttaagggactaatgagtttattgagatattcaggtgattagtcccaagaacttaggtgatcaagagatgcttggagaccccctacaacattcattcaagcggatttgaagcccgaaagtcaataggatagtttcatatttgaaatcgagttttaggaaaaaccgtactattaagaggggttccaagtgtggttctgggatataaaaagtaggggtgggcaaaataagaccgaaccgaagaaccgaaccgaaaagaccgagaacgagaccgagaaattcagttagtagttcgatctcagccctcaaaagaccgaatttttttcgggcaattcggttattagcttcggttaaccgaattaaccgaaaaaaccgaatttgtggcccaataggcctaggaggcccaataagcccagtaaattgctaaccatagaaatcacacgcggcgccctcaacccatccatcgcgccgcatcgcatcgcctccgcctccacctcagatccccatccatcgcaccgcctccgcacatcgcgccgcgccgcctctgccggcatccatcgcgccgcgccgcctccagcttgccctcctccgccgcggccccgacgagcactgcctccagccgagctccgccgcggccctgacgggcgccacctccagccgggctccgccgtggccccaaccggcgccgtcgtccgcctccagccaggctcgcctcggcgccgtctccagcttgcccacctccgccgcggccctgacgagcgctgcctccagccgggctccaccgcggccccgacgagcgccgccgcggccacgccaccaacccttgccgccgagccaccgaacgtctccagcaaactcggtctgaccaagaccgaaaccgaaaaaaccgagaccggatttgtcggtcctgagtttttctagatgaaattcggtcctgagttttcaaaaaccgaaatgaccgaatgaccgaagaccgagaccgaatttttcggtcagaccgaacgcccacccctaataaaaagtgctcttagtgggttccaagtggtagaatattttttaggagctatttttggaaatggctctagcccggatagagaaggctggccggaagttccggtccctggacccggaacttccggaccttgcgagttgaaaattttcctaagtgttgtccggaagttccgagtgtcaggaagttccggactccttccagttcaaaaatgtgagtaacggctagatgacgtcacctagccgttatatatatctagatcgcacccagctcaccttttggccatttcacttcatttctttcatgccctaggttcttctagcctctcccaagatccctttgcttcctccactcaaatctagagccattcttgtgagattctgagaatagatgagagtgtaggagtgatttggagaaggtttgaagattaggtttgtttgagcactttggatatcttgtgggctgtcacttgggcttattactcttggagatcttctcctagacggttaggtgtcgcctgcgagcttccaaagatcttgtgaatgtcccgggaaagtttgtgaaggttttcctcacctccgcaaggaaacgaggtaagtgattaaagattcttgtgctgagtttttagaggttctcctaggtagagcaacttgcacttgtggtcttttctagaaggatttgtgagttggatcttggtggtcactcaattctagaaaatgacctaggggtgttgagttgaaggcattggacttcttctgagatctttgcacaagtgaggcaaggggttaatcgagacccggctctttggagcacctcaacggagagtatgattgcaagatccgaacttcaggaaaaaatcgcctttgtcctctctgtgatgattctgtgcatgttgttgtgattgtgtatctgctctgtcttcctgtagtttaattcgtgcaatttagttcaagtcactgttagatcttcaggtttttctgttgctcggaagttccggtggttagaacaccgaaagttccggacagtctgagcagaccggaagttccagtgttctacaccaggaggttccgggcctgctgaattttaccgttgcgatttgtttgtgatttttcggaaagcctattcaccccccccccccctctaggctacatctttgtgcgttaactacttaaaggggttgctctaacaaaggacaacttagttaggagaaattggcatggcagtttgaaatgttgtttttgcatgagaaataagactattcagcatttgtttgtggagtgtcactatgcaaaatttctttggagagctctacaatttactactggtttatatactgctcatagtatacctcatatttttgagaattggctcatgggagttgataaaaaaatctaccaaacttattcttgttggagcatccgctatatgttgggctatatggttgtgtagaaatgatatggtttttgataaatcaccatttatgtcctatatgcaggttcttttcagggcaacatactagctccaatcttgggctcaactactaaagtgtgatgaagaaatcaagtcagtgaaagctgcatgtcgtaatcttgagtcatggttatgcagctattcgctaactttggatggagatccacaaataggattcaataatttttgtgatttttttatgttgtgtgagtttttattagtttgtgtgtgcttttatttattcaggtgtgagtttttattgagttggtgtaatatttgactgtatctctttgagcaaaggccgggattatattccattatctaaaaaatgatctttttttttgttaataagcgattcggataaacatatgaataagcgaaacaatgggacttggttgtacttacatggattgacttcttttataaaagagaagctaataaattatggagcaaatttaagaacccaatgttttatggttgaaattgcacaaacccaatgtattataatgggtggcatatatataacctaagctgttatggtttatggttttaaagttttataaaaccctacccaaccctaaatatttacttcaaattttacaatttgaaacttttagttgtcaacttcttatcaaggttgttggtctaactaaaagaaatttcaataaagatgggttttgtgaaacatttcagatatgccttaaaatatagttttctgtaactccaactataacatacggagttttatgaaatttactatttttttacggggatgaaatttactgattaaccataaaaaaataattataagttaaacgagagtgattatacatgtcttgctcgaaaagatttcgagagttgttcggagccattgtttcgcttattatatttgcaaatgaaaagtaatttataaataaaactttcacatatgtgttcttagcgatctaaaagaaaatgctgaaaaataaacttcagtgagaaaaccttaaaatcatctccaaatttaaggttagaaattcaaattttgactgataggcataatcataagcgaaaagacgagtcccgtttatgacgcaatacaattgaagcagtataacacttgttacgaaacagtaagtgcagcgatttgtataccatgaaccagcatttgaatgtcttcgtatcataatcttatacggcattctatcaatcggtatgaacacttcgtgacatgaaacgctaaggacataaggacatgtttgacagggcttcaactccacctcttttagagctgaaacattaaaaaaaatagagcagggttaaggttgcgtcgcaactctactttggagaaataacacaggcctaaaaatatcctaataggattttctcctgtgggtgaacatgtaatcggacacagctaccattccaaaagtgtatatataacttcccaatgaaattatggccttgtgttgaattccaattggaacaagtttactttaggtccctcaatttgtcgctgagtttgaattgaaccataataccaggtatagcccatctccaaactcgcaaaatcgtgtcaaatttcatcccaaggcagtatagctcccggttccatccgacgtagcattttgactccggttagctgtgttgagtcagcgtgggacccaaacaagctccacatatcattagccaactctttcttcctcatctctctccttctctttgccatcctcaccaggtcaggagtcaggctgcgggcaccatagataggggcagtggtcggcatccggcgatcagtagggagaagggcggttggccgctggtggcatggacagggaggcggtggggtccaccttgagccagcggtaggtgatccaagagaacagtggcgccgccaagcaggcaccccacttccggttgggacgatgttagcgatgtcgtcgccgagggggctagggtttctgacgggaatacatgttacatttcaggagccagaggtttagtagaggaggtggtgtttgtgttgctgctacaggcagaggtcgattctgtgcttgtttgtccgacgtccgtgtcgggccatctcgatcacctcacgccgccttgtgagttgaaattttctctctgtcggccattcatgttttgttttggaatttttgctcgatagttttttgtgatttctgatttccctgtgttagcgatactaattgctttgaccatataactgaatggtgccatcaacatctagttcgtatatgacatttttgtttttgcgctcatgtggtcgcttcaattaagtgaaagcagggatgtgtccttaacaattgtctttcatggcatttctttcctccgaaagcactgcataagaaaaaaaaccaaacttttgtcccatgtgatgtgttagtatattgctgatatggtttgatcgatgtatggcaactcttggcagtgacactaataaatgaataatcaatgtttgaataagatgcacacgcgggtaaggaacggtactgtagttgtatgcagtacttatctcttgtactttggacttgaactaggctggcttcttctggtatcatcacttagtttcatgtccactactattagtcacatggtgcattccgatgtttgttattttcgcaatgtagttttctgagcattgacctagaaattaaacaatccattatcatgtagcgagccctggattttttttacgggtaaaacagcaggagaggctcctactgcacttatattaaaaggaggaaattcacatagagaaactataaggggaaaatataaggggggaaaagaaagaggagactaaggtcccattctttttcctaacaagagttgaattgaagattaagattttcgtggcactcttttcaaactgctaaacggtgcggttcatgtgaaaactttctatatgaaagttactctaaaatatcatattaatctatttttaagtttataataattaaaactcaatcaatcatacgttaatatcacctcgttttgtataaaaaaacttaatctccatcttcatcttcattttcagtaaaaaagaacaccacccatgaatccatgattgccaagatggtttatctgcttcctttactctatgcatatgcagagtaaaattaccctagtttggttctgtaaatgtaaacaaaggagaacccactgctttgagatatgatcatggttgttcttgtcttccctaatgaatctactacacttgtatttgttaggtcggaaagatgaggaagggactacatcctcagatgcagtatatctcatatgtgacttagagtggcaggctgatgaacatcatgatgaccaagatcagccacaccggcaaagtgcaccacatgagagcgaagcatcggatggctcagagcctagggcagattgccaagttcaagcgccgatatgagctggaagcagaggaaaacaatggcaggtagggagaattgcgtgtggaaaataatagtagatgttgttggtggtaggcgtgtagcatgtttccgtgctatcaacataatgtgtgatccccacgtttactttgttatgctttacaccatttcgggttgaagcttgaaatttctgaatttcagttcgccgccttctgctgtaaacaaaattaagaatgtagacattttcctacaatgaaatccatttctactgatacatgatggaatgactattgtactggtgtttggaacccacattttccattcagtgttttggagtatttacaacgctgtggctttagcttgtggcttcaatccccagttatgctcgaatgcttggagtagctcttcaaatgtttatcaatgtgtcttccacaagacacaggtgtgggtgtcataagagagaggtgatccaaaggagagcaaaaatggaagtgagcgctgccatggatctggttcgccctgctgatccaagatgaaagggaattgaggaggatagggctccgttggcggaggttggcaatggagaaaaagagtgccggttgcattttggtatgggaaggagacgtagccggttgtgatgagagcaaaggtctcgctcatgaggtgagaagaggaggggataacgaagaaataagggagaggttttctatgcaaggtttgctttataatttctgtgctaaaacttttagtcagaagtcaaataaaaatatataagaatttgatggaaagtagaagagctgaattacaaaattatgtagggcctatctagagttatccaacattgtaagagttatatctctctacatgattttacctaagtagcgcgcctttttctcgtgagggctacaccacgaaaccactttaattgtaaatattgtatactcttcaatctcaaggcgtatggtccataggcaataaaaatatctacatcaacatccattgaacatattctatctccttgatccatatttctcatgttagtgttaatatactctatctcttttgcaagaagagttaatctatttaatattgtcacttcttttcctagcaatctagcagtgaatatcgtattcttctctttcttcccatgatataagcagggaatgtgaaaacgagctccaccagcaatgttgactcaagcttcgtaccagtaacaacaagccagaccatgaatatatcatctctagtggagtcacgacacgctctttctcaacgagatgtaggaatgaagatgttgctatgcttattgtctcccatgcctatgtcatccatacaacgttacttcacaaggacacatttatgtaatgattgtgacgtatatgttgattctacagttggaagagtggaaccaagctccgtatggtacctacttttttatattagcgtgtggtgttggtactagtgtgttcgttcctcctagtaaaattgacacactagatagatagggtaaggttaatttttatgactccgtcagcatacaagagtggtaccaactatatgaagcaatagttatgtcaatatctacaacaattaattttttttaaagaccataagatgagtccagttgggtcctaccgatgaattgcttcctacaatggtaaagcttaaagctctttttgactgtatgtatacaatgattaaagtatttactgttacaatatttaatgcttagggtttattttatcaatatatattgtggatacctttctgtaaagtctctttcaaaacatttaaattttacaatagtttataattggcttgttcgatgcaactgtttgagctgcattgcatagcccagtcgttcggctgcaacgatctggactattttgaatgcagtcagctgttttatgctggttgcagctcctacagccgttgttggttggctgttgtagccaccatagatgctgcagcagtactagaacagctagctctttcgaacaggccgaataattttataagacgtagattaacctttttatggtaataaaataatacaacaataatttattttccttgattttttttgtgtgtttgggaattgggatatgcaaatctgctcgtggcggactggcggttgccctcgcacatgtcgtggtagtagctgtggccgtggaaaggggaggcaaccgcacaagacgacacgaacgccaccacctgtccccatttcccccaacattccgtcccaatccaatccccccccaacatggccgactccgccgccgccgccgctgggccccaccaccaccaccgcctcccctcctcctcctccgcctcgccgccgccgccgcagccggaccccggcggcaagcgccagcgccgccccagcgtccgcctctccggctccatccccctcccctcccacctcccccaccctcgccgcattcccatcacccccgcctcccgctcccgcaaacccctccacctccaaccccaccaccccaagcccgagcacgaggaagacgacaacgaccacaacccctccaaccccgcctccgccgacgccgacgccgacgacctcgtcctcgccgccgccttcccccgcaagccgaggtccctggaggccgtgcagggagagagcgttgcggccgccgcggcggcggcggaggagaagaaagccgcggctaaagggaaggtggtggacgtggtcgagtggctgtgggggatcgggatgggaaggtacgcggcggcgttcgaggcgcacgaggtggacgggaaggtgctgccctgcctcaccatggacgacctccgcgacatgggcatcggcgccgtcggggcccgccgcaagctctactgcgccatccagaggctgccccctcctcccgctctgcctccgcctcccccgccgccgccacggaggtgaaaaccgttcttcctgtggtgttggtagtagcttagctcggccctaacttcgtcggaaacttaggatgcgtgggtgtcaccgtgccgaatagatttaggaggtgtaaaaagtgtaaaatagatggggaggaaggtttgatctgtgcttccctgtggaaatggtagtgttggcccaatgcccatggtagtgtcactagtgttgtgtacaaatgcaaagaggtgaaatggaaatgctaactgccctgttttaatgttgtcgaattctctccgtggagtggtagtatttgtgaatgtggaaagatgagatcgaaatggtaactgcaatgcttttgcaagtgtttggagatgcatcttaattggattaggtgaagtagccacatgctttgttattagtggaataacatgatgttgcttggtagtgtgacaaatatgtttagctgtgctgggtgtttatctaatgttttgttgtttgcgattgatcggattagctcctgcaactgcaataatcttgcatgttagtccatatcataatatgccctccaagtagattttgtcattttgctatgcagtttggttcctctcgtaggtgataaacacataaaaaatatgtacaaatgttacatgcaacattgtttctcacaagttgatttgtctttatggcagcaattactatagtgtgtagttgtgtactttcaggtttgctggttccaattttagattgaactagagtatgttgatgtgttttttctgggtaaaattgcttagtgcgctcagattcctcttggttttggaaagtactgttgtgaaggaggtcggtgcccatctgtcactatgcttaccagttcaagctttcttaatcattgaatggcagaagtcaagtttctgtcatattgagatgccaatgcctgaaatcatgtgactttggaatcgaacttacagatgttcagagacattttgaagtaagccacatttgtgcatgtctagttagttaaatattgaattcttcctcatttccttaacccttgttgataaggttttacgtccttgtccatggctcatgtagcgtagatagtaacagctcactggattgctttctttctggtcagtcattatctcatttttcttgcaagttttgctggttcgaaggtcacgttttacaatgctagtgttttgggcttttgggccttttctgtgttttttgctatttccagtaaggagatgccgtcccagttagagattcaaggctatatcctcccacattattgctgcatctgctttatatgcttctgttcttaacatgtcttaaattgttgatgacaaagaacaaatcttcaggactctcagtagttaatttgtttcttttcatgctgtaaatgaagccatatatgctctagtttttttttcacagcaagaacatgagaccagttgcttaagcaatttgagaggtgatccatctgccataaatgaaatcaaagtaattgaattctccagaacaaactcttgcatattcttagttcacttttttgaaatgttcaagtataaggaagaacttaaagcatgtcgttatgattttgaaaactcaagatctctatgctttagtacactcagcaacttcattgatccacctcaagtacattctgcacttttgggttaatcgccttcctgtgtaatgctctttaactcttatttggtattgattggtgtatctgatctttctttgcatgcttttcttgttatctggttttggctgactcgtgaatcataccatttggcttcaatggattattaacccattgtaaccatgtccttatccaaaacaacaagtattatcaacccagagggagtatttctagttcttcaatgtgtttcatagtgacaactagttctattcatgttaaatttacaacaaaatatcctgatgtcaaatgaaagaactaaaatcagtgtttctttactagtctttcattttgttcctagcatgttgtgccttctagcataacatcaggtatgagatcaagaagttctaaatcagttactgctgttaatcttctactaggaacttgaattcgcagccaataggaaaatggaagtttttactacatactttgacgtcaagattggctctcttccatctatgttaattaccaagtttttctgacccctcttattttgattatcacggactaattgtttttatgttgccagacagatgtcagggagccaagccaatgaaatgtaccttcccagtctttgtataagctgcagtttattcaggaaagcatcgtaatgtacagggctagagatagtgttcaacttcaatctagcggagtatacagactacagagcagaagggactgatagtctaaactaattatctcaatttgtagctagtattgccgtatggtccaaaatgtcttaggtttgcctggttgttgcatgaattaccacactcacattagccccagttatgctctctttttcgctttccgtagaagggtttatttaatggacaatttctttcacaccctggcctatatattggtcagtgtgcgcactaactagcaagttggtaccaattcacaccctcaacacatttgtccctcctcatgggctttaatgagatcatctaatctgggctgggatgtcacgtggatggatgcaagggtgtataggtgaaatggaaaatgatagagatggaagtttctgccaattctgtttcctagggtaatatggtgggaactttagatagcaccagttactcaggggacattatagggatgctcagaaggggatcctaaatgtctgtgctatatatggcaatatagaggcctgcttggctgtactttacaacgctatctgcggctgcgacacagccgtgccaaggagcagttggttgcgacgtaggggctgtaaagtgcagccagataggcgattttatgatgaatctcaagtgattctgggaccaaatatagcatacccttgtacaaaactgtaaaaataatggtatttctctaggttctcattttttttggttgggaatgggatcaatggcagcatcctggatggtatcaatattttgttagaagatattttcttgtacaagattgagggttgctccctgaaggccattcactgttcttagtcatttttgaaggcctacagaaaccaggactgtttgatgctcaatattccaatgtttgtttgaacgtgcagtctactttagatgcagtttgtgcaccatatgaaggtccaatcgaataacaacagataaaggcatgaatatttgatgaaacagaaatatttgcatgcagaaaagaaaaacattttctttgagatatgacatgtagaattttggatgggccttctcctgatatgatgaagggagctatgcacttcaactttctcttgacttgtgtaaagggggagtgcatgcaaatgttgatttatgaactattttactacttagatgtcgtcacatgcccctagcattatatagacattttaatatactattattaattcaattagcttctgacttatttattttgttcatggcactagttgtggcttatatgaaaagacagtggcaaaagtggattgatagtttaaccttatggggccaccttattttagtatgttaatgaatcatttgaagtcagttcaacgtgtgatgcttgaggaagttttctagtatattaatgggaacaccatattattactgaagggcatatcattgtgcctatattgtgctatacttgtgtaagtggattcaggtggtgggcttaaagtgctatgaaatcattagttcatcacagccccttataaaatcattttcttctctgagtacacatgaacatattctttctgggatactgggtgtgcactagtgtcagacccaccacttttatgttatcttaatttacctgggaagttctctttagtttttattatcatcataattgtgagtataataaccaagcaatcaacataaactagccatttcatccttcttttcagatctgaagttgcatagtatatacttgcataactgaattggctctgtcatttccttcactttcaagatggcacgagccatgcagatatgctgtcaaatcaatctgctttttggttctatgatattcttacggtattaatgtttttttattcctgtagtgaaagccacttggatggaagtatcttgctggtactaccaagttacttttagctggtactagccaatcaattaaaatttcatttttttatccgttatttcatccttttcttttcatcaactgtcggtgaggactatagcaggtgcttctcactagtattggtgctttgtcttctgttaaatgggacctacccccacctgcctcaactttgtcttactcattcctagcatgctacatcaaaggttcttaactatgtttactagagtcagtaagtaccatgtcatagtatatccttgcatcctctatcggtgagacctctgtattggagttgtgtctgctggctaacactactttatttcaaacgatgtttatgttccaacgtatgttggctgcaatttaatgctccatttacttgtttattggggaaaaaaaccttattacccccaaaatataagcacttaaccccttaaatattttttgattcattctaccctttgaatttctaaaaaagactcactttgctccctgatagatttttttaaaaaaaaaattatccttacagaaaatatgttttaattgaaaattttgattgtgccatatataataaacctgtaaaaagataaacagaaaaaaaaaagagaaatatcattagagggtagagtgagtccattttagtagtttatgggtagagtaaaccgaaaaatagtttgcaaggctaaatattcaggcaaaatattttaagggagtaattggggttcttccttatttattagaaaaggtttaattttgcgggtctccatccattaattaactttttcattgttacattttgtttattatattttgacctatctgtagctgtcatagatactctgatctatgcttggttatgcacttatgcttgcttgtattcctctcgtttgtatcttgacttgtgagtaatcgtttgcacttccttgtctttgatgctgacttcgtactgcccatttgcactctctttcattgatcctgacatgctacctgaacactaggatgctgcttcatggcacttccattgtgctacattgcgacatcattaggtcatcgtctgcatttctttttaaatcttttgtaccaaaagtttctttctgttacagatacaaaaagtcctgagcattgtagtaaggctgggtcttatacctttcttttctcccttctcaggtgcaaaaattctatcaacagattaataaatgaacatatgagattctggacttgctgcacttccatatatttggaaaaaggtaagaggaattgcatacggaagcaatgtgattgtaacaaaaataatatattggagttaaataaatatgaaagaattatttctcagggtttttgaagtacacttacatttgggtgttacctataatctagtatccttgggtgtaatgctattctttctcattgaattgtgtggtgaggattagatgttaggggagggaaaaaaaggggggagggggggatcagtgcctgcgtgggctgtgaaaactaattacaatgtgaaaatttgctgtgtctgtctgtcggtgtcctgttctctccaggtgctagctcctgccgtaattcaacgtcatgacctggttcgtgctcagcgagccgggggccggcaaaaccgctgcagcctctgccggcggggtgcgccagatggtgtcgcggacgtgttgcagtgtcatctccggaggaaggcgctgccctcgacaggtaatctctaactgcacataaatccacatatatatcaatgcacttgtactgtgaactctgttgccactgctaccactcttgactgtacaaccagtaataacatattatcaagaaaaagactgaaatgtgtactctgctaaatttctagtttgaaatagttttttgtttttccatgtcaagggaaaataaatgttgatggttcttggtgatatgggctatcaaatttttcattgaatgaattactggcaatgattattgaaataatttcacagctcaatatatgcgcagtttggaacaagtaattcactgttatatcatggtttgttccgctcagacatcagagcaataggaaaagtaagagcctaatttttatatgtatacatataatttgggaaccaggaatattttggcaacttatttccttcaagtttttcaaacatctcaatgtggacgatatcctttactgattcatggatatagccattagccagacagagagtcaagggcagaggagagggaaaagaggaaaaaaaatataggagctaatgagtggggcacacttgtattaagcttagtttgttttattcttagactatatatataatgtcttcgttttaccgttaatttaatagttttgtgtaaactattttgttggtgccgttcaatgcatctggacccagagcaatacagggttgattatccgaatccagtaaggaatccttcaggtcctgaattcctaacactccagttaattcattttattatactaataacaaagttcacacacgcaatgcacgaaagggcttctttgtttactttgaggttggaggattgaaaaggcccaaaagggaagtgcaaatatataacgcagaaatcaagagatgggttagtagtagtgcccaggaagggcactgtcgatctcgattgagatctttgttaggaggccggaacccatccacctaatcctagctgtttatactacaatatctttggcaaatgatgctgccttgtcgcctagtagacgtgtctcttacaaaagggcatgtagcctagtggttacagtgacctgagtggtaccctaaggtcctgagttcaaatcttctatggagcgaattttagattggttgtttctagggctaagttccctatttcaattgccgtatgtatccggttggatgtagaggccgggtaaaaaaaatacccttatctaaaaaaaataataaaaaaaagacgtgtcactcgccctgaaactggtttcaagctttcaatcaaacgttttaggagggaaccagtaaagatggcttagctgcacgcttaggagccatgaatttcacacaattcttgtgcctttctaaggccactttaattcttatgttaatacagtgaaggtgcccccaatttctagaagttattttacgattcttgaagagatcaataaacacacgcataataatcatcttacaaaaatactttggcgactaaaaaatatagtttaatttacaatgggagtatttcacagcaatgtattccgttttatttttagaacacttcaaataacaattaatttgctacaattatatatatgtagcctctcttaccttttcgaattgaattaggtaaagtgcattgcagcagtaccacacctacatgcacgtatatataaagtcatcgagagtgatcaccaggtataagaacgttagggcaccattcaaggtggaaccaataatagatactagtactatatatctcatcagctataataatgatgatgagctaaactaataaagtgaggttaatacacaattataaatgcatgcagagttggcatgcatgcagaaaggtatttgtagtggtggaccaatacatgtatatgtacatttaaacatgctatggttaaatggaagccgccacgcactaattaaaatcgttcatgatcgatcccaactcaactactggccttgtatattttacagacatacttttcagacatgcatgttcaatggcatggaatcaaagattttgaaagtttaccctccttgttaatcaattcaacgaacatgtaaaaaaaactatatctttagaggactgttctcacaattatatactgaattatacacacttttagtgtaaagccttcagatagctgaattgatatgtttgttttttttataaaaaaaaactgaaattatgcttgctaatatatataccacgaaaaaactaatcgctcttgggggaaaaaaaggaaaattgtagatgagctcgctacgtacaggattgtttagttactttaatttaaggccgataacatgacttcgaaacgagaaaatgaagtaggattctacagaaaagagatacatgaacgcgcacattatatgattaacgctatgtccgtttttaaatataaggatttttatagtttatttggagagattaagaatgaagggaagaaaacagtatatgatgccccgctatattaaaataaactcaatctattgtgtacaaattaagcttcagaaaaaaaaaatttggctagtttatgagacaacaatagtacatactccctctgtttcataatataaaactttctagtattgtccacattcatataaatgttaataaatctagacacacatatatattatattcattaaaatctatatgaatttaggcaacgctagaaagtattacgtattacttcctccgtttcataatgtaagttattctaacattttccacattcatattgatgttaacgaatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtaattttgtgcattagataccatggtgcccgggcaccatggtgccccatatgagtgtcctatatatatatatatatatgtgtgtgtgtgtgtgtgtggattcattaacatcaatatgaatgtggaaaatgctaaaaatgacttacattgtgaaacggagtaaggacattgcaaaacggaggaagtaaaacatacggttaatagttagggaccctaaaaaggtatattagggttagttaattatacagtcatatttggaaagggtgcttgtgagataatttgcaagcaatggggcaactaaagaattgagtggcactagaagctggccggtttgtgtgatgttctagctagcggctaacagcgtgcagggtgcacacaacctgtaattaagatattcaagtcctagacatatttatgcatgcttagaaagcaattgtgtatttgcaattttgcactcacatatatagctagatatttgatgtctccaataattttaattgcgtgagtgtgatgtatatcgagctagtacatgcatcatatattctcttaattaagagaagatatttaaaaaatagttaaagaattcctgacatttaattcataagaagctatataactaattattaattacaccatttacagctcataggactgtcaataaaaactcgcaaaatgacaagaaaccaaaaggcactacagattaattaagaaaataattagatgcatataaacttcattttactccaaaatatccaatagtataaatccttataaattacaggtgttaattagtactttttctaaacacaattgttagttgttcaatcatctctctatatatatatatctagcaagctaatacaatacccctacatatactccctccatactcataaaggaagtcgtttaggacaatgtttaagtcaaatcttaggaatatacatcattaataactcttaagtcgatgagtttgaaaatgtaaaaattatatgtatagatttgtcttgaaaatactttcataatagtatacatatatcacttttcaataaatatttttataaaaataagaagtcaaagttatgttttggagaccatgtcgctgtcctaaacgacttcctttataagtatggaggtagtaccagctaattgaattaattgattaatttcctacagggtcgctgccccatgcacagtgtcaccaatgagggaggctgctgtgtcggtggggaatatacaagtactacaacgatctctcatcccatcatttcgctccctacgtaattaaggcagaatgcgacacagcgacgctacttcttcgctaacacactcttaggcgatcgtatagtatcaaaataatactaatatatagggaccatatataattagttgtatatatatggtactaatttcttcgtcaagctataatatagctggctgcgattggtgaacagcgaatcgcggcgtactgtagcatgatgtgtgaggaggaccagctagctagctatatatagctagcacgtccaaggatatgtcaaatttgatggcaaataaatgatgatcacaaattatttgaaacgtagaaaaaaatgcataatattctgattccctaattaattaactgaaattgagttggttccatacgatactatgttatttttactaaacagtactaaataattaaagtaatacgacaagaaagaaaaaatgatccttaattttggaaattcataagacatttcaattttacagtaaaactaaaaataatcatgccacgagctagtcatatatagacaagaggcagccaagtaacatgcaagtatttataattaacaagggcagttagagaatactatcttttttttttattttccctcacttttaagcagcaggtattccatatacgtacgtacaagatacttaagataattttgaaacaaaataattaatacacaaattttgttatagagcattacagacacaatattttcagggaattagtgaaccctatatgtaacaattatatatattgtactccctccgtaaaaaaaaaaccaacctaggacttcgatgggacacaatttagtacaatgaatatggacagatcctaggttggggttttttttggacggagggagtagaggtttaattattgtagtcaatggcctgtactttgtggggcctttggatcttttatagtgaggaataaaatggtgggggaatttaataaggtaaaataccttaatctggcaacccattagcaggaatagcatgaacatccttgatactactaatattctctgtgaaaacccttattagttaatcaagtttgtaatgtgctcatctttggaatgtaggaatatttcacatganattttcaggaatacaacaaaatttggttcatttggaaacttgtgtcaacatgtttcaaaaaatcatgttgggctactacgtggatcgcttttgcatatacgcccacatcgagcttgagaagtcaatagatttgcgagcttataatttgtccaaggcttgacctttgtttaaatattattcagaagtcgagattttttttttgacagccctatagctaacanaaacactcagtagaatanaatgtcatggtggttggtatacttggtaaccattcatcacctgtcgattgctactgctgaggctttcgagcatggagaattcagtgtacgatcgacgaccaagtgtttttcaaactcaaagatcgacctaacctagctggatcaaggacaagttggtgaattagacgttaattagttgctctcaaatatatatggtcgatcgagatagtcacaataaattaaggacctcgatcccattggctacaccccgtttaccctatctagctacatctttaattgctactatgtactattctcctatacggttttaaaatggattgttttcaataatttttcagttgaattctcaaataaatgtattaattatgcaccaaattggattttttttacttgtagaaatccaattaggtctaatggaccaacaatttcctgacatgtcaaattaagtttgctgctctccgtcgtaaagaatccatttctggctatgcacctgatcgaacaattacttcgtctaagtgcatagctacaaatatggtcttttaatttagggactgagcagatatacgtacacatttctttacttaggtacctttaaattaagttaatccaaaatcaaaatcctcgtttaaattttgtgactacccatgggcgttggtgattagctagacatgcaagtaatagctcggagggagaaacatatatccatgaacatataacaattatattagtatatgctagtgcctgtgatagggacttctcatgctctagctaggactaactaattaaacagtgtttaaaaaatacctgttcaaattcgaaagaacaatatcaaacggctagctaggctagcttgcaaataatgcatctattttttgaaataattaaagggacatgcatgtgtcataaattaaccctttttccttaattgtgatctcgttcgatcttaattatttgtgcttaatttgtcgtatgtgtttgtgcgttttatattctttgaagtcaaaacaccttgaattaactaatatttaatcatctcgaccgggggagaaaactatatttagtggttactccttacatctagctaggtactgtacgagacttcctaatattatagtactagattaattaattaattgagaataagagaacatgtactccctccatactcgaaaggaaatcgtttagaacagcgacacggtcttcaaaacacaactttgacttcttatttctataaaaatatttattgaaaagtgatataggtatacttttatgaaagtatttttcaagataaatctatacgtataatttttatatttctaaactcaacaacttaagagttatttatgatttatattctcaaggtttgacttaaatattatcctaaacgacttcctttataagtatggagggagtatgatctggtgatgatcgatcatgcacgtactcgatcagtaagtaattaatcccactacaataatggagtagccaccaccgaatttcgggcattttgttcatctctttaaaggtgtgtttagttccaaagtttttttttcaaacattcaacttttcatcacatcaaacctttcatacacacaacatttcagttacatcgtcttcaatttcaaccaaattttaaactttgggccaatctaagggggtg

SEQ ID NO: 16474 - DNA, 24611 bp, Oryza sativa
tctaaacacagcctaaaagtaagctagcttagctaggctgtactaccacgcacgcgtgcatgcacgattccaaaagcgttagttaacgtgtcatcaacccgtaaaaaaaggaacatatagctatagattaatgatagtaacaattaattaatatatataactggtactactgttaattagtacactggtactactgttaatagtactattagttagttgaccctacaaacacaaactatatatgtaccggccccatgatgattaattgtcagcgtgtgttaattaatctggcaagagcatgatataaagaattaccactgtaattgccttagcttaagtaccattatatatttttttttcaacagacatgcatggcgataactacgacatgcatcgtcatcgccatggcacgttgcacaacttgcttgcttgcatgcataaactatagctattgcatatgcaacgatggagagaggtaatatgcactgcttagagcaagttcaatagtatagccaactactatctccaaatcatttatagccactgtaatagtcaattcgtacaatagtcgcttactatacttttaatatctggtcctacctgtcatacatacattacgtcttggagtccatgctgcagctggctacaaatctgtagcccgctgctcttctctctctttctttatctttttaaaatatatttatagctggcttatagcctgctattgtacctgctcttattgctgctgctgctgtttttttttctaaggagggttaatttattttactcggtcggtctttacatccaaccggatatatagagcaggatttggcgctgctgctggtgtgtatatattgtgcgttaggtctgacgtccattcacccgtgaaagctccaacatatatggctgctcatgacttacgtacgcgggcgtcacgcagctcgatcgatctgtccctcgactcacgcacgcgtgcgcgcactcacttaattttaatctggttttatttagtttggtatagattcaggtctcaaatctacgttgggtttgaagtttgcaagtggtttcaaaaattatgtttcatctggaataggaacaaaatgattcatacctaaattatcaatgtaatcatatatccagatctagaattactcagctaaaaataaaatcttggatctagatatgtgccacataagccttaatttccatatatttatatacctatactccctttaaaacttatctagcatttggtgcttaattactattagtgtatataaatactgtacttggatatattgggattttttttgaaaactatattttgttagtaacatagtttttagagaaaatatatcatgaacaatttctatattacacaaggtggtcaaagtggcttatcgaaaacttgacattttgttgctagaaaaatcccttggcaataatggtctcccggctggttgcaatgtgtaattgaacctcccttcttttaatatattgacgtgtaatactttttgtgctttcgaaaaagaaaatgtatgttctaatcaggagaacgttaggctctagtcgtgatcgatctgggcagtggcatggtacgtagggagctagtgcagtgatagttgacagctcgaagtggctaataaagctaggacgtccacttcgtagtgtgtggcctgttgtgtgtggcttactggtttaacttacaacagcgtaccaacgtttgaccttgattacgccaagtgatcactaggtttgtgtcaagttaattcacaattattggatattccttcgatcgtcaaccgtgtattcaagatgaaattatcgatctcaataaaaacgtatgcatgaccttgtcttttcacttttcctcttgctgtttggggcccgatttcctcctagttagcccagtgtgttgtagttgtaaaaatcttttctttcgctaatatattaacgtgtaaaacttttacgtgtttgtacaagaaataatataatcttacttttcttttgcgaggacagttaaacttaatttacagctgataggttatacaccttcagtaaaataatatgattatataaaaaaaccataaacatagttattttagtttctggaataaataattatccgtttaatttttatgtcccacataatacgaatctttttatgtaaaattatgaactaatatatcctatttgtttttttgctaaaattttgtaagtttcatatttcataaaaaataataaactaaaggttttcgatggcaggtaattaagtttattgagtgcatgtgcttagaccaaagaaaatcaagttttgggtacaattacataaaattaaattggagatgaagggccttgagcttattgaggtgttgaataaagttataagcaaccttccaattttaatatacgccttgaacttttagattagggtcgaaatgtttttaataccgataactcacttaaagcgtacgtgatgagctagcggtattattaacatggctaattgcaccttttacaatgtctatcaatatataatataaatcatccaacgtcttcttttataattacacgaaagacgcatacatacaccgcccctagcacacatatcctccaatgtcccttaattttccatactttgctttctttgtagtttgaattttcctcctcttaaatattagagtacaccatctcattaactcgttaagttttgagaaaaaaaaaagagatatatactaccttcgtttttagtagatgacactgtagacttttaggcacacgtttgaccattcgttttattcaaaattttacgtaattacaatttattttattgtaagttgttttattactaaaagtactttaagtataatttatatcctatgcttttgcataaattttttttaataaaacaaatggtcaaacatgtattcaaaagtcaacggtgttatctattaaaaacggagggagtatatatgaatgtgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcacttgaagcatgtgtggtggagagaagaggggaaacacacgcgcgcgctcgctcgcctcgcctcgcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagattgtgcgggcgccctgatcaagcgacctttctctatataaaccgacctgccgtcttcacgcaacacaagcgaaatcaatctagggtttgcctcctactctgtactgcgccgtcgctcgtagactactccatccctctcgccggcgtgcaccggcgatcgggagagcaggtctccggaacctctgccttcgacgtcctgcaccaggagaaggcagcaataaggtttttgggaagcgcttcgcgcgactgctccctgtttgttcacgacggctcgccttcctcttcgctcgcgtgtttcgtgccttcgtagacacctgcgaaaagtttcgaccaagcagccggtctttccgtcacctcggtacgtgttcaatatgatgcgcatatttgatctgttcatgttatactgtgtagtttacatgtatagatctaatgatgcgttcttgctagttttcatctgtaatgtcatgatttatttatggaatagattaaatcattatatgtctataatctcaacagaatgcgtgcttgttaactcgctacaaaaatgcctaagcttgtgtaaatgaatgtacagaatatgaataatccttcaaaagccaagggcagtgtgtctaactaaaggaaaacaggaaagaaggaaaggagacaagaaaaaaaaagatgagagatggcaaagatgaatgggccacctactagaagatgtccaaacataaaacaaagggtctctgtacatgcatggctcaactaccactctagatagatcaatatatgcatagagcattttgaaagtgtgtgtgattaattagcaacgcaggataacgactgaacaataaaacaatcaatacaatttagtagaaagtagtattttgacatttttatgatacatttttaatgtgtaagcatgcacagctaaaacaaaacaaaaatgacgtgtccctttcatgaaaaataatgatgttttgtgtagcctttattctagaggctaactagatagctagggaggagtgctgttaataaatcagaaaaaaatacgttattatattgaaaagatcgttacagaattcatttccttattatcccaagttccatatatcagcttagccaaaacctgaatttaatgcacaagggtatattggtagttaaggtgaacgcaagttaagaaatcaatgaggaagacctatcagggaaattttgacaagtttattttgaatctagataaaagtcgatatagctttaccggtggggactcagttttgtaaatactctaataaaaaaatcgaaaggttgattttattggaaaagtctatatatttaactcttatgtactatgactacgtgtcacatcttttgattccgctgtaaccgatagtatcttgtatgagagacctgttataagtacgtacatctagattttctataatttctatctagttaattaaattgaccggttaagatattgtttttaagagttctgtaagaaaattttagtatgtagcagtgctcgattttattttatgtacaattttttcggtgcaccacatgacagcctttatattgcaactgttattcatggttttcttccggtggtgatcacagatatatctgtaagttcttttttgtcatccactcattttgaagtttgtgtcagaaaagatccagctgttggaattgatgtataaaattttcaattaataggaataagcatataggtctactacaacatatttattaagattacaataagcatgtagtacgtgtgtggccagtgtgtattttgggctccacgactaaaagatgtactatgaattgatctgtgtgcgaaagaaaaaaaagtatatagcatttataattgtgtttaaatatttaataaattaatagatttcaggatttcagaagtattattgcactacatcctttttttgtcctatacactaattaaaaaacgcaattaatgtctgtacaataaaaggtgtatgtatcaagaagaaaaaggtagtagtacaatgtagggttaaggaatcattaactctatttggatttggaatcagatagcacttgctgtaaagattcgtcaagcgctatcataatggcccaattgaactatatttatataacttactgtagacaagtgagttaatttacacaaaatactcctatatataatggtttgtacgtcttgctattaattatccaattttaaatacttggccgagtactcgtaaagtcaagtcgacttatcattttattttctttttcaggagagtttcttgtgctatatattcaattttgtccatagtacaattgaaaaggtagttagttttctgttccagcaaaatacttcttttttttttgcgatcgaatcccatgtcttgtaagttgtatacgacatttaattagtttttgtccttttgcaattggcatccagttgttgtttttgttggagtgatatgcgtaggctgctttgcagtgtgttcgatccatccatctatctctcatgcagcaaccacccatttgcatatgcagcaccgacaatatttgatctactccagtatgcagtgaatagttttgcagcctttcagcacatgatttttaaactggcaggtctctctttttgaccaagtactgagtactatgttctatatgtacacacctaactggatacatcaattttggaaaaacatgtaaaatgcttatatatattttttggaatggagttagtatatgcgagaaacaatatatctatatgcccggttctttttcttaactctaaactttaactttgtcttttttattaacatgcttttcaaactattatatggtgcgtttttgacaaaaaagtttctatgtagaagtagttttaaaaatcaaataaatctatttttaattttataatagttaatacttaattaatcacgtgctaatgagttttctcgtttcacgtgcgcagaaaatatctctcaacggggcataagtgtacatatccgtgtttataaaaaaaatctatatatttaatgggatgggattttcatttaccactgaataaaattatttcttaatattaggaagttgctgtgctaattatatatatagggaatttctatactaactaatagaaaaaaaaagtgctttcatgcgcatgagatcgatgtcggtactgttatagtagcatgtatgcatggctagctacaacatttgttttagaaaattcaccactaactatatagcaaaaaacaaaaataaatatgaacatatatagatgagatgagatgagatcagatcaatgttgctacagtttgtgcatctagcttagattgaaatcaggtccaccacacggccggcttgtcgcaacaaggatgcagaggccattatgatgatcagatctcttgatatctctggcagatatacatttgtgcaatgttggcaattagctacaagctagcaagctagtagtaccatctatcaaagcttctcagtcagctagcttattgggaaggcatatatatgccacaaacaaaagcatacattgtggtatataggatggtgcatgactttcattgcattaggtgagacttggccttttttggggacagtaatatcttcaagtaaactcaatacccctcacacacttcccatcggtttctcgcaaattatatatataggtaccacgcgtgctcttgtccctattccgaataaattgtaggtgtgtcttattttacataggttattttttttaaagagaagataattttaacttaattttatgcaattacatgagtttaaatctgatctaaattttgaacttgggaaatttataggctattttcaccgaatcaggtcagtaaaaatgtattatgcttttcattggtacccctagccggccagcaggatgaggggacatgactatagatatatacatatttggcaattctttggtaagttcatttgaggcaaaacaactgtggaaatgttttcaacttgccatcatgtatgggcaatacatatatatgctgaaccttttttggtgcctttccccaacacagaagctcccaaccaccatatatataaccttaagactgtaaaacagtcaaaatatggtagagacacaagtccatgcccaagacacaactaattaagtaagtgaggtcactaattaattaagtaatggaaactaattaagaaatggaaccttaagcagcaacaaaatcacagagagagagagagagagagagagagagagagacccttaatcatggggggtcacccatgatgtaacacttggacggacacccttcacctacaccaatttgtcacaacaacaacaacaaagacctattggaatcccgacatccaaactactgtccgtagctctaaagctcctttcacctaccaatatttttgcgctctctctgcagcgattataattgatcatctacttaagctagcaacaagctccaaggtaattaattaatataaaacacgccacgaaattttccagatgcatgcactataactatagattagctagctctaggcatgcagtgtaattaagtggctgttgacaataggttagtacaagtagcaaaaccacccttctggcctgcccttatttgtggatgccacttgtcctagaaacttgttctctctagtccatgcacttttctcagttgagttaatattgttgcactacttttcctcttgtttttttttctaaaaaaattactgtatctatctgtatatgctgataccaggaagatatatttatgtatatatatacaggggataatatttaatattatgtgtatataatgtatttctcaccgcaaaacaaattgatgtgcttctccccacaaaacaaaataatgtatttcccccacacaaaaaccaaattaatgtacttccattatggaacttggcagcgacagtctctcacaagaacatgatgatgcatattattttagccgtgtcgggcccgatcgataccacgaaatttttgtatattgcatatatacttttgcatatagctgtagcaactgaaaaacttaatttatatgtgttaatattttcttagaatcttgttaatcctttttatagctcagtggttaaaattgtttgtttctaccaagagccatgaggcccccatgaggccatgacccacagtggggactactaaactaacaaagctaataactctagttaagaaactctcaaaaccgcgacgaatcaaaaacagtaaaccaacggacattgttccacactcattcaaagaaaacaaacatgaaaaaaaaacataaagacaaggcaaaggagtgcaaaaataaaataaaataaaataagcaaggagctaggtatgcatgacatacctgtgaatcatcctcaagactcagcttgttaaccaggtacctcatcactactctaactgtcatcctcccatctctgttaatttggccacaccatgcacacacaacatgtgcgcacacatgcatgcacacacaaacaccccccaagtcaatgtggcatcatcaaaaacatatacaaatatccatcaccaacaagaccaaaaactataaaatcaatcaattaaaactaatttaattacccaagaagttgatcaacaaattaacaagaagatcattagcttttctactgctccctccgtctcaaaatataagcatttttagctatcaatccggacagccaaaagttgttatattttgggatggaggtagtagctactagagaagtagagatgcatgagaaaaattactaacctaaccctcaagaaactccggggaatctgcggcaatggcggctccctcctcctgcaaacatggatcaacggcaaccgcatgaactaaccacccacattgtctctaaaccattcatgaagatcatcgtcgtcggccatggtgtactcactggttctgcgccgcccggagcacgaaccacgtgccggcctcgtgcgccggcggcggcggcgccgccgccaccaccgcccccaccgccgacgccgacgacgaaggccctgggcctgggtggagcaccgacagccgcagctccggtagctgcggatcggccgccgacgttgatgggcctgcggccgcctcatggtgggcgtcggttcttggccgtttccggcgagacgacgacggcgagcccggcgccgacgggccgagcccgagctgcagcgacaggccggcggcgtcggtgccgccgccaccgctgctgctacttgtgctgggctcctggtgggcgacgtcgtcgcgaggcggcggcgccgtgattagctcgggttgctgctgctgcggctgctcctgcggcggcggcggcggaggggcggcggcggtgtccttgctctggcggtgggggtgcgaggggtcctgtgccatggacctcaggaaacaccacgacgacggcggcgatggcggcggcggcggcggcgggtgttggctgctatcgcttcttcttcttcctcttctcgtatcgaagacggtgagctggaggcggcgaacgtcgacggcggccggcccatgggcgtggcggtgcggccggagcaacgtcaccatcctctcatgcctcctcccctcttgtggcgttgcgccgcgccgcggccgacaccacgatgggatgggaggagatcgatcgatcgacgagaggaggaagaagaagaaaaggagaagaatgttcaaaggagaagagtggctttcatatataggtagacaagctcatttaatgcacacactaatcactttttctaatctctctcactctcagtaattaagtggtaatagggtttagagagagaagctggtaagacgtcaacggcgattgcacagtgcccaactttgatccgtggatggaagtgaatggatggatggatgtactacaagacaggaataatttatgggaaaaggggcataatattgtgctgaggtcatcacatgccatgcactatagtgccatttgtgctgtgcccccctctgatcatgactactagctagctagtttatggttaccaacacattctagctatgtgcacatctactggcttgtgtggtttttaatgtatattatcagccacttaattgctcagtaacaccataaagatcaaatatccatgtgagctagaaataaatatatatatataacattgatgtgtgacttcctttattaaaaagaaaacattgatgtgtataaatccggtactccctccggtttcatatttccttagacgtaatcttatttacggaataattcattaaagtacctttgaactcaccttttcttacattggaaataaaaaaatagaatcaacaggaaatataaaaccggaggaagtaaaataaaaacagtgtttttcatccaaccctcgatttgcatcataattttgccactgatatctacatcgacagaaaatatagaaccggatgaagtatacttttcaaaaattttcatatttgtagtgcaactcatctagaacacgagctagaagtcaacacaaatggttcgcggccgtctgcgaaataacacgacatatcacggacgattctgttgctacaaacttcagttattgttactctaatagtggtgctctgctgatggtgggggcacacatggatgagacagtgcttactgctcagggatgatgcatgacgaaatgagttgaccctagataataaacacatagatctagctagctaatatagcaattaattgtagtaaattaattactccctctgattcaaaatacaaggcacaactagatgtttcataatataaggcgtgcatgcatatatgacagtaattaactatgaccttctctctactaaattattgtattttaaatcccccacccttaaaatctctaattatattggatacatggattctatttatcggagtgatccaaacgaggtgatgataataaatatttcttaatctttgagttacgggtggttatgtcttatattttgaaatagaggaaatataagtactataagctaattgaatcaaaaccgtctgcattaattatctctttatttaaaactataagaacaatagacctacaagaaagaacaaaaaggatctaagctacctcttctctcttctccaactaaaataacaaaagaagtggatctaaaccatgcatctccctctcttttctactaaagtaaaatatactccctccatttctttcacttgtatataaaggacatatatagtcatagtccccgattaatgattatatttttttttatttttataataatatatttataaaactataaaaatagaattgcatgaaattattttttaatgaaactaataatatcatatttcacacatcaatatcttaatattttttaaaaatattattagcgagtcaagattttgaggtttaataattaaaaaaaaatacaacctcgctaagatgtaatcttcaaaaataaagtaggccctccaccaaatctcctaaccttagatctacaaaagaatatatggaccaaattaatctcctagctatctgcaagcctgagcttaagcagctcaaaacagctctaacagacaaatcagtggtaggccgggctcctggtctcgagttgtgtaataatgcaagacagttttttttttttttgcttagatctgcatgtgaatcattgctcacagatttgccaaagaaaccatgaataggagtatatattactggtgacgtttagtgcaatatatatatggtaatcgctccatgcctttctcagttgatttcgtagagagaaattatcactgcagagagccacatctgtttatttttagtactcacatttgttcatgtacatccacttctgtccctttgactttccatgtagaagacagaaaataaattataaaaatcaattataaaaaagctgtaaaagaagttcatcggctcagtatagaaaaccatttcctaaaaaacttttaacggtgaaagagatcttttcttcttagaaaccaacttgaatttccctcgcaaaaaaaaaaagaaaccaacttgaattctaggaattacaaaagaaatgttaaaataattagaaatttaaactcaaaaactcaaaaatttaaaatatataaaaatgcaaaaatgttgaatcaacattcaaactcataaataatcacagagaaatgacaaaagaaaactcagtgcggtgaggccaacgagcttatagctatgttgggtcatcaccatcttcaccttgcacttctagggctgaaaacaggacggattcagatgaatacagtttatatcacctcatatcccatattttctaagcggatttagagtgggtgcaccaggtgtgtggatacgggtgtagagcagattgtttcggatgtcatgactggtatggagtcggtgtagaggcacggaaactaattaaaattgttggatgttacatgtatatgcaatcaatacaacatcaaactagcaaaggcagaagcgggaaccaggaggggcgtcgctttgccactaccgtgtgaggtgtcatcttttgctgtgttgtcacaaggtggaggcatgagtcatcgacatgtggatgtttcaactggaggcgcgggatgaatatcaacgcgcatcacttgccactcgcctagtgggtgcagtaaaagcatatcgtcttagcttccatctaccgtcggctgtgggtgtcaacggtgtcgtaagacgaacgggtgagaaattattgaaggaagttgagatggtgagatgagagctaggtttaggggcagagccatattaattggaggcacacctagggatcagttgtattatttttaccctaattctctataaattcaaaaaatttatgcaatttatttggaaattacatggaatcattgtcctaagcctagggcttgagccctagctgccctatgcctagatcctccgcttgctagattaattgatggattaattgggccattcagtttattaatgggctgaggaagtcgaattatccgtcaaacagttcaacggataatctaatcaaaatattggataatgcgcatccagtgtatttttgcaatatatatgccacatccaaacccaatacgcaccatatatactactcctatctgatatgttttcatccctctttttttttatgcatttgagggggaggaagggagggtcgattggagaggataggaggaaaaagaaaaggattgacggctgagattgtcttttaattaatcgaacggctcgggggataggcttcaattcgtgcaacgaaatcgtcctcgaggtttctgttaattgcgcacttatgcttagtttctccttaattttaattgatttgtctcatgtgttttgtttgcttgtgactgcatggatggaacacacgagctgtaattaaccaagttaatgatcaattatcgatcgatgggcctgtgcatcgcattgtacgttcgtacgttgcacctatattgattttgtagttaattatgtgagtgcattgcatatggttattggcattgcttataaaccatatatactgtgggatgaaacacaagtttggaaggtgattggctgctttcgcaacgtcgtagtacgcttcgttttgtcacatcagatgggagtacgtacggtgtgcgtgcgatggtgcccaattaactgggatccacgctatatatatatatatattccttccttcagggtcctcttccttacctgaccatacttttcctttttcgtgccatatatgcgtgcagtatctattcacgtggtatgaaaaatcggacgggataaatccacagggccaacaataattgttggtatatacttcatatcatgaatacatgattgtttttagtgactcggatccactactacagaaacgatttttgcatgtggctatttataaatttcgcaggcgaaataaagatttttgcatggcacccgcaagcgaaaattgttttcttagacaggcatgctaaagccgccctgctctataattatggcaaaacaaataaaaattccaaaaaaactgcaaaaccctagcccgcatttagccactgccacacaacatccccgaaacactagcccgcatcctgaggtcacccacgacacgatgaaggaggacctgaggcgtgctaaggaggatccgctcattgccgccggccgcttccaagtccggcgtcgccggatctgtccttgtgttgttgtcgtcgttgtcgttgccctagccatcgccatcgttgtcttcattgtcttcgttgtcgctaaggccggtggaggtggattcgccgctcccgagtttggcgctactggatctggcctcacgcagcttgccaccgtcatcgtcgttgtcctagctattgccgtcattgtcatcataatcgtcattgtagccgatgccagtggagatggatctgccgctcccaagtctggcaccgctggatccacccatcccgggcccgagggcggcagatctgctgccgcgtggctttgtcgcagccataaccaccgttgtcacggccacggtggaggaaagggagggggaggggatggccgttggaggaggggtaaggagagaagaagagaacagagtggggttgggggggagggaggagaggagatattttaagagagcagagaataaaagagggggaggggatggggcagctgactggatgctagaaaaaaatcatcactaccctaccaagtcaaatagcaaacatcttatgaaacccgaagcatcaagtagagagcataggagatattgctggggctcagcatgccagtcaacttcagcctgagacatgcccgacaaaccactcgaagatggcgaccagatgtgttatacatctcaggagacttgaccaaatcgctggagctctacaacatctcaaatgctctaaactcatactcatgtgaaactagttcctaggacaagcactagcttcacattttcatctaagcaatgataaacagaaataggacataaatagaaaataaaactcagattactactagatatatttacctaggccatccggcctaatatataataatatgtggaagcttgtatacccgttcccacaagcagccgacgggcctcttcacaaatctacctgcgaaaattgattttcgcacgcgatccttgaatcgtcctaggggagaaatttttgtatacgaagatagttatagtccgcctgcaacctagaggtagggatgaaaacggagcggatagtttccatctgctccagacaaaaacggatacaaatacctttcggatcggatatataattctcggatagttcggatacagatacgaataaagatattttctaccggatacggatacagatatggtattgggatttccgtcggatacggataataattcggatatccggtgaacagtgctatttggatatccgtaaaagccatgagacatatcgcatttctttctaactctataaccttcaaaatacctttatagattttaatagtagtttatctcttaacactagtccatactattaatattatttaaattttaaaaaatatttataaattatactttattttatataaaatgagctaattatatatgttgatatttgtttctattagaagttgagttggttttcgtgttccgagaaaaaaatattttcgtattcgtgtccgatcatattcgattcttattcgtattcaagataatccgtatttgtttccgtattcgttttcatatccgataaaaaatataaaaacgaatatggtatgagcattatccgttcgtatccgctccgttttcacccctacctagtgggagttttgactggaaaatcgattctataaaacaaataaatttttattaggatacacttatgaaacataataaatttttaatatcaaagtagttttaagacaaatatatgcatagcattttttaaaaattttccaactaaatatttttgaaatttagtgatgaccaaaatttcacaatcttatgctgctacctttcttttcaatttttgttctctatgttttgtaaggttccacctatgataaaaattccatccttttgtcatgtcagaaattttggttgatacatatataagtgtactaattgagaatctagtggttgataagaataatgagctatagataagggggggaaaaagaaagaaataaccatgcatcttattaattagacgagaccccacaatattactcatcccattaattcaatccacagtaagaaattgatgagatagtacgcatcatgcatcgctataggcggctggagatgcactgcagtgccgatattaggtccttgtctcacgtcgtttcgatcgatccctggcagatgagagactgagagagagcaatctggaatggaactgcaaaactataaaggttttggaacggaatctgcaagcatcctttcagctgatggcccctgcattgcatgcagtagtagcactcgccggccacttgatcatcttcgtgtctgggcaattgtcggtcgtcccaaatttgtgcatcatttctaaatgtgtgtgcatgttgccggcctggagggtgagatttacagagttaccacaaattaaatacatatctactccatctgtctcaaaataaacactacgctggatcaagtcatttgtcgtagataagtggtcactgatacctgtaagagttacctttgaccgcaatcaaaacccgttacatgtaaccttcatatgtgatgggtagttattttaactcgtcattggtgacctttatttgtcatggacatacattttagcccgtcaatggtaacttttatctacgacggatcataattgggacccatcacaaggtgaaaaattgaaaaaataaatataaaaataattttcacctagctagttatagacctttatctgggcatttacaaatcacaaaaatcatcacaatcacattcacattcatctagacacaacaaaatcacccagctacggtggagcttatccaactatttgcccggtggagctccgctccgccgttcgccaccactagatctggtgattcgggctagacatgtgcaccaggcagtctggggcgttcagatctagagacaggcgccgacgttgaccgagttggcggggggaggtggggtcgaggatgctatggagttgtgccccctccacagccatggtcgcctccatcactggttccttaggtggggtgaccaaatccgggcactgcaagctccggaaaggcttgatctaggtgaggccagcccgcgggcggaggcaaagttgacgaccggtgcttggggttgtggagacggtggccggcactcgcggtggagaaggcggcctccagtgcgctcgagctagaagatgtagaggacggattgcaggtggaggcagaggcaatggccggcgcgagcgagtagaggcggagatgatggaggtggagctagggttgcgggcactaggttaagagagtgatgatgcgggggaatcgagagagagggttgataaggcttggttggatggccgaatagataagattaaactcgttaattaccaaatgacgggtaaaaacaaaaaacaatttaagattaatttttttaccattgaacatgttgtatttatcgcccgttacatatgagtgttctcatctctgaccaactgtatttataaacccgtcacatgtgtagggtcatctatgacgggctgacatgtgtgcccgacagatgttacctttgtccagtgcacaaatggacccgtcacagataacccctaacctgtgatgggacttagcccacggtctcatctataacggcctctagtccaacccgttacagatgaggccatccgtggtaaggcagtccaagccatcatagatggtcttgtttgagatgggcaaagcgtagtgaaatcaattttaattttatacatgaatcataatatagtttatctccatatctattatatactaaaagtccattaaacttcctagaaacgctctcaagccgccacgtgacgttcctataaatactcctagaccgccatatggcactgttaaatctcaccatcgattttcatttaaattggtggacccaatactttagactattagattagatgtgttatttttttaaaaaaaaagaatactttcgcatctatactgtgggccggacaaagaaacaaaacgtaagttatctttgtacgtacgtacgtacatacggagaagaaacaatgaatcttatgtcctcttcaacggaagaaaagaaaacatgtaccgacttacgataaaaatgattaataagtaaaaaaaacatacgtaaagcaggtacgtagtgccactgaaaaactcgatgctccataaaatatgatattatactattttaaaataaaatatattactctataaagttatgcaaatatacatagctaaactagatcgtttacaatataaaaataaaatatcctatgaatactctttaaacatcctatctataaattattttaaaatcatatatctaatttgtgatcaagtcggatcctctaattaaataaactattgatgtctatgttcataaatacatcattatatatgaggtcaacatataataaataatgttataataataatcagaaaaataatgaattaccccttaaactattacggtcgaccgaattacccctataaacctaaaaaccggacatctttcaccctcaactattaataccggatgaattacgttccccccctaatgcggagtggtttttcgtcctacgtgtcaatttagttagcattttcttaaaaaatggtaggacccatatatcatatctcttcctcaccccttcatcatctctctctttcttctccctccacatatcaatcagcaaggctaggggcggcaagcggcggaggccactcctcctcagctgactcggcagccacatgcgcattccaatcaaggccgtcgtctccatcatttccgttgcatatcgttgtcgcatgatgagagttgcaggtgccggaggcgagaacctgcgctggtcctcaatggccaggttctgctacacccctgccatctagaacttggccaacaaatacggccgcagctatgtctaccatagcatgtcgtcccaccacggtttttaatcgatccccatcaccaatgcctctctcccgatgagacaacgaggcggatcaatcaagcaagcaagcgtaggggaatagacgaaggaggaggagaagagcggcggggtgacagtgtgcctacccggccggtccagtagcaatgggagggagaagagagaggctggggaatgggattcaggaagagaggcagagaggtgagagaggagaggggtagagagggtacagagtgtcacatatggccccacctattttttttttaaatacagactggactaccatgtagggctaaaattactccaggttgagttttttttggggggaggggtgggttaattcatcttttattaataattgagggtgaaagatgtctggtttcgggtttatggggtaattcagtcgaccgtaatagttagggggtaacttgtacttttcctatttcaaataattttacatcatattctaggtgtcaaataacacttgatgactatataatgctaacttaaagctctatatgtaaaataattgaaaacaacacaatttagttgtgtatttttaagcagatatgatttagttttaatatgtctgagattaagattctcatcttttttttaattgttagaactatttcaatagtatatgataagtgggcaacctaaatgttacataaatgtaaaaaataattatgaaaaatatttcaagccagtgatcttgctataatataaccatttagtccatcataggatttatggtcatatatgtatgtttttctctttgtcaaatagttttgataacaaatgaacaatcaattaacatgcgcaataaactactcatgatatattttttttatagttgaggaattccaacttatcagacataatttgatgaatgtatgtcatgcactctattgatgtgactatgaattatacttcaatcaattagttattataaataagtttgggaaaatagattcattctctaaattaattagtaaaggtatcttatgtgattatgaaaggcgttgaaaaatacgatatgcaaaattatatatatttgtcaaaatataaccaacaatatggtcctttggagattttatcgtggtagtattttaaaaaacactttattcaggtaagaaaatcacatatagtacaaatagaaataaaaaaaactccattattccattattgttttattatcgtgacacatgttgttctcataaattcatgtcattgtcataaatttagggttgtatggtttcatgtaatatgtcataaccagatattaactaaaacatgtttaaaatagagtgaagatctattttgaaaatataatctaaatgtaaacatttataataaaaaaagttaagcaacattaaataagtgtccgcgcatatgcgcgggctatttatatactaaaagtccattaaacttcctacaaacgctctcaagccgccacgtggcgctctaataaattaaagaaaatcctagaaattataagaaaaaaagaaaaacatccaccccttgattttcacttaaattggtgggtccaatattatacaccgttagatgaaattgatcataaaacaaaccaaatactgtggggtcccacctctcctcctcctaccgcgcatgtgtgggtatacgtacgtaacatgtacgtacgcttccttcccttcctcttttttttttcctttttttcttctttttcccatttatataatggatattttttaaatcaccataattttacaaacaaacaaatttaccatcatacaactcacatgtaactaaattagctctacaatttttgaaataaaatttacaccattatatgttaccattaaattaataatgtaatataatttccactaacatatgtactcattattttatactattattttcaaataatgcactattttaaaataaagtttacacatctatattgcgtacctatcaaataaacaatttaagatctatattaactgatttatacgtacacttaaactgatggacccactatttaaatcattcgaactatttttattacattggactattattctcaaataatgcattctttcaaaataaagtctacaacattatatactatatactgtgtacccattaaattaacaatttaaaatctatactcactaatatgcacttacactagaaccactagacccattatttaaatcatttgatatattatttgctaataaataaagcgtccgaaatcgtctttttggcccgctgcacaatgcacgtctgcacctttgccttttgcacgtgtgtaaagcgtcgtgtctgaggcatctaaggtgatcacgactgccgcagcactaccgctatgccacatatcaaatcatatatggagatgattaattttgttaataacatggaaagaaaattaatggtatgatgcagcgagagaagaattaaacactgtgggttgtgttttttccaacatttagctctgtttaagctgaaaccgagagttgattacagaataattataatgtatcgtgttatgtcatatttggattttgtactatttattcatataggtgaaagaaattattatattataaatctgagcacaatattaacgaatatcaagagaactcttacaaagacaagggtgttataagggagtttaagaccctcttttttttctagattccatagttggatttttgtttgcacgctttccaagtttttaaatggtgtcttttttaaaccacattttaactttttagaagtcaatttatttgtttataccctcaaatagctacaacataaatcagataattcatcaatttcagctgtcctaaaccctaagtagtacgtatttttttttcatgcgagtgatggtgatctgtaaattggggatcaacggataatcaaagtcgtaagatgaatatgtaagagctactataaacaactgtaaataggtgtcaaaattaattgctattaattagacatctaatggcttgctagccacacaattaatttctctttacatgcatataaacatgcaggaagctggaacaaatattaccatgtgccccatacatatatattaagctacatgcatataaacatgcaaaaagctggaacaaatattaccatgtgccccatacatatatattaagcggttaatattttaattacatgtgttaagtcctttaaaatttattaaaatgctctcaaactgccacgtggtgctctaataaattagagcaaatattagaaattctaagaaaaaaagcaaagtatccactgcttaattttcacttaaatcgggacatccaatattataaactgttagattaaattaatcttagaacaaactaaatactacaagatcccacctctcgtcccgtggcataggtatgcacctacgtacgtgggtacgtacgcttcctctcccttttttcatttttccctttcttctttttttccatgcatacccttctctctttttcttactatatcatgcgcctttatgggactatttaatcacaagaattttgagtatcttgctctcgcaatttttatttgtggctatactacacggtaggtatgcatatagatggactgtatgataattaactagcaattgtttcttatttactcgagaaaaaaaatgattcaaaagtcgtaagtacttaatccttctcttactcaaaagtttgtgaatggtttttaagataccttaagaaaatagaacccttaaattattataaaataatattatccgaactttagtttgcccttaatttatgagacaaaatttttgaataaacaataatcttatcttttaataatataagtgcccacgcatgcgcgtgggccaccttcctagtttatatataaaagttggcttattttgggatggagagagcacttctcatctattatgatatattttcggtttaacctcaaaaccttaaaatactaatagatgcagaaaataggagaattgacatctaaaaaaaagatatagcagtagatttgtcttccaaatattatatttaatttctttttagtaatttcataatgatacgattagagaaggaaatgaccaaacatgtacataacatactatgtcaaaaattggtcccaaaagccaggaaagattcaaaatcatttacccacacttatggcaagttttagctagaaatgaacttataacctttgatgcagaaccccatttaggacaggtgattgagaaaacatatgaacaggaaaatggtaggcagagtctcaatccattgttccaaataactaaaaagattttctcataaaattcagatcctacaaaattcctttaaatatcctttggtccaaaaggggcctaacccttgaattccctcaaagctctattttccactctgcagtgcctctgtttctgtagttcttggaggacttttctatggccgcccctacaggtgaaaacttacaattgctctttgttttcaaatgttaattttcttgaaacattggaagataaaaacaaccgaatttcgagccaaatggcatatttcagctataattttgtccaagttcctatttaaattctggaagtggagcattgtccggtacatgcctacatggaatttgcacatttcttaattaactcctttcttgaactgacttatcggaatagagtttccattatctattgcaaataaaaatagttgcatgcattggattacttaatttcatgaatcattgtttgcaatactgatgaacaatgcacatcgattacgtacctaaattggttatttatacattttaatgcacgttttgtatccctgaaaaaaaaagagtgcacgttttgtattattgatcatgataacacatatgcctaactaattcaaggactcattggcttcatgacaattatcagcaaagtatcatttgaaaaagaaaaaaaaaagaggaaaaaacgagtagtcaacttactagtgcatgccatggggaagtccactatgctgtacagagagaataatgccagctatttttgcctgcacaggggctgcagga

SEQ ID NO: 16475 - DNA, 4734 bp, Oryza sativa
ggggaatctgagaatgtcttgtgctttaaattaacaccatatcatccatcggtgcgaagtcgatcgtcacgaaggcgtgatcagcgatcgtacctttgatgatgggtgcccaagtactgggtttctgtacatgttcttggaggtggagatggtggttgaaatctctcagagagaggcacactcccacacacctcatggcagcatgtcacctgttcatctctctttcaggaacatcttgttctacatacttacattgctcaattttgagcgattcgatctaatatgcggttttcgctttcggagaaggcgtccattttcgatgatcataccttcttctcctcttgcagctgctgggtgccttgacttgctaggaaatagtttgcagctccttttccatggatgctgacctcctactgtcccttagctgcattccctttccatgatgatgacatgctacttgaacacttttcatcagagtatcagattctgctgcaaggtgcttccctctctgtgtgccaccttgcagcaacattaggtcactcacccccagtgcataaaatctatatgatcttgcaaattgtgttttcctttttgagttcaatgtctctcagacaagttaggctggatcggtgttatttaccttatctttctttgggtaaggaaaggaagaactttgaagccaagacagggtaatatagagtagtaggaaagtggagctgttgcatctccaaacaattggaacttgtgtttctactttgccggcatgaaagcaatttttaagcaagtttatcatgaatgccccggcattgcaaacatggaccttttttttatctaacaaactcggtgaactttttttttcggagcttcgaaaatggttgagtggtatggttcaaataagagtaaaaaacaatcaaatcttgggatttcattttttttccaataaaacccagtaaaagaaggtgcaatggaatttcagtagaaggatgcaagaaagagaaagttctacagggtgcagaatataggcttcctgctagtagctgctgcacacaatgtcatgggactgttcatgtgcttggttcatcagggaaaatgataagacatctgcaccaattattgtgagtgcctatctaactttgcatgttcctgtttacattttaaaatttctttcttcatttttcatggaaaaaacaacagcctaatcaatgcctgaagtctgaactctgttcttctctacgttattactgtttcaacaggatggcacagtgttattgatggtaacggttttctctatctgttaatctgacctgctacataattgtcatcatttttcttaaatctcctccattctggcaccatcaaaccaaaatctctttaggagaaaaaaaccaatccaaaagcaaaagttaatttgaaaagaaacaaatatgaaaaacaatatgttactacacatcaaaggacaactaaaattgtgtgcatgaagacgtaggtagatattgtgtcatactgtcataagcaaaggctcaaccaaacgccactagatagataggagcatcatcaacttcacctaacaaagaggcaacagtatcaccggtggagatgatggatgatgagtagtagtagacaggcagccttccaatggctaatgcacacaattatagcataattaacacaccaaaagagccatgattaacctagagaggaatcatttggtaattggaggagagggctcatgaggaaatatgcccaagttttcctttacttcctctcttttctccagaaaaatatatggtgtgatttctccttttttgttatttatatgtgatgcatagaccaagaacaaaaataaagggtaatgttatacagatttttctttgcaaaatatttttcaaatataaatgttaagtaccattgtatttctattacattgaagacacattgcatatggtgcccaattttatgcatttgagtacctgatggagactacaaatacaaaacatacacccacgatgttctagtaattttgccagatctttctaaatattttttttgaaaagtatactatctcagtatttcttttcgacaaaaacattttttccataccatcacaaaatgcagtttgggtaggcctagatgaagaaggtttcttattcaacagtatcggattataggatataaggggtttaatttcattttttttataaaagatttatataaaaaagtggtgttttagatggtacctaattctgaggcattgagtacttgggatgcaagggtacaagtacaaaatgtgtaagacacatgaggccggagaaagtggttgtgaacttgtgatgggatgttcgttaaaacttaaaagttgtgtcgccttaatatttatttatttagcacttcattgagggcatttcttaatgttaattattcgcatagtctcacgtgctgcttacataaataatatagtccttattaagggaatggggaatgatattgatatatgtgagatgtcattagctaagctattaaatacagggacttggttcctctccaaaaatatatatatacagcgacattgctgccgaaatactaatcatgaaattatatttcattgctttaatcacgtgttttcagcttataaacaacagcaaaggaactcaaccatattataagagagttactccctctatctcaaaataaattgagttcgaaatttgtttcaaaagcttaagtccgtaaattaagaaattttatccattcagtatcctttactcatacatcgatactacttttactttgccttttttacaccactcattttttcttgggatgtaatggttcgatttattttgggactgagcgagtatctctgaatcaaaatgttcatcttagtgtaaattggattgcccaacttctttatgtatattaaggggacatggtttctctagtatatatactccgatagttctattttacttattgtttagatattaacaaagtcttcattagacattgttcactactacatttacaatattattaaaatgctatacaaaagtacttttatcatgaactactaattactctgtgccgctgcacttaatttaactgttgtgcagccaatacaaacagtgtgttgtgtctgcagctacagcggctacggctgcgtgcagcggctgccctgaccagccgaaaatgcccaatatatgtttatagattaactgtgatatttgtttgtatgcatgcattctaaatctcaattagtttttttttttgctaaaacgaattgcacataatgtacaaacctcatgttgttgcactctaagcatgtattagtcttcaattggccgccgacaggcaggcatcaaatcgtgaaccggaggatgtttggtgaagcgtacggcatcaggaccatgaacactttggaacggagctgcctagtaaatactaaacaaaacaaaataagtttagggagtattagcatgtagacgtctattaaaaaggacttttaaatttggtttctaaagagaagaaacaaacaaagggtcgacgcagaaaaggacattaccgtgacggctattgttgtattttaaatttgattgaattcagtggttttactttctttgcagaaaggatgttgctcattagctccttgattaatggacatctaaggcctcttatatggttaacaaatcacatcagcccaaaagtagtgtagaaccatcgatcgtatatagcaggccaaatggccaatatatatatggaaaagtagaccattttacaccctaactaactaactataactatatatatatatatatatatatatatatatatatatatatatatatatatatatatatatatatatatatatgtgtgtgtgtgtgtatatagttattcagcacataaaaaaatatcgaaaaacgtaggcattagggaggcttttttctttttgcgagtgcagcttataagccaagaacacttgatcaaagcaaacggaaaaccagttttagactaagattttcatactttttctcttggaagtctagcatgagctgagcgacagaaaaaaaactaaattaattctaaaattaagttttagaattgaaatttcaaattgtttgatgtcatttcctttcaactccttggtgtagaatcattaggtttattgtgtattccatatagtagaaaaatttattctaaatcccccaaaaaatgcacatgataattttatacatgactgtattttgcttaggcctcttctaggttgtagcactggcctgttgattaattctggcgagccaggcccaacgttttagaaagccggtattgcagagatactggccttggcctgaatttatcaaacataagttcatatatcaaatatctaggcctaacaaaatgtagctaattttaaattgaaatttaatatatttctacctatttattttgggttcaaacgacaccagccaaattaccagttcaccaccgttttttttttaacctaggctaggacttgcaagcatcagtcaggaaggtctgggatcaagaggtaaacagagcagactatgatttgtacaaataaataaataaaaaaagacctccctaggacaaagaaacagatcagactgtgtgttcgcacctcctggttgggaacacttccctccattaggaaaaacggagcatgccattagcacgtcattaattaagtattagtttttttaaaaaaagggctgcagg

SEQ ID NO: 16476 - DNA, 2416 bp, Oryza sativa
  unsure (1)..(2416): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagaggcaaaagagaggacaaagacggtgagaagaccaacaacaacaagcccaacaactacaagtcgaagggttctaaccaagggaggaagatggagaatcttaggaaggtttttcaacaagtttgcgccgccttcgaaccactaagtgatgtagatggtgaaagtggagatgatgataagggaaagaacgtctcggatatttgcttcatggcgcgtggcgaatctgacacagagtatgaagataatgaggtgagtgcttttgaagaagctattaatattttgagtgcaaaaaataaaaagtgtgagaagatgtataaaaaacaggaatttatcattgaatctcttaagtctgaaatgataggttaaaatcttttattcctaatgatgatgattgtgaaaattgtgaggttttaatgaatgagatttcaaaaattagagatgttaatgctgcacatgatttgaaaaatagatcttctcttgcttgttgttttgctttgcacacacgcactttggatgagttgtttttaactaaaaagttgttgcaaaaatatcaaattgcttttcatgctagtttgatgtttaacatgatttctgctaaaaagttaaaacaacctcatgatgttttggattgctcaacatgtaatttgaataagatgaaactaaaagatgctttaggtcgtgttgagtatatggaagatgttgtgaaaaacaatgaagtgttttcttgccccaaatgtcgtaaaagcaaaggtatcatggtagattgtgaaaattgtgctaatttggaaaaagaggtttcttatttgaaaaattctttgctaagattttctgatggtaaaaagaacctcaatatgattttggatcaatcaaaggttagcacaaataaccgtggtttaggttttgatcctcatgctcataatgctagacatcctcctgttgtgttaggtgttggtgctagaagaggtgagattttggttaaacctgatactaataaaactgtgtttaaatctgctggtatcatgtctactatgaatgcatcttcttcaaaattcaatgttgtgcatgcaaaacctcctgtttctgcttgtgttgctaaatcttcttgctctaacaatgtgtctaaacaacgtgaaaaatatgcttgttctttttgtggaaaagatggacatcattgttgatttttgtttcagattagctcataaacagaaaaaggagagagagatcgcttttgcaaaatcaaagtggcaaaaatcgggttttccctcgaggaaaccggtcagaccgcagtgcgtcccgcggtcagaccggcgaccggttagaccggctggagagcctcggtcagaccggacaccggtcaaaccggcagtacagaggcggtcagaccggcctctggtcaaaccggtcactgtacctcggtcagaccgcctcggaggaatttttctgaaaattctaaaattgattttgcacgtggatatatgcctattggatcttctggtcgtgtgtctcagtactggattcctaaattcttattatcatctaaccccagtactgaggcttcgacttctacttgtgtgtaggctttggtggcaaggaaggagaacgtgtggattgtggattccggttgttcgcggcacatgaccggtgataaaaattggttctcctccctcaaaaaggcatccaagactgaatcaattgtctttgccgatgcttctactagtgccgttgtcgctacaggtttggttaaggtaaatgaaaaatttgaattgaagaatgtagttttggttaaggatttaaagtacaatttgctttcggtttcacaaattgttgatgagaattttgaggttcactttaagaaaactggaagtaaagtttttgattcttgtggtgattctgtgctgaatatttctcgctatggaagagtgtttaaagctgattttgaaaattctgtttcacctgtgataacatttttggttgctaagtttgataaagatgtgatgttttggcatcgtagactgggacaagttggttttgatcatctcactaggttaagtggtttggatcttgttcgtggtttgcctaaacttaagaaagatcttgattggtttgtacaccgcgtcgtcatgctaagatggtttttacttcacatgctcctattgtttttgtgatgacggatgc

SEQ ID NO: 16477 - DNA, 3309 bp, Oryza sativa
aggatattccaaagacagcattcatcactcggtacgggtcgttcgaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagccgtggatccagcaaatgtggagtcagttaccgagtggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaaccctgcctgatcagacgaaagatttccaggtctattgtgatgcatctcgccagggggtaggatgtgtgttgatgcaggatggcaaactggtttcttatgcttcacggcagttgcgtcctcatgaaggcaactacccgacgcatgatctggaattggccgcagttgttcatgctttaaagatttggcggcactatctcatcggtaaccgttgtgaggtatatacagatcacaaaagtctaaagtacatcttcactcaacctgatttgaatctcagacagcgaagatggttggagctgatcaaggattatgatatgggaatacattatcatcccggcaaggctaatgtggttgcagatgccttgagcaggaagagctactgcaatgttgcatgggtagagcaactatgctgtgaggttcaacgtgatttggaacatctgaaccttgggatagttgagcacggattcgtggctgccctagaggcacagcccacactggtggagcaggttcgcatagctcaagcaagtgatcctgaaatagcagagctcaaaaagaacatgagagttggaaaagcccgaggttttgttgaggatgaacaaggaacaatctggatgggagaaagattgtgtgtacccgaaaacaaggaattaaaagacctgatactaaccgaggctcatcaaactcaatattccattcatcccggcagtaccaaaatgtaccaagacctcaaagaaaagttctggtgggtcagcatgagaagggaaatagctgaattcgtagcactctgtgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatagtgtctgatcgagggagccaattcacctcaaagttctggcagaaattacaagaagaattgggaacccggttgaatttcagcactgcttaccatccacaaacagatggccagaccgagcgagtcaatcaaattctagaggatatgttgagagcctgtgcgcttgactttggtggagcatgggacaaaagcttgccgtatgctgagttctcttacaacaacagttaccaagctagtctgcagatggcaccgtttgaagcactgtatggacgaaggtgtcgtactccgctcttctgggatcagacaggggaacgccagttgtttggtacagaagttttaaatgaggcagaagagaaagtcagagctgttagggaaagattgagaatcgcgcagtctcggcagaaaagctatgcagacaaccgccgaagagagctcgctttcgaaacaggggattatgtgtatctccgtgtcactccgctcaggggagtacatcgcttccaaaccaaaggaaagttggcaccacgctttgtgggaccatacaggatcttggaacgtagaggtgaagttgcttaccagctcgagcttccctccaacatgcttggcatccacaacgtgttccacgtctctcagttgaagaaatgtttgagagttcctgaggaacaggcaagtccggatcacatcgaaattcaggaagatctgacgtatgtggagaagccgattcgtatcctcgaaaccagcgagagaaggaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagtttccccctctccttgctttaaaaatttgttaaataaattgcccgaagaaattatcttaattaacctagagctaattccctaactaataaatgcaattaataattggaattggcatggtggaatttttcttgagttccccatgctccaatgcattaacaagatttttagtggaattttcagagccttggaaataattttaaccaattaaaaatcaccaaagtgcaattttaatcccaggaaaatcctttcttctttttctttttcctttttcctcctttttcctcttcttgggccgtcggcccagtccacccgtcgcccgcgctcggcctccccttgtgggccggcccgttccctttccccctctctccgggacgctgacaggtggggcccacctgtcaggtcgtccccttcctccagccacccgcctccgacggcaaccgccgccgaatccgccacgccgccgcctcctccgctcttcccgcgcccacgccgcgccgctcccgcgtcctccccacgtcgccgcctcttcccccgcatctcccggcccgtgcgcgcgctcgagagggcgggattcgatttcgaatcccacccctctttctctctctcctccccacgtcgccggctaaatcgggagggttcccggccacgtcctcccctccctcgcccattaaatcactctcccgagctccctctctcgttttccccatttgccgtcccctcccgtgtctcctaacgagcccacgccggtagccggtagcaccacccgttgccgcc

SEQ ID NO: 16478 - DNA, 473 bp, Oryza sativa
agcagcaaaagccaacaaaagtctaattgcctcaattctagcagcaggagcaaaagtttcatcaaaatccaaaccctcaacttgagtaaaaccttgagcaacaagtctagctttatttctcataatcaaaccatcctcattttgtttatttttgaaaacccacttggttccaataacattatatccagaaggtggttcaactaaagtccaaactttgtttctctcaaaattttcaagttctttatgcatggcgttaatccacgattcatcagttaatgcaagtgacacatctttgggttcaaaagaagtaacaaatgcagaatttgcacaaacatcatgagccgttacctttgaccttgtagtccgctcacctatattaccaataatttgttccggcggatgtcgtcgttgaatgtgcaaaggagcagcaacttctgaagttgatccacgttctgtttcagtactggtcgaag

SEQ ID NO: 16479 - DNA, 326 bp, Oryza sativa
tcctgcagcccaatcgcgctctatgcaccaagtgaagcgaccgccatggagtggcaattctcggaggtccagctcttggatcaagcgagaaatcttcaccacctcctgagcacatctagaataaaagatactcgtaccaacttcagctacccagcagcctgcaggctgcaggcagctcatgcccatacgagaagagcacagcaacccgagctgcccaaatgcccaacagctacaacccctgagtgccttgtgtaaattaagtgtgcactcggcttctctgtgctctagattcgccctcgccggcggcttgcctggtgctaaaaatg

SEQ ID NO: 16480 - DNA, 9594 bp, Oryza sativa
tgtctttgatacgatacatcgatggtcgatttggttcctgctgactacaacttaaacagttgttagggctgtaggatgtaaattcaaatgcccaaatttcaacaagacaccgttagggctgtagcaagactactgtagcatttaatctggaccttcaacggaaaaattggatgactggattgcgtgcaatctctaacgtgcagttatagttgggactgcacgtcagcagatgttcccaatccatcgagtgtgggtgtatgacctgacctgaaactgacctgtcagcaggtttgatgcgttcaccggtcggcatgtatgcagcaacatggtagtgcaaaaagggtacgcgtaaacctggatttcttcggtctcaaaaaagcccaaatgcgaccttaaaaaagaaggccaaatcagccaagctcgatcccttgactgaagcatggacgaccgtttaccttggttagcttggaacgggtcaataattgctgctgctaaatatggcaaaatgatttactcttaaaaattactgcagatgattaaagcaatcagatgcttactgcaaatgattaaaacaataagatgcttcagaagttcacgcatgttaacttgcgtttcgaacgtcgggcgtgcgatgtgcaagcgtacaatcgtgatatgtggagtagtagcgatgcagtagtaccatggaagaaaaagataaacagagtatgggtcggaactcagaaaggggtgcttgaaaacgggaatgctacgcaccggaattccgtccggacgggatccttttatccccttgcttattcaaatagtagcgatacctgaccatgcacgtcctgaacagcagcagcaacctctgcaggacacggtgccgctccagcgcgcgcgcatggctgacataggcagcggcgcccacacccgcactgtcgacgcactgccccgtgatcgtgagctcctcgccggcggcgtcggcaccggcgcaggggaggaggaggacaacacggacgcggcaacagatgaggaagtagagtgcgaaggtgttgccctcaccaccgccgtcggcgcagagcacaacgagcacgtacttggctagctcgtcgaggtggggaaggacgtggccgtcggcgacaagctccgacgcggcgtggacggtggaggatgcggccgtctacgacgagctccgacgtgggacatggatgatgaaggacgcggtcgtcagcgacgagctccatcgtgggacgtggatgacgaaggaagcgtccgccggtgatgagctccgacgtggcgtggacagtgcaggatgcggccgtctacgacgagctccggcgtgggacatggatgacgaaggacacggctgtcggcgacgagctccatcgtgggacgtggatgacgaaggaagcggttgccggtgatgagctccaacgtggcgtagacggtggaggatgcggtcgtcgacgacgagctccggcatggggcgtggatgacggaggacgcggccgccggcgacaagctctgacatggcgtggacggtggaggatgtggctgccagcaacgagctctagcgtgggacatggacggtgggatatctggtaggtatcgtctgatacctcgcaagtatcacattctacgtggtaagaatcgcatgatatctgataggtatcatctgatacctcacaaatatcacctgatacgtggtagaatcacatgatacctgataagtatcacctgatacctgataggtaccatctgatacctcgcaagtatcatctgatacgtggtagaatcgcatgatacctgataggtatcacctgataccggttaggtatcaggatctgatacctcacaagtatcatctgatacgtggtagaatcgcatgatacctggtaggtatcacctgataccggttaggtattaggacatgatacctcgtaagtatcaccctctatgtgataagaatcgcatgatacatgatagatatcatctgatacttctcaagtatcacctgatacgtatgtgatagaaacgcatgatacaggttatgtatcaagacctgatacctaaccggtatcatcccgttcgaaaacgagattccgttatatagcagcccccgcttgaaaactaacccctcttaggacaaaaacacattgtttgaacatattttaagtcacaatatttttaacatatgaattgcatgtatgaaaaatcatatattttgatttgttggatatttagttatcttttatgaaaaaaaagcttcaattgaagactatatcgatgttgaaacgatattttttccaccaaaagtgagtactatttaggtgtccttggaagtaaatttagaggttttatttttttaagataaaggaaactttcttgatggatgtaaacaattataataaagtgatacaattaatctaagatcactcttggcaccagcatagtaggttgtccacaacctataattattttttagaaagaagaacgacatgataacaaatatcatgccatagtgagctacaaccacaagctttatactctatacacgcatcacttagaaaaccttaaaaacaacacctccaaaataaaaattgcattgtcattgccatgatccgatcaacaaaacccaaatcataggttttcatactagagaccaaattcttcgaattctagacaatgccttcaaccagctaatgccatatgtagggaggaaccgattttcgatgagcacagcctgaccgaagttccacattcatattgtcctctcatttcttgttttgtttgagaaattatcttattcttgtgaaaaatctataaaacttctacctatattaagggaaaaaaatcatgccttaccagtctacctaccaattagtaccaatttaagcaatacagtaatatatcgtcggagagtggattttgaactctcgagtgaatgacccatcgttgtttacatgtcactcaaatggttatgaaatttttttgagaagatgtattaacatgtgatatattactccacaaacatgcaagttaaatcaacttttataagttgtaaaaaaacaaactacagataattaaagtatattcatagtcaaatttattttttcgttacgatatgtagaagttaaatttgactttgtatgtttgtgaagtgatatatcacatattaatatattttctcaaattttttcataaccatttgagtaacatacaaacaacaaggagacatcccctcgagagtttaaaatagtttccccgtattacccagtttggaggaaaccagaaatattttaggccatagccatgatacaaggtgaaacggttttatttcagaatctggttacaagagacttgaatttcctttactacaacggaactaaattcaacacgaataaatctacagacaatttaatgaaacaatcaataactttccgacaccttgtaatcacatcaacccctgagcccaacgtccatcagcatgagcaactttattctccttaatatcgtgtgttgcagtctcagttaatcgctcgtctgaggtgatgagcagccgcagaggagctgccagatgctcttcttgacgttgttacgcttggacttccccattcttgctccaggaatatccgagctgcacaagctctaatgctccaaatgaaatgctcctgtaaacaaaggaaccaattgaaaatctcctacaaaattacgcgaagatgaaagaaatatacacagctaaatagcaaaaaggaaccagcagagtaaaaatagaatgctattgtaacctccagttaacttcttcaggaatcaggggatgtcaagcttggtgcatttggtgaatgagagaagctactcctatttataagtgttgcaagactgaactgtacactgcataccttggcttctgaatattgtcggactttgcaagtaaaagttcgcgagaatccacaagaatattcaatgaagaaggactgaatgagtccagaacttgaattctgtccacttgcacaaacttaattcggtggtatttgcccgggattagcttattcaacccttgtttaattgcacctcacctctgcttgttagagacaagtagaggtgaggtgcttgttagaacgagaaatactcaggggtctttcggctagctccacaagatggtgggctagacgacctgggttcaaaacctaaccccttctaattatttgatattaggtccttccctaatttttgagttttttttttttctgcttgttagaacgagtcctagacgtcccaaactgctttaatcactatattagatgcaagcgattagaatgcgcgtaattaatcggattaagtgaatggtttggaacttcatcgatctatgccatgtaaaaagaaaagcattgcgtattccctgggttgcttctactgttacataaagtgtgctgttcgtcgtcctgttgattgaatctttcatctaagaagaattcagacacagccacgggttgcgaaatggcccggatagactctgatgatttgatgggctgcgcgggcccaaaaccatgaaggtcgccatcccttgggcctagtggtagggctttgtctcgcgcggcccagctcgtcggtcgctgttggtctgctacgccaccgatcaaagaagttcacaagcacagttggtttgcagtagcgtactctcgatctgttctaaaataaacaaatctattactcttaatattataaataatatataatatatcttaatactataaatctgttctatcaaatattatgtttttgtttattttaatatgaagaaaagtaggaaactaggaatgtacgtaggggcttttcaactgaagttgaccgaagcatatgtgcataataatttgttgggattattgtattgagaggcattgagcgtttccatccagggcctatagctgtgaagaagaataaaatttgagcatacgattccgctcccgttttgtaaaccgccaacatgcccatggttttggacctttttttgtgccaaccttgcaatcttcaactacaaataaacttggatggaccagttctcaatacgaatgaacaaaacatagtactagtaaattacggcctgtttatagttccctaacaaaaattttgcaccctattgcattgagcgtttgaacacctttataaagtattaaatatagaaaaaaaattaattatacagattgcgactaatttgcgagacgaatcttttaagtctaatcgctccatgatttgataatgtagtgctacagtaaacatttactaataatatattaattagggttaataaattcatctcgctatttactgacggattctgtaattcgtttttttattagtgcttgaacactacatgtgacaccctatataatacccgatgtgacatgctaaaactttacacctctcatctaaacaccccctacagctgctaggcaagtgaaatatctctatgttctggaaccgtacttgtttccatgtcattggccaggaaaacaagaaactgcgtcagaattgagacctggaaacattattggctcctaattaacgcaattgacactgggccacagatcaaagccatacttgtactgagcttggacgaaaatattcttcgtctttccagatgattaaagagccttctggagagagaagcaccatcatggctgcctatctggcgaacggccgatcggccatgtaaaggagaaaaggcagtttgcacaaggaataaaggcaacctagtctacaagttcgctatcaacaggcgatatgtcaccctatttctgttgctgttcaacgacgtccttaaataggagtacttgtgctacaagcctaacccagagatagcaccacaaatacctctcttttctttaggtgtttacttcgacagcttcaccaccttcgtttacccattgccatggcggctgagaagcgaaccattgggctcggcatggactactcgccgtcgagcaaggccgcggcgaagtgggcggtggataacctggtgaaggccggcgaccggatcatcctcgtccatgtccttcccaaaggagcagatgccagccacaaggagctctggaagagcaccggctcacgtatgtaggggcattgcattttttttttcttttgccttttcagtttcttctcttgttcagcaaattctggttcagaaaagattgacaggttttgcatctgatttaccgttggtttttgactttgtgtagctttgattcctctgctggagtttatggagatgaacgtgcaggcgaggtatgggatcaaccccgataaggaggtactggagatcctgcaagctgaatccaagtccaagcaggtaatgattctgcagccttctctgaattcttcatgaattacctgtgatgggactgtaaaaactagaagggaaggttgattcaaatgtaatcaaactaaaaagaaacgttgatccaaatgtaattcaaagcaaaacactgattccatattggctggatcaggttgaagtactggcaaaagtttactggggtgatgcaagggagaaactctgtgaggcagtagacgatctcaaggtgaatacctttgttcttggttgcaggggactaggacccttgaaaaggttagcatttaaacctttttcattctttgatctaaacctcttctcagttaaattgcgtgtgaatcaatggtttttacctcaatgcagggccctacttggaagtgttagcaactatgttgtcaacaatgcaacctgcccggttactgtggtgcgtgcaccaaccgtgtcaaatgcctgattctatgctacatgggactgctggaaattggaatgctgggcttgttttgctgttcatccatcttttagcagagaaccttcatctgagttggtgccattgcaaggattggtctctggctcctgcacttagcttttccatgctattggaatgttattaagttgaatcttcggtgtatttccttctgttacttcctatgtatagttcattactactgtttaatggtgaatgttaaagattgccaatggtgtgcttgctttatgtatacgacaggggccctaagaacagttttttgcttaggcaggtctttgtaacagaaatggcatatctgattttcttttttataaaataaaacaatcttacataagcaaagataatagaaaaggtgcctggcagtacatcaaatgtatataaacctttatttccaaatggcagaaatatatgctttattctttaaatataacaaacagtgttttacattaaccatctgctttgaattttgtcgtacaaattgaggcgaatactctttttagacaatgagatgtctgaaacctttaacaacaatggaagcaattttggagcatagcaatcagaacatcttaccagttccatctttgcgtggaacagattcttcaagatccattctgcgccaactcccactcaaagatgataactcatcaaccttatcatacaaaccaagaagaccacctgtatgtacaaaaagaatttttcgcccttcccacttagctggattagcacccatgtctttcagcattccatatgctgcctttccactgcagaaatatgaagcatatatctttaggcaatgatatggccagtctatcatgaacttgtgatgaccttcaatattagtctaacagaacaaaactttttatacttttcgacaaatggcaagtatactggttgtaaaattagagttacatgcaaaaggtgtttcttgggattaatgtttcaacaaaaggaatatattgtacctgtagactggatcaaggacaatgcctgttgctgtagctatatctttaacaaacttaagctcctcagctgtgttcatggcataacctaagcccttagcctgtgaagcggcagttgcaggtaatcaagtcaaatgttcacaaaattctaccaatgcacattagcaggaaatatcatcaattagagttgcaccataaaattggaacaatgaaatgaataaactagtttcagaacaattatgttatatactgatacgcgcataacaatgtcataattagaggatgtaagtccactcttcaataccatttaaatatcaaatatagaactttaaaaatgtacttacattttcaatgttgactaaatcatgtgaacgcaaatcagaatgaagtccatcaatcaggtcttgaacataggaatggaaatatccaggatcatcacaaacagagaaagcatggacctatcctaaaaatggataattagtcgaacaatttcagcaggatagaaaacaatcaaagaaagtgcatacttttgcctttaagctactcaattttgatcctaaagcaagaccagcaatggttccaccgctgcataaatttaaaaatcattcaagtcataaagcagcaattgctactttcaggaactaggcatgacgcaataacaagtgagtacataagtaccccttaaaagtaaagaatggtgcgtattgacaaaatacctgccacatgcaacaacaatgtcgtcaaactgaacatcacctgatatctgaatttgatgttcaatctcccttattgcttctatatatcccctatcaagaaacaaaacaagttctgatttacaaaaagaaaaaggaaacaatacaagttacaaagataggtcaagtttcaacaatcgggtatcactttcacaaattctgagacctgtttgaactttgaagtgcaaaccttctctttacagtaatcttatattctattcaatgttgttgattaaatgtggatagaatacactacatttgtccttcagctatgctccacttgttagccaccacacaagatagaaccggattcttctagtgttgcatgagatccactagattcagagcctagggccttagacaattccaacattccaggtccaacatagtatattgaccaatagaaatttgccaaaaaaaagtgatgccctaatgtttattcaaatacaaactaatctcttcttttctgatagactgatggcaaacaccaatccatgaataataatagtccctgaggaatattcaaagtatgctataaacgcacaaagaaattgaaaatgcaaaaatggttcaatagttaggattgaacagaaaacaataccaagttcctagagagtttgatccaccaacaggaataacatatggttttcggccttcttccaaaagcttctttttcagcaagtccgctaaagcctgaaccaaataaatccatactaggcttagggacttttaagcaatatcaatatgaataaagaagttctaacaagaaaaagatcactcagatattttaataggcaatgccactttaccagtttatctacatacatattcaaagaataggcaatataatcatgatctttcctcagaatagggaaaaaatgaccatgctaattgtatgatgcagacatatactgcaggatgcattacttgattggacctttagcccctttaataactacttgagtatggatatcaagtatcagtataacaccaaaatataaaaagttcctttgctacacatggcccgatggaattatgaaaataataataaaagcaataatagcacat

SEQ ID NO: 16481 - DNA, 1865 bp, Oryza sativa
catattaatagtctgaattaataaatggttgcgatttgcaacaagaataaggaatatatgaagttattttttaaagaaaagattagtaaaattttgtttagaagttatgtagatgaaccttcttaaatcttctggcaggcgtctatggctcatccactgttcaacatcacgcctcctaagttgcatttctagtctcctatccaaaaaaagaagaagagagaatcaggactagatattttttctgttagctggtacagcttatatctatatagaggtgtcaattcctgatgtgtattaacacaacaattagaggtccatctcaggattgtaaggtagacaatattgcacaataaacactagcaaattttgcatgtataaccacgtaccgtcttccaagagcttggagaaaattttgcatgttcccaataagtaatgcgaaaagcaacagccccaaaccaataatagccatagtaaacaggacttcccatgcaaaataacttgggacaagattaccagctagcgtacttatttgctgacgtcaaaccaaaataacatcagtaaagggtagtcaaaattgtacagtgttagcatggatgctgtaatcacgtatagaaaccttatacatcaaatggaacaaatgagacacaacttaagtacaagaatataaggaacaaaagtcaaatacctggaaaccccaaaataatgaatatatataacgtttaacagcattgtcctctgtagttagcaaaacagcctgttcataaatcccatagtggaaaccgttgtctccagtgtcgaaacaagctgttgaggctgaatcattaaaccactgctgtctgcttagttgattctgcttcccaatattaatgccacgtccacaatctataaaaccatcacaagatggaatttttgatgcagaacaagcattccgtaggcattggttgaccctctgtcaaatgaaaataaaaggaataataacatcatgaacctctactttagttaacatctcctgagtagcttgatatgatcaagtcctctattaaaaataccaaaggagtcgtgaacaacttaaaaggagcaggtgaatatagcaatttacaatcaccccttttaacacaaggaaatcaaatgtgcatcgttgtaacaatagaggttgtacagctcttagcctccatggcagctgtatctgttgtactagtttgaacctcttctcaatcttaataaactttggccgcgtatcttacgccggcccggcgaaaaacacaaggaaatcagcatgtatacaataaaatgcaatctaaatgaaaacaacaaattaaacagaagatatgttttctccgtatcaataataaagcaataataaagcacacattgtcatggcatagttctccaaatataaggaaacaattaataatatgacattcaatttgttggaatttgtaaaatgccactcgagtcagtgttgcatccataaaatgcatttcttaatttaattccttgttctttgccgattacgagccatatgaaaagaaaagcatgcctaccccactgtctatcaccatttctcttcatcccaaaaatccaacagtttccaaacaattgctctccacctctggtggcctagactctgacaggctccatcagccattgagttataaaacccctctagtctgcaaccaattctgagacctctgacatggctggccacaacagtagcgaggtgaatttttcagattttggtccttttgaaaaacttatttcgcaaatagacccttggaaaaacttatcccagaaatggtccttcttggggcgccagagtggctggcgccgtccccctgccgacgtggcggggcgatgctgaggta

SEQ ID NO: 16482 - DNA, 5177 bp, Oryza sativa
ccccctccctcgggcgctcctgccacgtcggttcgcgtgtgccacggtggcaggaggacggcgccagagaggctggcgccgtcccgttggatgacggcgccagccactctgacgccccaaaaaggaccatttctgggataagttttttcaggggtctatttgcgaaataagtttttcaaaaggaccaaaatgtgaaaaatccaggcgagtgatgacgatgaagcttgagcaggttgagatagcactacaagtcaaccattgcaatgtgtgtgatgacgatgaagcttgagcaggtggcaacaatgatgagggagagggaacagtcgtactgctgctctttgtgagggggtaaaggagaatggagaaataagaagacaaagggagggcatactggtaagtttcaatatttgagtggatgcaaaggttgatttgagtggtttccctatttcaacatttaagtgacactatcaatttccccagatgaaaaactactggttcaacatgaataaacacaatatttttgtgcagaaaactgaaatagaagctgaactaacctgcaatccaaataggtaccaacatgaaccaacaacatgtcccgccaaaacaaacattagaaggttaatcacaaagttagcccacgctgactcgaatatgaatccattggcagatgagtcagactgaccaccaagcaatggtacaaatctgatgatgcggggaacatactgaagaagaacagtgatacgcagtaaattcttagcatagtttgcagttgataacccaacatatttagggatgaccagcaatatcatcacctttatcaaggaacagaagacaaaaaaaaagtattagccaataagatataaaaaggtgtaaattgtttcgatgaatatcctttattaatagggttagaaaaaaatgcaattctgatttacataagcaactggggcaataaatagataaagggcatcagtgcaatcagatcaaatgatgctcatactgacaatattgatggcaaacagaacagaaagtaacaaagaattgccagcctagctaaggtgttcctctgcatgatcaatttcatgagactcatcctcaatctgctaaggtcacaagtatggaataatcaattagtcattatcatgcccaagatccatagtattttcaatgctaaacagcaacttctttttgacttcttgtcaatttctagttggcttaaatacattggcaaatactctgagaccaacaagaaactaccaaaataaacctgaaaggttcaatagcatatattttcaacggggacttgaaccaatactccttagatgaagcttatgtattttaaagtacatcaatagtggagatcacaagtttatagcttaaaaggataatgtggtctattgtgcacgtgaagagaactgaaagaaatgctcttgatctgttcatgataggtccataacactagctacatagggcaatgaatttgctgtgtgcatgaaaaagatgaacatggatcactagcacttgccaatcgcaagcattcagttgtggccaccggtccacaaagccatggcagatgcaaagtaataagccaagcaaacaagaaaagcaattttcaacagctggatggatagctgggacctcctaactcctatgctgcttgtgccaggtctccaacatactctccaggatgtatagtgcgttcccagtagctaactcttttatttgtttgacctaccctaaaaaataattatcataaccctaagaacaagtttgccttctgctaccgacttgaagaggagtaccaaagcaatataaaaatataaatagaatgataaaggaaaacttcagcctagataataagtcatccatcagggataaagaagaaaaatgaagcttaatgtcaaaatttagccacatcaactcagaaggataaaacaagttacctgagggagtggaagcacaacgaagaagtcgagtaaaaaatatccacgaagataacggacagcaattttctttggctcgtctactaaatctccagctcccactactcgcgattctggagctacataagccagtctgaactgaaagagaaatgcaaaaaataaaacggtcaaaagttgataatatgttttcttggggttaaaactggacaggaacaaatagatgcaaaataaaataaaatacaagatatgataaatcaaactaaaacatgataccagaatggagtcaaagcatgacaaaccattacaattaacaaacaaagggtaaaaagatatcacaactatttgatcatggagatatgataaatcatccgctgaagatcaaacaatgcattactgttagttactaaaacatgataccaggacacaagaatattgaacctgagcggctgagccttttctcacatattgtcaacagataaaaagtgcaagttatactcacaaaaaaccagtatctaatttggcatttttagaagaaaactactgatcactcaacaaatatacttgtcctaatatgcataccaaagaaccaaaatataatcaaactgccttccatctgatgccttagtgaccatgttatttatgaaagaattttataaaatgtggaaccataccctatcatggaacatgaattatagaaccttctatagaatagcaaaagcaatgatgtactgacctgaagaagcatgtgtagaaaataaatagcatcagtcacgcttctcacaactgcaagtgctgtagcaaaatgccagttcaacacaatgcacttgttatcctgcataaaaaaaaagggaacaaaagtaagtgcaggtcagctttgatcttcggagtatctgagattttcggaatttccgaaaagcactgcttctgcatctacttaaaagttttaatcgcctattccttcccccctccccttttaggcttatttgaccctttcaatccattacacaagatatcaacacttagaacagttaaccgataggagaatagaatgctgcaacaggagtaagaaaaattacacaagattagctcacaaactcacaaacaaggtgcaacaacaaatgaagtgtacaagaaagttgtaggcttttgacagatggatatgaactagcatcttcaagtgaactagttaccttttgaactgataataggaagaaaaatagtgggtcaatgaatatggcaaccaggcatgatatcacaaagaactgattccattgctgaacaacttttgcatgtgggttcataactggaatgcgtgaaaggaaacgctcaatttccttcttccatccaccaccatgctcacaaagaaaattatggaacttcaagagagcaaaagaaaacagattagattattcaatacaacaataccacagtcagtaactttaagcgctcttaagaagtgctttgatcattatgttgaagaaatctaactagacaaaaaaaaaactaagaaccaaggtactaaatagcattcacaatggccacaattgcagccgcaataacaatagcggggtacttccgctacagcgctacctccagcaatattggctgttattttccattgaagattgaaatagaaattttgatgcttaaaattgagttatctgtagccaaatgttgattgcttactaggagatttttatataagaagaagataaatatcaactaatattacctctcatctatgtagaggtgcattctatactctgtttttttttttttgccttttatcttttatgtttcttttagacttgtgttctctactttataattcagaagtactaggcttctcgaatccagatcacttatgatgattgtgaagtatgtatcaatactatgctattttactagaaaaatgttgcgcaatccagccacaactatcaggttcagataaaatcatatagttttaatgttttgtgcattcctacaaaaagagggaagtaagaccaccttactgtccaatgtacttgatcctctgtgaaaatgccttttgtttttacaagcaggagggcagttgacacaatcaggatcgtcacattgtcccaaaggtccagacatcatcaaatgttcattctttggaacattcccactataagaccacctgtttcctccaatttcttctggcattatcgcatgtggcttgttgacttgttttccttgtggaggtcgaggaggcatatctggtgtatttgtaaatggaatgcccgctgctgcagtttgtgttggtggctgaacaaacagaggaccagtatggggtacaaatgtgtcttcttcgtattcatcatccctaactggtatgcacattgatgtacttctaggaggaaacgttggtagctcaacatttcttagtagcataggaatatcatctctctcctggtcagacatttcttaaccctgaaatcaacatccattgtaatagaaaatcaagttcaatgacacaagcaagaaagtttgcatacttttgtataaaagaacattatctatcttcagagagtaacgactccaatcaatatcaatactcatgttggaattatatttgtagcacaatgtcagcataacaataacgaaaattttcagaacattttcaggaatgtaaaaacacattactgaatgccagtgtttgaaacaaccaccttagatagaaatataaagttattaacctataatggccactagaatgatacagcatgaaaatacactctgcggtagagaatccacatgtagattggccaaacaaaatcagcccctgttgtgtcagtaacctgctgcatatctaacaatggtgacaagcctatcacaatcaagtgttcacctgattaggtccccaacttacagaaccaattacatctgtaggagtcccccaaagaacagagaacctgaaatgagataaagacattttgcacttgttatagaagggaaacctatagcattactgaatacggactgctgaattggaactaagaagtgcaaaccaataaagacagcaaatacagctgcaacaactttaagactagttgtgtccaatactccaatgtatgagatgaacgaagagagaaaataactaataaatagtttaatataaaaaggggtatatatcacttgaacttgcacattgtgatatataccaatagaaagcctttggttctctcaaaataccactgaaatagtgtgctcttcctc

SEQ ID NO: 16483 - DNA, 778 bp, Oryza sativa
aaatcccataaaaatcgcctctccgactcctctggaagcatcaaacccctactcccccactctaccacatcgccgcggaaaagcgcagaaaaaaatgaacaaaaaaatgaagagaaatcgaactaacccgacgtgttcttcttcttcctcctcgagacgtcgggagattgcaccgatcaacagcggccaaccacaatcgctttcagaacttgtgcgcgatttggacactggagcgagatagcgaactatttttttttccacttctcctttcctttttcttttctttttgatttttaatcccttcctcttgtggcttccacgccaaggaccaggaggagagaaagcgagtggacacgggggcaaagagtcaaaacgacgtctccttttctctcactgacacggggcacgtgaggaggggcccgctgctcagtagatggcgcgtggggcccaccaggcaccaggtgggttttggactgtagctgctgccccgacgcgctgctcgctgccccactctctccccattcccctccacgccgccgccgccgccgccgcgtggatggccggagtttccgccgcctccgccgccgggaagatcgggagcttcctctccaagaggccgtacgcgccgccgtcctgggcctcgcacctgtcccccgccccctcgcagaccttctcgctcggccatgtgagtttgtttccctaagtccaccgcttgatcgttgatcctaacggccgcacttgttcttatcggtggattcgattcgaagtagttttgaat

SEQ ID NO: 16484 - DNA, 68440 bp, Oryza sativa
  unsure (1)..(68440): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaccgcggtgaacacggcgtcgagctgggcgtcgaggaggctgtagtacttgaggccgctcccggagtcgagcacgccggcgttggggcggaacagcgcgtagtcgagggagatgacgtcggcattgccagagtacgcgaagaacgggtacgcgttcaccatgaggtacgagccggtctgcgcgaggaagtcgagcatgggcttcatgaccgcctgggcgaggtcctcccggaacacgccggccgacggcgggtacgagccggcgagcgcggtgagcgcgatgggggacgacaccttgacgggcttgtcaaggctgagcctcgccagcgcggcgtgcacgttggtcatcgccgggacgagctgcgccgtgaggttcttggccgaggcgaacacctcgttcccgacggcgatgccctggatctgcgtggccgggtagtacgctgcgacgttgcggcgcacccaggcgagcgcgtacgacgggcgcgacgccgcggcgagcagctgctcgttgggcagcgcgaccaccaccttgatgccggtgttggccagcgcccgcagcacggtcggctcggtgtcgtacagcttcacctgcgcgatgccctgctgcttcatcagctgcaccaccgccgccgggttgggcaggtcgttcgccaccctcccatagttgatccccaccgtgcccgcctctgtaaccaaaccaacccaacaatcaaccacactactctccactaaaccacctgcattgccaaatctctcgttacctgaagcggacaggaagagcagcggcaatgcgacggcgaggatgagggcgcggaggcgcccgggtagagccattttgctgctcttgctgctgctcactgctgcgcgggcgcgagaggcagcagagcaagacggcgacgagtcgtgtagtggagagcgtggtgagtggtggagagggggggaaaagggcggggatttatggttgggggaggtgaggcgctgtaaagtgggccagccgcacgcgggcgggttggttttgggtggggaggaaatggcggggatgttgggagatgcacgtcgcgctcgcgtcgggttcgtggcgaagtgggtggtgcggccgtgcgagcgagggagagcgaccggcgcgccggatgaccgttgtctccgcctgcgcggcgggggcccaacgaacgtacggagcgcttgggctggctcggggttaagtggttagttgctggctaatcaatgtcgatgaatgagactgtacttgtagttaagcgtgacctaattgctctcatcccaacggctccaaacttgttcctttctcggacgatttaatttcctgagctgaaattgttggacgattttcctgagctgaaaatgaaccgaaatgtgggtgtggtagtttctggcatgtgggaccaaaatcattctgggctttgcaatatttatcggtgttcggtgaacatgctccacatagactgtggccctgtttagatgggactaaactttttaagtccctatcacatcggatgtttgaacactaattataaatattaaacgtagactattaataaaatccatccataatcttggactaattcacgagacgaatctattgagcctaattaatccatgattagtctatgtgatgctacagtaaacattctctaattatggattaattaaacataaaaaatttgtctcgcaaattagctttcatttattgaattagttttgtaagtaatttatatttaatactctaaattagtgtctaaatatatggactaaagttaagtccctggatccaaacaccacctgtgactacaataagttaaaaaaaacacctttttaatgaaaaaaaattctttattgactggactactggattgagtgttacaaaatgtaaacttcaacgacgtgatataccctacttttgttagcatgtaaaccgaaacaaaatggtgactgagcattaatcaaacgtgctatacgcgcgactgttttcagctacacttagaccaaataattgtcgataacaaacctgtacttttgtagccttgttcccctcaaatctctcatccaagtgactaggtggacgatgcatacacgcaagggaacgcttgtagcatgacgccgacagcgtgccccggtctctccagttttctgctttcgcaacatgcaattgcatggtcctctccttggaggacgtaacaaactctgccgacctgaattgcttggtcagtaaagtctctcggccacacaggcgatgaggcgagcaacgcatgactgcacacaaaggcagccaggtacactagctaccacaggatctttttggagcggatgaccagtgtccagtgcgagacagcactagtgtaccaactcatccgttgcatttgcacatttgcactgcagttgaacgctttagctcggtttggtactttggtgacgttggttcattaattagctgtaaccgtgtttgctgtgattagatgagctaggacagtcccaacccataacactagatatggtttttataaactccacattatcaagaaactaatactagacactactcttacaatgcaaacaccactatttcatactttaatttaatgctacttatctcacataatgtcttggatgttgtgtaggaaccatgtctcatgcaagacatgttttccttctcttttctcattttattcacttgccatattatttttttgtcctagatagcaacttatttaatgctatgaacaccattctagttattggggtggaaatgcccttattaattgattgattgatggctagatctgaaggtagccgaaatggttagaggtaaattatgcaagaaatggacaggaggacaggttagcctttttcaagcttcaccttcggttaattatgtttgaggtccggacaagaatacacatggggatcgagtggggaaaaaggcctggacgccttttaagccgctaataacaacggacagccgcgcatgctggttagagtaggtagagtcgagctagcgtgctcatgctcgagacgaagacatactgcaactactactactcgatggatggaagcagcatgtcctcgctaggtccaaactacagtgtttgccccagctcacattgcagcagaagacgagaagaccagtaataacagtagtcagtagatgtgctgcggcacagctattgttgagctcgacacgattaggaaaattcctcagggcgtgtactcacggtcttctccgtgatcgtcgtagatcggtcagtacatctgtcacgcatggtgtcgtcgattcgtcgttcttgctcgctcagctgttccacacttcacatgtagcgttctcccctagattagccagccagtttctggcaaacaaccaattcgatcgtgcaggcacagttgcagatgaagtggacgtggtgatgaacagaggagagcagatcgagcgagcgagcgatcaagtggtaaacggatagaaatccagcaggaaaacgcatcagggcccgcgcggcgagaaatgatgggggaagactggtggtaaaggggacgtacatcccagctgtgcaacggggggaaaagcggcctctgctgcgtccggcttgtcctccaccggggcgcgccatgtgcgccgtaacgcccgttgctccccggccgcggcgcgcggcgtccaccgctcgtctccacccgtctcactgcctcactctctcgtcggtggccacagtagtaaacacacaggcttgactcactggctgccaaagtgccaatgctcccgaatgtggcccaacagacagaggattaattaattatttgccactcttacggatggtgataaataatctgcccctagacccatatgtgatagacgcataagggcccacatgtcatagagacataaggacccatatatcatagacagcaagtgacaaataattaattgccacatcttaaacgtggcccaatgctaaatgtcctagagacataggcctggtttagttatcaaccttttctttaaactctttatttttccctcatatcaaaactttcctacacacataaactttcaactttttcatcacattgtttcaatttcaatcaaactttcaattttaacgtcaactgaacacacccagaaagacacaggatttttctgcttccgatacctgacataagagatcgtgccatcgcgataatgcaaaggagaggagaggcagtagtaggcctttggatctgcactagtaccattttcaggttagtttttttattttttgtcaagaattttcaggttagttgtgttcatgttccctactagcagcttcgttctcgcttcgaccatgtggcaagggtggcactgcaatcttctctcctataatagcagtagtagattccagaccggcagaagcttgcattcaaagcaggctgattaatctggttcagatagagaattatcgctcctgcgcatgcatgggatcctgcatcattgcacgaaggtttttatcattagcattaatatttttctctctgcctcttgagaaccactgagtggccattgctgcagacgagagtagcatggtgatctgatgaactcccacgctatgatcagtgtcagccatgtggatcttggagcatcatgcatccgagtcccagaggcatttctgtcggtgtggctggggaattcactcatcgcacgaaagattaggccgggaagggcagaatgatgaacatgcttggctaccctacgtcactggacgtcatccctggaccaccatgaaccggttcatgattggggcttggatttgtactgcacctgcagctcgggcagcagtagacagtagtgcggcgacaacagccaaaggccaagactgggaaaccacagagtgcgctcatgtgaaccaaacgtttattttcacactgattgcagtgagccagtgagctatagctcactcatggaccattcatatcacatactccctccgccctaaaaaaaaaagacaaaccctggttttcatgctcaacatttgaccgtccatcttatttaaaaaaattatgaaaaaaattaaaaagataagttacgcataaaatattaatcatgttttatcatctaacaacaataaaaatacgaactataaaaaatttcatataagacgaacagttaaatttagacacggaaacccagtgtttgtctttttttagacggagggagtaatctctgagctgcctactttagatcacggcgcttcaaaagagtcaatagattcagacggaagaggacatcaaatacatccgatatgatactattgatactgctgctgattcagtgcccaccttcagagttcagaacaatttcacggccacaaatggcagtaacgtttatttcacgttaaaactgaaagtttggttaaaattagaatgatgtaatggaaaagttagaagtttgtgtatatagaaaagttttaatgtaatggaaaagttggaatttagaagaaaaaatttggaactaaactcggccttagtattatccgtctcaggccaagtttagttccaaactatttcttcaaacttctaacttttccatcacatcaaaactttcctacatacataaacttttaacttttacgtcacatcgtttcaatttcaactaaatttctaattttggagtaaactaaacacacccccagtggtgacactggttctgcaatttgttttccttatcttctttttttgctccatttcaccgttcggctaggatggggaatcaagcctggatcttgcactattgcacacatggaccggttcaccaaccccacgtgccgttggtgacgcggcagggtgaattgcatgctactagtatgctacaccacctccatgtgcagcagcaggaaatgacaacggcgaagaatagatgagatctgatgaaagagaggtgaatataaaaaggtgaccctggctgaagaattcggttttaaaacgtcttgctacatcagattattctctcccttccaactgatgaggattgatctaagtttggaatgataaaactggaggacccaacaaacacatatgaggacccaccaaacgtatatatgctgaatttactgtgtagaggcccattagtattgactttcgattcctttgtgatgctggatgggaaaccgattatcaacgatgtttttaaaatgtgaaactgagtaccacacacagttaagacaaaagattggacaaccgtgttatggaaattgatgcttagctatttagctaatactcggatgtaattacaaaattgttgttcagaggaacatttcgggaggatatgcacaaacctactaggctgctatacaagccattagaatgaacaaacaacagattctgcgtatgtacaattgcggcgttttgtttcactacttgcccgctggtacagataggatacatgattaaagctatgtgatgaaacattcggtataaacctgtacatgactcttccaattccaagcaagttgttttgaaggtctgtccagtcgaccgggtatgcttctgtgttagtaaatgtttcctgttcacacttttttcagctcacgactggctatctctatttatcccgcgcataggctccctgaatgaggttgttacctggcaagtcaagttgccaggcccactgttatctcgtgtgagttttcctttgctacagaagtacatacaccagacatgtttatgtaaggagttgaaactataatatagacaagttagttgaaactataatatagaaaagttagttttgaactgttacttcatgttggactctctgtagaatatatgtggaatgcaaaagatgatataagcatgattttgataatccaagttacagcagttcgtgcagtgaaaagaaaagcagccatattcacagttatcaccacttgtgggttaaaatgcaatcatagtttcatacttgattctgtagacatttcgtagttcaacatagcttaacatctaggaaaaacaaccaagattgtaaagactactttgcacttttttagtgggaaaagcataggcacaaacagcaatgaagcataactcagattgtcataacagactgttatatgaactagtgatttcaattccaagggtcatttttacccctaaacttcatgaaaaaaaatcatgatagactgtaacttttttaaaaaagtaaggacttacaggatgattttgactagaatacctccgtgtgccttcacaagaggtggtatgctgtgcaccagttaaaacacgagataggcgtcggagaaatacttgaatgtggttgtaaatgctgcagcatgaagtagtagttaacacacagcacacatgaagtgataatgtaaactttgaaacactatataatcctgttatttattttgaaccactcgaccatgttactaaatcactaccagagtaccagtgaagttcacaacagaatgacatgttagatgaggcattaatcaggtaaaattctaattcgacagtcaatacgagatgttttctgtatatacctgatttcatatttaatgttcatgtgaccttgaaaatactaccacatacggatgagaaggaaggttacctaaagccgatgcctgttgcatgttgaaaagaaggcaacaaaaccatacagaatgcttcgaatcgcacggaaaatctgaaaaagaaagtcaaagtaagttccatatatcctatttcctaatataattactggccgcatcaacatatttttgttacctggtacagaagatctttccatagtgacccccagatggtagtttcagatgcaagtccggtcgatccggatgcagaaccaacttgatataaggaactcaatgtagaccaggtctccctcagaactccaacaatgtccacaaaagagtctgccacaaaacttgctatcgcaacaacaagccggaaaggtgcagctagaatttctccaagaagccaaacgaagggtacaggactgaatttgctgaagttaatacaaaagagaaagatatcagaatcaacacaaaaagtttatcatagtgaggtcaatacaaattgaagagcagagtagcagacatatcgtctcagaggttgcagaaaacataccaacattaagcacaacactgaagaccagccaaaaaggccatataatcatctgcattgtactgataactacactgcatgaagtctccatcgccaacatgataactgagctcagatgtcctactgtttcagcacaaaggttccatagcggcagggtaaattcaagaacctccaaaattggtcccatgattggctttgtcaaaacacttagagcagatttagtagcagttacaatcttaagagaccatgtaaaagcctgctggaagttatgtagaaaaagcatggttccaagatacttcagtcgtgaaatcatttcccacgtctctatccagtcaaagaaagggccaaacaatcttgatgcagttgccttcaacatggggacattcttgtagaggtcataaaatcctatgagaacagtaactattgacatcaagacatacaatgccctggcaagaggacacatccatgggcgatatgtcttgcagaacactggatatgactggagaaaaatgacccatgaaggaaggccatactctagcaatgttaacagcctcacatcagaaagtattacttcttttagtctgaaagggagatcgtggtcatcgaaccggaataagatcaacacatccttatatgtgctaggctcgagcagagtcttgccacaatcatcatcactgcagcacgaggaagatggagatgatgaatgtgttggtgaggtcacaacttcagaatatgattcttcagacatattatttccagcatcagatcttattatctttcttctcttggaaggtccagagcaaggaggtggtgtgtatgaggagcttgtaaaacttgacgactctctcatgcattgactaggtccagaatcgtcatcatcactctgtacattctcactgtccccttcaggtgttgagaaataattctgagcgtcataaaacacatttcctgtacagcaagcatataagtggtctgcacatgcagcagagaagaatggagagcacattcatgcctttacctttaggagagatgctgttcaaataatcctgtaggagctggcattcagagtaatttccagaaaaccatgaagtgattaatgatgaagcttggttgacactctcaaattcccatctcttcattgttttagcttccactgccatagaagtatcagtctacaacaacataaaaacaaaataagcatgtaccatccattaatagctatgaatatcatgttcagtctaaaacaatacctgaagttcattgaaatagttcatgccgcgcacatcagcccagtctacctcaaaaattataaagccatataaggttcggtgcagttccttgttcagcaggcgagaatccttcagcctattcacatgaagctttttattccgcatggcatcatcaattaaggtataccatctggatgatggattccacaaatgagaaccatgtctaggatctttagagaatacaagtttcttcccagtttcatctccctttctcctagttctagtgtttgcaaaaggtgaaagtcttgactggagcaaaaaatgacaagaagtcaacaagtaagacgagccagaatcgatgtaacaagggcaatacatgaaagtgtaagcaatgaacaaatattcataagtactcgtttgtgtgcttacaagtggctcgtaaaacagtaaagcatacctttgtgaccatcaattgccacaggtgagcaggttttgtgtcctggtcttgcagccatggccggttatcaagcaatatgagaaacttcttcgtatgagggcacaaaaatatagtaagttcagcaagatatgattgtaaatccctgcatataataattatatcagactaactaactgtaatatagatgaaaatccaaatttacattgcactttaagatcatgaggttagtaaatgcaagcaaaactgtgaggagtaaaacaaaacttgcagtttgcaagaattcttaacacaattgcccacctcagaaattaagataattgcaatacaacttaaggtcatacgactttgcacaacaaatgcagtccaatggatgtacagaaaaaggataaaataaccgccacattgttcactgtttgatatcatatgatccaggtggacaatagcagatcaaaataaaattaatcaggaacacagtatttaacattttctttcctccagtgtacggacggagtcatgtattgcagcctactgaacctagaagtaaagtaaagccacaattccagatttccagtcgataaggtatgatgaatgtgcacaaaacacaaaattatcaacctacgataggcaactaaacctaggaataaaacctagattgttttgcaaacaacaacgtgatggtatagtaagtttgttttatcatctctgcatgaatatgtagggagaaatgacaaaccctgaattattgaaccgttccagtatagtatcgatcctgtgcctttacactggaaacatctactaccttaaattggaaagatttccaagaacagctttcctttctactcctactaactttagtcatatctctcatcaagatatacagtattctgtaacaaaataaatgctactagaatgaagcaatacaagacaattcagctacccactcccacaagtgagctttcctgtctttttctcataaacagtatgctggaacttcctccaccaagtaacacaaacgaataaacgactgttgtagttttgatcaatttccactgccctttgggaaacaagcgtaactaacttcaaccgtgttcatcgaagttatccagttaactttctcgtaacttctcgtttttttcacttatatcacaacgggactacattgcattgtggaccacacaaattagcacccaaattatacgagactggaacattccaccaaaagcaatgaaaagaacgtttccaccgcgagatcaaaacagagcccccgcacacagaaggagacttacccgatttgcaagctcgtaagggggaagaaatgccgcttcccgccgctctccatcacgccgactccaccacctccctgaaccacatacgcgaaaacacgcaaaaaattccacatcaaacgggagatcagaggccaccacaaaatccaggcaaaggcgcaagcaaaaatttgcagaggtatctcgtcgaatacctgcgcagaggtcagaggcatcccatggtgatgcctatccgcatgccaaggtggccagagttaatggccacccccggtggggtaaatacgccgcctacctccccctctccaccaccacgcggggctcaatcaccaatggctcctcctcaaataccaccaccacgagcctccccccccccccaccctgcctcgcgctgctccggcgagaggcgcggctagctctccgccgctccgccgccggtgacacggcgtggtggtggaggcggcgaccggatcgcggcggggccccgcgccacaagccaaccaaccatccgaacggccggtacgggggctttgcttccgaggtgagatgagacggttcggatatttatatcccgatgacatgtggagcccgagcacgagcagggcccacctgtcagcgtgcccggatttgttctccggaggcgggtgcggtcggcgtgggggtgacgttgatggcgcggactttcacgaaacccggggggtggctgacaggtgggcccggagattgtgtgctcccacaagccagcgtgccgcgtcatccgcttcgggcatttctggtttccccgcgtcgaagcaaaggggagacaaatactacgtgccggcctacccgacgccactggtatgcaagtgacgtgtggggcccactaagattggacccatatgtcggtgagatctgcagcatccgacgtggagtaaggcgagtgacccatatacgtaattatcgaaatccagagtggggcactcaggggatcaactgcggctgttcggtcacgcggcgatggtgtgcgaccgatgatatggtgacacgtggaccgtgctgcaatgatggcgtttactgcagcgatgacgtgtggtgtttcgtgttcggacaggtgcacggagggctctaggttctaggcgccacatgcaaaggaggaacggcgtccgcgtgacgcctcgagcaccgtgtaacgggtttattgcatgtgaaattattggcctgtacgcccagattgatcatagataaatcaatgatcgtggcctcctggagaaaacaagctggagctactccgttcagacaagatccaaggaactaaccgtggaaacatgaacggtctaattaaaagtactcccttattctagcatttctctcatattgatgttaataaatttaaacatatatatctatctaaattaattaacattattatgaatgtgaaaaatgttagaatcacttacattgtgaaacggatgaagtagtttagagcaagtttaatagtatagttcactattaactccaattcatctataatcaatctaatagccaattcatataatagttgctttctatactattaatatatggtcccacatgtcatatatacattgtgtcttggagtccgtgctgtagctggctacacatctgtagcccgctgctcttctctctcatcgtttatctcattaaaatatgtttatagctggctaatatccagctattgtacctgctcttatgggaaaaatataattttgtatgaaccaaatctaaaaaacagaccatgataaaaagaaaaggatttgatttatctcctcgattatcataaaagtattatctatccccttaaactagagtatcggaaatttgacaatccccgagctattaaatcaacacgaaccaaaaccgtaccccttcccatgcgtaaaaaaaagtggtagttttaatattacgttgcaaacatatgacatcgatttcattacatggcaacctaatcacgcattttattagttttcttaccctcttatctatctttcttactcgctcgatcaaatatagggccgtcgctgtctacgacctccttccctgttgtcctctttctgtttcctgccaccaccttggtctttccacttacttttttcgatcaatgaaagaaaggtaattcgagcgacgagagggccaaaagggagaaagggaaaacctcctaatgttgtttgaaggaggggagcaacaaagaacaacacgaccttgtggaggaccacgttccgagctggctaggagggaatgaaggggaagcccatctaccatttatggggatgggagtgacagaggatgcatagtggcgcaaattagtggaggacggtggcggacatgcttgtctaggaggggatgaaagggaagttcgttggtgctattttaaaggaggggagggcgagtgaaaggatgactcgtaagctcatgaaggatggtggcgggcaagctcatatgggaggacaccgacagctcaagctcaaggagatcaaatcgtgtccgctcacctatgcatcaagtatgtcaaccttctcattcaccgaatcaagtgcttcaatgccaacctcaccatcccatccataagacacatcccctccatcattgtacggggacccaatgaggtgaaacttgagcgggtggtatagatctagagggcaaaacattgaaccgtcctcacaccacaacttcacatgctattatcaaggtccctccatggcttcacgctaccaaagaaggaggctggagcgttgaaaattagggcattgcctaggaaagtaggttggggcgtcgagaactaggacatcaccaaggaggggttggtgcgtcatggaagaaaaagaataacgagataggctggtaggtaggcataatgagctgatatttttgttgccatgattcatccagatttaatagttcggggtttaaaatatttaagagggtaaatcatacttgtaggggtaaacaaaaaggccctaaaatcaacaatgaaatcaagctttaacattctatgaaatttggcaataattgatatattaatgcttataattcatcaacccattaatacattgacttgtctggttgtagtatgtaaattgaactacatatttcatattttcgttccgtattggaccttagggtggtcatgatcgatctaccaacgttgccgtgataaaattatctatcaaccaattaatgtattgggtctttttgtcaactcaccatattgtagttcatataataacaactatatatataaattgctcaccgggtgtattgacgtgttgtgcaccagatagctgactagctgtgcgcctgcttccgttgtttgttcgaaaggcatatccggcgtgccgcttgcgacagcatcttccatctccacatcggcaacgaccagacgatgggtttgctttggaatcgccatcgcgttgcagcatgcaggccacatgggccaaggctcgaagcccaatcacatcttttcgttctttactttccgagaaggcccaaaataattttagcccgttgcggtctttactctttacgcatctgttctcgtgcgatcgtgcccaatccctcgatcctgtccacccagaatatgtctatttgacttctctaagctcttgctcgtgattaaatagcctccctcaacctaaaactgcatataacatctccctcatttttaaaactagtgtaaatcgacttattcaatggtttggaaaacgatttctgccgatgtggctggttgaccccagggctctgcagttgcgtcgccaccaacggggcgtgtaacatcgattacttatggtctccttggcgggatatgtgctgccgacctcaggagatagatggaaaggagaggagagaggaaaataaagagaggagagtggctgataggtgggtttaaccagctgattcagcgagtcaactataattaacatatcacgtctacaggaaccacttcctaaatcatcgaaagagtttgatttgtatcggtttttcaagatggggaagacattatattcagttttgctgttgagaggcgattcaatcaagaagagagataaagagagtcataatagacttattcctcccccgttttgcgcaccgacttcggcccggcccaacccagccagcacctctgccctcctcgagcctacggctacgaggcggttgctcgccgccccaataaataccccccgcctccccttccgagttccgagcaatcgatcgaaacgcttccccctcattctcgcacagcatcacacacgcggagtccgcgcagggagaccacgcgcgactaggcgctcgactctcggcggttgctccgcggcatcgcgcacccacgccgccacgactcgcgagagtagggtgcggaaccctagcctccgcaatgtcgcgcggcagccgcgaggaggaggatgaagaggaggtgtacgactcggaggaagaggaggaggatgagggggaggtggaggagaggggcggaaagcggtcacgcgggggcggcggcggcgggaagtggtccggcgtagagagcttcatcgacgacgcggccagtgaggatgaggatgaggaggaggaggaggatgacgacgaggactacgtgggtggcggcggcggccgtgcccgcaagaggaagagggcgtccatcctgatcgacgatatggctcaggtcgacgatgaagaggaggaggaggaggatggcgagttcgaggacggtgagtgcttcctggtggtctcactggtgtttgaactgtgaatccgtgatagaatcgttagattgatttcccaaatccgaaattacgaagcacagcgaaatcagcaatttcgtttcggtttctgctagctgagtcattggacgtagaatttgtgtttgttaattaagcgctaagttgagcgaaccaacaatttcaatgctagttccttcccggttaccctggataatcaactctgttcgaaatggtccaggtgtagattcattaaatttggtggtcaatttcgtattgattccatgttgttgcagttctatggttgtttgtggtggtttagtctcatctaatggcaataagaatcgagatttctgtttagcgatatgtgaaaacttcagttggaggcaaaagtttatattcattccgggatttttgtcataaattgggcagatttgctaggacaaaagtagttccgtcaaactaactcgacaccaattaggccttcaccaaccaagaagttaactgggcgagtgggcgtagttcattcaatcatctctatttaaagccacgttgccttgaatggcaggactctgcgacatgccaatatgatggactgaatttgctgctactacctattatcaatgttcaaagttgtctgaatacgctgatggcctgatggctgttctatgttattgtgatagatctgttaaaaaatcttcgtttcaaatgtgaaacctaattggaagatgctcctactctttgtttcgaatgcggcacagggaagatgctccaattaattcataaactaactaagctgtttacttgtgctgactactaacatgtgttaccttccttttggtattatcagattcacattgtcaaaatatatcttgtgttgaattatataatatccaaaagcaagttcaagtgttttaatgctgtcagctatggtccttcatgttttggtaggctttattgatgatactcgagctgacgaccctgaccaagatgtgggaagaagctctagacggcatccatcttctatgctggatgaagaggaggacgtggatgcacttgtgaagctaatacacgacaggtatataattccgtcatcacattttgtggatgatgacgatggtgtgactgaggttgaacagcaagctcttctgccatcggtgaaggatccaaagctttggatggtgaaatgtgcggtatgttgcaggttctatcgaataatgttctgctccacaatttgttttctgtataatttgatgctcactgatatccaattatgattttcagattgggcatgaacgggagacagccatttgtttgatgcagaagtccattgatacgccagatctccagattaaatctgttcttgcattagatcacctgaagaattacatttatgtggaagcatataaagaagcccatgtcaaagaggtacggtgcttgacctgacattgtaatattcctgctatgtgatgggaactaaaatttattacaggcttgcaaaggtgtgcgcaatatcttcgcttcaagaaaagtaactctggtgcctataagagaggtggctgatgtactctctgttcagagcaagtctactgatatttcaattaacacatgggtccgaatgaagcttggtgcatataaaggggatcttgccaaggtatggccatcaccacggcagtacagtttcttcatgctaacattttctgctactatttgattttatgacctccatcaggttgttgacgttgatgatgtgcatcaaaaggttactgtgaaactcattccaagaatagatttacaagccttggcaaacaaatttgtaagttgttacttggtataaattgccacgttttatgttcacctttcagcctaacatgccctgttatatttgtggtgatgcatctgctgttaatacattacctttttaggttgttgctgccatcatttggtatgatgttaggatttcctatctgatgtgattcactgaatgccagatgtattaatttatagtggaacaagtgaccatttgagtaaattgaaaattaaaaatctgtacgtagtccgtggtcatctgcatgctattatcctttgccagtgccgatgggctagcatgatcagtatttcccattttcaggatggacttaaggttgtgaaggagaagaaatcatttgttccaccaccaaagttatttagcgccaatgaggcaaggtgctttttcctccgtttgtaatcagtatgtattcatatatatttgtattgctgcaatctgctaactcgattgtaaataaggagatgaacattcgtgttgaccggaggaggaatagagactctggggaatactatgaaatggttgatggtttaaaattcaaagatggtttcttgcacaaaacgttttcaataaagtcaataagcgcacacaatattcagccatcatttgatgaactggagaaattcagggaacctgataatgacataaatgaggatgcggccagcttgtccaccctatttacaaataggaaaaaagggcacttcatgaaaggtgattctgttattgttattaaaggtgatcttaagaacttagagggctatgttgagaaagcagaggatgccactgttcatatccgatcaaaattacctggtcttctggtaattacttgcaaaaggaattttcatgtcattttcaatgtagccattacgaatttatacatctctttgtgtacctgcagaacacacttgtcttcaatgagggggatctctgcaaatgtttcaatcctggagaccatgtaaaagtggtgtctggtgttcaagaaggtgcaacgggcttggtagttaaagttgaaggccatgttttgatcattttgtcggacacaactaaagagcatgtgagggaattttcgtggacataagtataagaaactatttggataaacttccattatgcttttgactttctgatgtgtttatatgattacagatccgtgtgttcgctgatcatgttgtggagagttctgaggtaaccactgggcttaccagaattggtgattatgaattgcatgatcttgtacttcttgggtaagctcagaatttctaatgagccattgttgttgcttacaacattgaacggctatgtaataacaatgttcctcccattcaattttcagaaacttatcttttggtgttattataaaggtggaaaaagaagcacttcaggcaagaaaatttgtatagaacatttcacgtatgcctaatgatcttttgttcccatattttttgtgtactaacccccaaaatgcatttagattctcaagggagagcctgacaaacctgaactagttcttgtgaaactcagagaaataaaaagcaagatttatcggcgaacatctgcaaaagatcggtccagtaatatcgtgtcaacaaaggatgtcgttagggtcattgaaggagcttgtaaagtgtgtacagtttattttatttgtttttagcttttcatattatattctgttttagttttttttctgtcagaatatatgtttattacattatcccattatactatatgtctaatacactttgtcacaacagggaaagcaagggtctgtggaacatatacacagaggagtactttttatttatgatcgtcaccaccttgaacattcaggctttatctgtgcaagcgcacaatcatgcctccttgttgggggatcaactggtagccgccgcggaaatgtatgtttgaagctatttacctctgttggttgtcttggaagattttcctaaccattttgcttctctgatacagggtatgggtacagttgatccacgatttggtgcttttagatcttcagcaaggattttgcaatctccaggaaggctcccccctaaagcacctcatactaattgtatgaatattatctgcacagctccttgttttttttttatttaggctgcattgctctgctaaatgcaatagcaataccaattcataattgtccttcctatctaatgcagatggcagacggtttggaggcagagatcatggtggcaaagggcatgataccctggtgaatagatgtatcaagattaaatctggcccctacaaaggatatcgtggtcgtgttaaagaaatgacgggagcacttgtacgcgtggagcttgattcacttatgaaggttgttgcaggtgaatctttgttgtcatttgttctatttttggtgggaactttgcgcgcatttgtattaagaagggaagcaaaaaccaataaaaggagatcaacgagtacacctcttcatgcagcaatcgctgcggacacactacaactttcattcctgagctgcattccttccaaatccccactatttcttctgatttttaaaactatcttgcttcaaatatgtagttaagagagaagatattgctgacacagctactgttgcaactccattcgggtaaatttcttcctccttgtccgtatatttggaaagctgtttgatttcatttaatgactacttgtatcgacagtgaatctcataattcatggggcaacgaaacacctgtgcacccatctagaacgccactgcgtccttttcagactccattgcgggaccctggaggtgtgtccatcttacatgcattatggttattataaaaattaagacagctaagatcacttatttgttccttccgtttacaaatatgtagttttggacataaccgaagcaactttgactgctaaatatcagaatatgtttactaagaagtaacaaaaatgttgtattatgatcccaatgtagctattttgggtcctaagagactgggaggtttatctataatgtcataaatgtaaagtggagagaagtactaattccatggcactactttgtagttttgttttctttatgtcatctactcaatatgtaaaaaattaatgcggatagactttgctacttagtacttgagtactcagatggtgatggaagatttatatggaggctagtgcatctgtactgtttagcagcataatcaatggctatcatttctctactgtttaatcaacttaaactatatgagtagtcacctctttgtatcttgattggtgttgttttttggagggagcctttcctctcctgaatgcttatcaggaagcacttcgaaatgggtgtgatagatgtaattcagatgaacgatgtaaaatttgactggcgttgtgtcgttggccaaacgaaaatattatgcagttcatgctataaatggtatttactttctctctctctcttgcacacacacatattaacaaggtgttcgtcttttacagcaacaccagttcctaatggaatgcgaactcctatgcctagtcgagcatgggcaccaatgagtccaccaaggtttgtatgctgacattatgtgcaatttagttttataatgaaaatgaattatgttgtgcaagcgagctaattctagtataagtttattttatatagatttgttgttgactaattcaattattacaggaatggctgggaagatgctgtcacttgggaaagcagcccaacttaccaagttcgtcatgcacttatgctatttcttgactgctctttattttctgtagattagctttgggttggcaatcaatggtaagtttttgagcctctacatttcacttttgcagccaggaactccagttccccagccacacgaagcccccacccctgggtcaggatgggctgttacacctggagttagtttcggtgatgcctccggaaaaaatccaagctcatatgcaactccaacacctagtgggcaaccaatgaccccaaatcctgcatcatatctcccgagcacacctggtggtcagcccatgactctgggttatattgaaatggatataatgtctcctgccataggtaatatttttatccttcgaattcgttgcttctccagcaaaatgcattctacagtcaatctggatggtgatcgaaactatctagagctctggatgcacttatttgggtactaattcccaaactgctttcaggtgaggagggcggtaggaactggcttttaccagatgttttggtcaatgtgctcagggaaggttatgataccacctgcggtgtggttaaggaagtcctcccggtgcgtactatttttacatctacaagatgacccccctaattcttctttcactttcctacactgacacatccttgaatttaaactctaggatggatcttgccgcgtcgcacttgggtcgtcaggcagcggggatgaaataactgcttttccaaacgagtttgaggttgtcaagcctaagaagaacgacaagctaaagataatgtctgggtcttggcgtggactcacggggaaattgctgggagtcgacggatctgatggcattgtgaaggtggatggtctagagacgacggatcagacgaaaattctagacacggcgattttgggcaagctagcagcctgaggcaggccgatcctacaagccagacaaattcttgttcatatcttagtgtagcgagtagtcagaggtgtacatgtattttaaggtgtcctatttgtccctggatattcataccaggatacgctctcgtctcaaatgacaaatgatactgaacaagttgcgaatgccagctgcatcgttgacaattgatgttgtctgcccttggccatcaggtcgtcgatacatagattgctgtaccagtcattactctagaaagaaacggaagaactttttgcaaagagatttcacataaatgagaagatgacatcaagactcaatagcgaccaaacaaaagtacaataggctgtattttataatactaagtatccaagtcattaccgagagatgcaacactaatttatgctttcagaaaatctactacacggtgtcctgtcacaacgggataaactggataagatctctgccttatctccttcccttcccctccacaaactcactcactctctctctctggataaggccgagaaggctgagaagaagccagccagaaggaagggatcgtcgtcgtcgtcttcggcggccgaggaggacgacgacggcacggcgtcggtgaggtcagggggcgtcgggggtgatctcgccgcacttcctcgacgccgtcctccgcccgctgcggcgccgcctccgcgcgcacgctccccgtcactgccggcgccggggctgctgccctcctccctcgcgctcctcgccaaggtctccatcgcctgcttctcatgagccacttgtgccgccgtccttgcccgctgctcctgccgcctccttgccggtgagcgcaggtggatcctccgctgccactgtagaagcagaagaagccggcggtcccggtgcctcggctgccgcaacgccggcgacaacctgctctagaacctctacctcctcttctttgccatcaacttgaagatgaagttgctgcagcgcgtgttcttggagatggtcaccgttgacttccggccggacctcaccaccttcagcgtctgcgccacagccttctccatcaggcatcagtcgtcgtgatacctcagtattaggcctggtatccacaagtatcaggcctggtacaagattacttagtgtcaagcgctcttcgtcgatgtcgacgctatcctcctctcatcagtgttatgtgcaggtacggactgatacctaggtatcaagcttggtaccaagtactaggggtatggtacctcaagggtatcatgcctggtacctaagtaccatccagtatccatgggtaccatgtgcatggtattaggtaccagatacctataattatcaggtaccacatggtacctgatacctattgtacctgatacctcgagggtatcatgcatggtacctaggtaccatccatgggtatctgttaacagtgaaatttggtaagcccagagtagtcatcggcttagagtcagcatcggcttcgaagtcctgagattagccgatgagagttgtcaagtcgtcagttgtcggattcttgctatattcggttaaggaaattgatctactaaaggaagcttatccaaaagagaccgagttcaaagagaatgcggcatggcaagttatctattaattaggaatagtttgttagtttccttttatctttaggaaagtgtgtttagtgtcctataaggactttatcttttccttttatctttaggaaagtttctttcttgtccgacaaggacttgtatcaacccatgggtataaatatgtacacctggggtctatgtaatctatcttcacgatcaatacaattcggcgcatcgccaccctttttacttctacttttgttttacgttccggcggaacttggcacccggcgcggggctacatcgtcttcgatctccggcgaagggataagtctaatgttccgccggtccaggcaattgtatcgtctacgtcggcgtcgttcaaggctgcatcagtacattcgacctcttggattgctctggtttggatgatatatttgcctacctatttatcatatgtctctgttaatctagtcttagcatatcaatttagctctatcggctgcttctcgttttagggtttctgccggtatcggctaaatcgcgttgctagattagattagcttagacatctaccaccctgaaaactcggtcaacagcttgattgtctagatattatgtttcttttcatacttagtgttacatcagttaagtttgatctactaagtcgtgcttagaaccataatctctagcctgcttttgattgccactaagggtttcatcggggtttcagccggtgagttatctggacgttgcatcggctcataaggattgcatatacatataagttggatttagccgatgacaacaaaggtttcactgtttaatctaatcttgtggatttcatgacatcggacctccagttgatgtgtgctttaaccttcggatcgatgcttatttatcatatcattatctgccgattggtttatactggactatattattgttatattttattatcaacagccgattgcctttatatcatcatctacattggacatatagccgattgcttacaccctatcgctatcggctagtatcggcatcggctattatcggctatcggctggaactattccatcggcttgtcagccgattgactgttttgatctattatttgcatatcttgtcagttgcaggatcaaactgactggcacgctcgcatctaatcaagatttggacctgcacaggagctaagcaaatctctcagccgatgtgttcgattttctcgtcaacagtaccatatgcatggtatcaggtaccagatgcctagtacctaggtaccatccatgggtaccatgtgcatggtatcaggtactagatacctatagttatcaagtaccacctggcacctgatacctattgtacctggtaccacggtcaaaggtgggggaagggggagcacgccgtcgccgcctggctgaccggtggccacacgttcgttgcctcctcttctgttctcccttcctcagttcctctcctcaacgtttctcttctccttctgttgttgttgctgtcggtgggggcaaagaggaggatttagcgggggagttgtctgctgctcccgctgcttaggggcgacgacgccgacgaggaggtgtgtgcttctccaggtgcaaaggcaacacgacgccggcaagggaagcgcgcgatatcaggaagagccagctaggtatcgtgcctcttcacgtggacaacagggacacgggacgccatttttttattttgtcgtgtgttttaattatcccgtgacatcacttttccacggtatcttgtgggctagctgccctcttatgctttactccttccgtttcaaattctaggtggagtagtagtacttagtccaaagaaacgaacagaactgtttgaccactgggcacttctcagctcgacgtgatgggactagttcatcaaggactcgaactcgttatatccacagttaaatccgcgggacttgcacggaattgactgtgccttcgggtcaataatcttgatcgcctacagtgtaatccgacaatatctatcctatactattgttcaggttggaaaagcagcagcagccgctagcttggtgtgtcaaggcggctgtcaacaggcaagctcgagcgagctcgcctgtctaggcttgagctcgatacaagctcgagccgagtctataaaatgttcgacctttcaaacaagctcgatttaagcttgagcttgatttttaattagaacaatatatattttaaaggataatctttttaaaaataattaatttatgatctatcgtagaagaggaaaaagaataaaataaatatatgatgccaatacaaggtatataaataacatatttgatctacaaatttattaaataacaataaaaaaaatctagaagctcaagctcggctcgacaaagctcgcgaactttaaaataggctttagctcggttcgttaggagctcgagccgagctcgaatcgaacttaggacgagtcaagctcgagcagctcatgagccttgagcttttttttttttttttttacagtcctacgtcaatcccgtgccatgattcccatgaacagcgccaggtacccgacgagccaaatcacaagcgccaggaacaggcgcggcaatgacgacaccggctcggcgtacacgccaatgatggccgtcgctccaagcagcatgaactggaacgcgtagacccgctgcatcggcggcctgcggcgggcgcgttccgtccttggtcctggcgcctccttggcgacaccgccggcgtcgttcggagccatgggattaggacggatcaatgcaccacgagtccacgacggccgacgccgccgtgggatgtgtgagtaatctgagtgagcgccgcgagacgaggtgttttctttccgaatatggcttctgttctgggcacgaactctgattaccttatttatagctgtcggccggtatggcagttcgggtgtgtgtgcccgtacatttcgtgcgatggatattggctgctgtttgtctgcatcctagcccttgggcacctgcacctgcagcttcggcgcagcttccttcgcgggatcacggcgtccgcccgttgctttcacgagcgaacaggtgacagtgacctgacctggctggcttcaatccgaggtgtctccacgtctgtacatgcacacatggcgcatgagcattcgtcacctgctcatgatttctcgcggcaaaaaacatgggggtggcttcagtcaagatgcagggtcattagaacaggtcgtgaccggctaatcattctgaaacttgttaccattagtcggtggcgccgaaatttccctgtaatctcgttcatttctcgttcgctggtttcggcctaacaagacaaaccagcggttggtggagcccaagggtttgggaattctgctgtacgtcactcgagaacaaatattcattgccgacccatttaaacgactcaaatttgagtattcttacagattagacagaaacaaataaagatagtgttattttttatctgcctgttcctattctagaactttgacccttgtatgaatagccgtactttatttagttttatcataagaaaacaaaatgctaccagcccatcaattaaaatatatgtttggcttctttggagcgaaggaaaagtggaggaattttggaggactaaaattcaacagaaaaatttcccacatggtcctttggagaattggagtaaatgaatggcttctccgaaatcatttgattatttcatatgaattttggagaaaaactctttgaattatagaaatgaaaaaaatggaggaataggaaaaatacttgattcagataataatacaagtataaaacatagaattgcaaaacatagaatgatcatttgattggaccatatagatttgagaaaagataaagatacaaatgaaactttccatgagattctactcatgttaattttcgtccaaaacttgcatggaatgagacattcttcatataattctatagaaatgaaatccttcaaaattgatatgattttcctttgaattaagggggcctaagtccacttgcttttctataatgttaccagacaacacttttttgcaaaaacctcgtggatttagtccctttgagttcctctgaatttaggattatggcacggcatcctaatcctgagattttcatgcatctcagggtttacattaccggttgaccactaaatttcgagccccatcggtatcacggttttcgataaatttcgatcggttatcgataaatttcgactgaattttgaccaaatctactgtttaaccttcgaaatttcaatcaaaacttaattccgagtcatgtcgaaacgtcgaaatatcatggaattcgacatgtttttgtcgaaaatgtgaaccctattctcaagttctcaaccaatctagaatcggcccaacccacctaaaacaatccctctccgagttgggccaaaagttagcaaacccatctgtagagcacggcgcccctttcttccccagggatctccccctccatccggcggccgggcgacggtgcgagagagtagagagagacccgagcgagagtccgacacggggccagcaagcgctgggataatggcgacggcggagaaaaagaggcctcggagcagaagcggcggcggcggcggcggcggcgtggagaagaggccgagcaggaagcaggtctttatatttctctcctctcctcttgttgatggggccagtatcgatagctcgttcgtttcaccctacccgtagtcgattactcatggctgatacgatttgttttatattccgcgaaaccgaatagctgataagattttgtgtatttttttagtagatggtgtttggcacttggttatgtcagagttcaattagcgcgcacttcaaaccctacaagtgtgtcgaattcctttattttcataaactgcgaaagctgcagtgtcaactttattagactcatgtgttcttctgttgaatacgtatgttgcaacctctagatttttgtcaaaagttctttttttaaacttatttggtgggtggtttgtcactcctgtcaccgaggtagcatttgaggagtaatagcggagatgtatctaatatcagggtctcattcagataatcttctgcctttgcctagatattggggagaaagaaggctgttgaagaacttatcaggaaagctgtagccgtgaaggatcatctagcgcaatttcctgattttcataagtatcagagaaatggtaacctacattgtctgttggtgaacaaaattcactaccttaggactagtaatgttccatcatgatgtagaaactattaatattcccagcgaaaggaaaaaaaactcctaatgtcaaatttacctctataattccaacactaggccctaacaagtcctattcagtacaatgcaattttcttatatgtgtgttgtgggcattatatcaatctcaccttttttatgcttaggtcttttggtctacttggagtctggacatggaaatcaacttccattatcaacaaggaagtacatccaaaatcttctcaaggtcacatatatttctctttcattttgctcttagtgctgctggatattttgcatatcttccttttacagtttccccataaatattgaatgtaatgctagaaagcaataatataggttaacatggagggacaatatgggccagaatggccttcagaagagaaaattaagcgccgggaaatggttgccccagaagcacgatatatctttgtccggcaatcttcaaatgccattaccacccaaaatattatgaagcaagattccgggctagaatttacacatgaagcatgtaatgaagatcgcttgattggttttgtacactacagatttgttttggaaaaaaatgttcctgttgtttatgtctatgagttacagatggtgccttctgcacaggggaaggggctgggaaaatttctaatggaattgattgaacttatagcttgtaaggtaatgtgacttgtttaacaattactgatggtttactaaaatgacctgctcaattttgtgtgtacatatttccagaaatattatgcgtacttatattcttctatgatacctcttattccttcatctgtcttatcatgtacattttttagcataaaattgctatctgaaatctcagcatgaaggatcagctgattttgatggcgtgtacatgcagagccaaatgggagcagtgatgctaactgttcagaaagctaacaaccttgctatggctttctacaagaagttgaggtgaagtgctaggcttgaatatttcctccacagtttatttatgctaaatttataccttatcgttggtttgttaatattgcagtgactgctggttgaaacatttcaatgtaactcttatcctgcagatatgtaatatccagtacttcgccatcacgagtagatccactggtattgttttgcctataaactatagtttttattgattaagatgttcatatcgtgatccttccagtgtctacagattgggcttgaaaaaaactatgagattttgtgcaaggcatgtgaatctgaagctaagtccaaattagaggtatgcagcatgttgttcagtgttgcataaatttactgctaccttcttgcaacttctaagatggttgagtctgatgaatagaaaaaatattcgccagacaggcatattaatcattcactaaattctttatgagttggctgtgttgatcctttttcttagtaacaaatcttctttgtttagtattggctatatgccaattactcactaatgcataatgtggtgaatttgcattaatatgatgtaaaacaagtccttgatatgtatttttgttaatatttgcaggaaggcaactgaaaactccctgcgcaatgaccaatcttgttaaaatgtgatgtgatgatggatgttgttctccactacagttttgacaccttacagggtacagcactacagctcatgcttgagcggccgcatatcgtcaggacaccatgttatcgcaatgcattcagatgtattgcacatttgcactgttcttgtctgaatgaagctgatcctgctaatccatcctgggaaacaaacacgattggctggcccatattctttccttgcaaaacgcaaatgtacatctgcacgatggagagcatatgaaggttgcatgtcgtaggcttgagacgacagtaatgcaactttttgcaaactatggatggagattcacaaatagacttgaataaatgtatactccttatcttggtttggtcttttattttgttggtgtgtttaatttcattttgaactacgatactttgtaataattggctgtagctctgatgagcaaaggctggaatgtttcattccattatctaaaaaaacatctgcacgtttctcaattttacttggaggaaacatgctgttgctgtatggtcgtcaatattacttcaggtaggatggcagatggcaaattcgcaggcacgcatagatacgaccccgagagctcaagccgctcaaggcgcgttgtcgcgcttcttccgcggggctctcttcccccttgtgacgatgatcgcgtcgccgctccaggtctccacctcctcctccggtccgggtgcggctcctcctcttttgcacatccgcgcctgagcaggagacgcttgcgcggcggcaggtggtgctcgtccccgacgccggcgtcggcgcggtgctccgtgcggcgcagcccgcagctcgcgcatatgcgccgcctcatcttgatgggatacttgcgctgtttctccgtgaacgcgccgtcctcctcgccaccggcgaacgtcgtgcacacaggggtcaaaggaagcgagagcgacctattgctcgtgctcaacatcgtcccgctccactgtagattaatctaagttcgatgtggatcgtattgcctctcgatccatgtttttgtaggtctaaaagagctcgggtttttctgggatgaagaatgcttgagcatgcatggggcggcacagcaccatgggaaccgtcttatgattgttgcgtgtgaatcaaagcatgagtttgccctgtgtgcgggcgttttgctttcgtttcctgacgatgaagacaaaccatatgtctcggttcctcgtgcgagaaacgagagccacatcgttcgggttttccggttgctgcccatttggtgccgtgcgtccgtgcgtgcgcctttcgtgtttttaacatctcgcaatggacagtgccagaacgcagcaacagaaagtaagcgtgggacgaggatcaagttaaaccagacattaaaaccgtcgtccgagccacctttagatcttgcttatactagttttaaaagttgagcaacgcatgcttatactggttttaaaagttgagcaacacattatatctagtaattcctccgtcccaaaaaaagccaacctaaaaagggatgtgaccctcctagtactacggattcgtaggactaggaggggtcaggttggctttttttagatagagggagtaccgattaaggaaacgatttaaacccaacctcaaccgaaaaccatcatccgaaccgtcttgagatattgttttcactgattttaggagttgagggacgcgtcatacagtcatatctgatactccctccgtcccataatataacaacctaggaccagataaaatatttcatagtacaatgaatctagacatgcggcctgcccagattcgttgtactatgaaatgtcacatcctatactagattgctatattatgggacggagggagtagaggtttagggcctgttcattttgatgccattttcaaccttaccaaattttggtaaagttgccaaaaatatgtgtacgtttagtttcctgccaaattttggtaactatataagaaatcctgccaaaattttggcaagttaccaaaattttggcaactatgccaaaattttggcaatttggtaaagtatttttggcatcaaagtgaacaggcccttagacatgaattttagatttggcgacaaattaagggatctgaagtgaacttatgcccccaattatctgtcgatctctcacactcatggaggcccaataaacttatgggctgaatttagttagcccaacaagccagagtccattatcaccgtgggcccgacctcttcgtccccctcggctctctctcctccccctcggctcgcaaccgccatggagccatcgccggagattccgccgccgccacccgccttcgccgccggcggagaaggcgatccgcatgctcccaccacagccgccgcccgctcctcctcctcctcctctctatttcctctcttccccctctcggcgcccgaggaatcctccgcccccgcggcggggtcccagtggctctcaaaccctagcttctccttcgacgcctcctccctcaacatccccgccactgcctcctcatccgtaccgccgccgctaagcgcctcgtcggacgaagaggaggcgccacggcccgcacctgctaagtatgacctgctgccctactcaccgtcgcctccggcctccgacgaggagaggagggacagacggaaggataggaagaggaggaagcggaggcgggagaaggagcggtacaatagcgcggaagcctcgcgaaagccgggggttcgcgcttgggctgggtcggagacgaagttggctaaggattactacttcgacgccaagggcgaccaggataacttggcgtttggatcgatatacaggtcaggtttttgcatatgaaatgtgtagcaaagctgaacttgcattgtcatctgaagttaataatcaggcatacgcactgggtttgttccatttttgcggtatcaggttccatttgaaaaccatgggcgtttatgttaattgcgcaattccatgaaggtgtgctagactagctgctaaagtggcatgttagatgttgtgcaggcttgcttctgtttagggcatcatcagaattctcagtatcaagtttgttttcctagattcatagctacttgtttaaacatatttgttgtgatctctgagggaaataaataaaagcctctgggctaattgagttgcaagaaactgttaggcaaatttactgaactcgaagctcattaatgtttagtcccctttgaagttaagtgggctgatttgatttcgtcttgagaaaagcgagatctgatttaaatagaatgaatcagcttacatcatgctttggccagaatattaatgcttagtgtgattttgtgactttccatttttttccttggttcatgagttgattctttatttttctgctttcttcatttttgtttagtttgactgtagatgcatttttcattttactgaaatttgacacacaagaaaattatgcagaatggatattgcacgctacaagtctcaaaacatgccagaggcacgtggtctaaaacggcttttgtttcataacttgggtgtctcggtacatatgggtcatgagtcagatttagatggactgaatagcaaagcaagagctggaggtcgctactactcggcgaaatatgcagttgtagaaagaaataagggtttcaaacacctaaaagtattgaaaaaggataactctgcaattctcccagaagattttatccccctagggataccatctcttcctgaaaataacactactggggaacaggaacttgaagaatcttgggaagatgaaatacttcggaggacacgagaattcaacaagatgtctcgggagttccctcacaatgagaaaatttggttggactttgcccgattccaggtattaccaatttgtctgatgttataatatttcttttgtgaaacagtgcatagtgtgatccacattgttgttacttttatgggatatcattagtagttacatagagagttctaagatatcaaccttattaatataatgtttcttcattcaaccttttccttgtccgctctttataaatccactgaagaaattttctctgctactttttacaggataaagttgccagtactcaacctcagaaagcagcccgtttgcaaacaactgaaagaaaaattagtatattggaaaaagctgtagagcttaatccagataatgaagaattattgctttatcttctgaaggcatatggtgagagggatagcacccagaatctcctggataaatgggagcagatactcatgaaacacccggatagttgtaagttgtggaaacagtatctacttctgtgtcaaggggaattctccagattcaaagtatctgacctacggaagtcttacgcttatgcagtacaggctttatctgcagcttgtactaagctatgtaggcaggttcaacttcagtgtttctttgtatatagttcagcttatctgctccccctcccctttttctatccctctctcggcatgtatgcactgttagcgagttaaaattttctgatgtttattctttctttctttttttcacaggatacacaatatgatcgtctcgaacctaagtattcttccttaattcatcttgaactcggtctagtggatatatttgtgaatttgtgtcggttcgaatggcatactggacatcgggaattagcaactgcactatttcaggctcaaatagaatttagtttattctcccctccccttcatctgaccacaagcagtaagcaaagactctttgagcacttctggaacaatggtggtgctagaatcggagaagatggggctcttggatggtccagatggttggcaaaagatgaggagagtagacaaaatatagatatacaagaaaatacccaagaaactgaaaggggtggttggagtggttggtttgatccttctctaaggactaatagtgaaacaagcaaagtggaaccatcgacatctgatggaaatgatgcagaaaatccagatgatgaggacccatctgcacaagaagatgttgaatctttgctgaaaaagcttgggattgatggagatgctgattacaatagtgaagttaaagatccaaaaacgtggaatagatggtcatttatggagttatcaagggataatgaacaatggatgcctcttcatgaaaaacttggtacgttattttctccttgtgtttgtagattgacaaatcacattgtttttttagctaacccagtacttacactggatgccattttcatggacaggatcactttattctgatgatgctccaactggagaagacaatgatcagctttccagagtaattttgtttgaggatataactgagttcctgttctctctatcttctgaagaggctcgcttttctttgatatgccaattcattgatttctatggtggaaaaatttctagatggtaatttcatctacttcttttcagataagctgttgtcattctctgtacgcaaagtctactagcacttgtacaataaaaatggcatttcgacctcagtgaaacagcaaatattattgctcattttttaaagatgtgaacgtattccttaagatcatcactatatgggcctttgaaagaacatactaatgatagctgtaactgtataatgaggtgtatgattcaacatggcaagtgcatcttaattttagacttgtgctgatcatgttgatagttttacttgaatccagaaattaaggaaaatagatggtaatggtattactgcccaggagtttatagtccttgcaagcaaacatttggacatgtaggatgaaaacagagacgatggcagtgagatgtgaaatgtgttatatcagccttgtcctcattttatgtgccttaaaaatctgtattaattatgagcagttcattgggttgcactatgaataagttgttacttttcacaatttgtttcttgccattttcatattgttgtgtaccaatgagttaactacaggatatttttacattccaggacatccaccaacagttcaagttggattgataggaatttgagcctagagatgattacagatgacattcaggaagatcttagtacggtgtctaaccttatagacaagaaccaaacttcagttcataataaaatggtgtcattgttaggaactatgcatgaattttctcaaaggcctggcactgcgaaatttctgaaaaatgcaatattgcttttccttgatgtattccctcgtaatcatatcctggaggaagctgttcttgttaccccccaaattcatacagctcaagaaaaatatctggctactccagccaccgcatcccgggctttggccaaaaatctattgaagaaagacagacaggtatgccttgttccgtatttttggcatcacttggctgagtagcataacaggtgaaaactaggtcgttagttgtgcaatgagcatacagaaaccggtagttttttcatgtgttttaagctagctagttgtgcattttatgttttcttgaatacgtgcattgtatttaatctgcgtctcttggtagactggatgcatcatgcagtttgggaaccaaaatcaaactgagttcttcagagattgagacatgtctcttcaattcaataacatccatttcatttaactagctcaaagtatttcaacgttcatcttattttggatcttgcttttccaacagttccatgtgtgcatttttttaatatttatatacctgcactacatgtatcagtaaatattcttaacagtgatacttggagcacgacgctcttttcttttgaaataagaaaaaaaaactgaaccatgtcacctttttcgggtaggatcttttgctttgtggaatatatggacgaattgaggctatgaatggggactttgtcaaagcaaggcatatattcgacttggcactatcaacttctcaaggagcttcagaggtaaaaccataaagtaaatgaatcagtatgttcagatccaaaaatacaatcaatgttgtcattatgtctttgtaatgtgccaatgctgctagaaatatagatcagtatgtcaaatgggtctcactcactacctcccttccaaattccaatatagatgtagttctgtatattgcaatggttctctgacacactgctagcaattatacccttcttttacattatacattgataagcattataaaatgtactgcctggaattagttactgtgagaaacaataacatgatatctattagtgcttaaggtttgaaaagttttttttgaaagtgttgaaagtttgactgcgcacctcctatggcaagtagggaacctctattttggaatagaggtactcactcgttttcacaatattattttcaattccaccatggacacaaaccaatggtcaccaacttagatcacatgctataactactcaacctattcgcaatattatgttaggggtagctactattatagagtggacattgtgacacttggttttctcaatagacaatcattttgatgtggcctgttgcaagaaaattggctaacatatttttgccattcaggtttctcacattggtctagcagcaatctcgtggttgagttagaataggtttcaagcaactttatgaaagcatatactacgtagttaattgtcttgagcagtttatgttattggaaaggaaacaccacatcggtacttggtcagctatgtcaaacatagttttattgatttcagggctctattcccagcacaacaatgtgccttatatagtcttctattctagcacatttatttatgctcgcttctgctttcgttgggcaggatctcaggaagaaggttcctattctttatttttggtatgctgagatggagctagcaatatatgcttcaagaaacaattctgactctgtggatcgtgcaatccacgttctgtcctgcttaggggacaaggcgaagtatgcttcttttgatgggtctatatcacgacctcaggtgttaaaggctcgtcaaggatttaaagagcagattagaagcttgcgatcttcatttgcaagtgatggtatgaaagaagagtctgttgctctaatctgctcagcatctttgtttgagagtatgacatctggttttgcttctggtcttgaagttatagaagagaccttttatatgacaccttcaggtatttcatccttcagcacctttttcttgataatctgaatgataattactcatgcctttacttttagctcatgtgtatgtttatttatctataagcggggcgagttgacttttgtacaaattgtagccattgtttgtcctcccatacttttttctcaagtactagtgatagtctaatagatactgatcataaaagcaaccacatgctaagccattacattttctgttcctttaattgttatatattggctatctaccatctgctaactattgaattataacctgtctttagggctctgttagacgtattttttagtttgacatttgaaattgttttcatgtatcttgctaaactcttagatattttacaatcttcaataaacatacctattttctgactggaagtgacaagctcctttctagtactcccaaggctgctcaggtgtcaactacagcttttgataccaagattttgcatgaagtatcaagcttatttggatcacaagtctccacccatagtccaaattaactagcatttcactgtagatcttacatttattttatttctgcagtgcttgatagttcatgattttatttatccttttcatttactttgcttttctatgtctgtaaatatgtattattattctcatctgtcaaattcgcaatctattaagcatactcttatcatgatttttcagagaacaaccatagcttagaattcgaagaattgtggatgcactacatcaagcagcttcagaaaaatcttaatcagttgagtctctcaagggtttggccaaaaatatcgcaaggaatacaaacatatccgtacaacccaaaatcatatgcagccatgttaactctaggttgcctttacagtgtttccaataatctacgtctcacactcgacaaatttaatcaaaggtgagttctcttccctacaaaatccataacacactgcttttattacatgctatggtgttcttctctgacaaaaatatggaatatattgtgtaataaggtagaaatgtaattgatcctgctaatgattctcttggtctcctttagcaatacatttttttgtgatgcttttcacagtatatagagatacatttgtaacctgcgaacttcctgacacagtaaacagtatatatcaagtatttttttttcctttaagtagccagtttgggtgcatgcactcttctaaaaatatcttctgaagtgcgcatggtattgcattgcatatttactgctctttgtcttttgattttatcagggatccttccataattggcttgctctttgctttgtcctttgaattgtgcaaagctggatcagacaatagaatacacaatctgtttgagagagctctgactgatgataagttacagaaatccgttctgttgtggcgctgttatctagcttatgaggcagagatagcttgcaatgcttctgcagctcggcgtgtgttcttcagagctatacatgcctgtccatggtatggtactgaaatatgttgtcgcaatttgatgtttctctggttatacttacatgattgcttattctatcatccatctatatccagctatttttatgtagccaatttggaacaaagatcatttatatgttttttgttacatttgtatcttatacttacactatattactagagtacagaagagatctcatcagaggataatgggcacctgaactttgttgtgctattgcccttacagatagctaaatgtacaatagagtataaagtttaaataaccacacttttttggaagaaagtgctttgacagtaaattggtgttcttgcaaatatggttgctctatgaacttgttacttggaactcggaacttgtagcttctgccttttcttttttatttttttatcaaaaagttccatctttaattgtgggtttgggaaacacagttctattttcatgttattttagctgctattgttttctaatattaaacatttaaactgtaacttgagtgatggccaaactaatgacaattggaacttggcactcataacaagacatcccactttgcaggtctaaacgattatggcttgatggatttgaaaaactgagttcaattttgacactgaaagagttgtcagatctccaagaagtaatgcgtgacaaggaattgcacattcgaactgacatttatgagatactcctgcaagatgaaacagatacgtgatgcagctatccctgtttttgtccataattcgagatctccatattatctcaaggttccatcttgcaactgaagatcggttgcatgtgatcttttaactcataattgttggactctcaagatcggttgctcaggaacctttatgtcgcatggaatgtgatctggacacgatgtacatccaaagcatctttagattggcaatctcgtgacatattaatgtgatttattttctgttcctggagacatatgttcggcttgtgtctggtcactccaatccttgtatttggttggctcatgcttcttggaagggcacaactgcaggaagaggtcaatatgaagtaatgatggaggaaagcatagagcggcagcataaagttgaaattgtcttgccaaaatggaacatcaaaagctggcagagaatcgagttgataaataaaaaattactgcgtcttcaggcaagtgatgctgtattttacagcaaatatgtttttttagtttcttcgtcattttcttactgcacttgctcatggtactccttgtgaaagcaggttgggggtatttatgcagtaccctagcgtcaatcaaaagcctggagtatgtcttcatttatcatctttctgcgattaaacgatgcttgtcctttttaaaacggaaagaaggaaagcttagttctgaacataatatactaatattgtggtatatatgtgtacaatgcttgaagtgacacatttttttttgaaaaaaaaaagaaactaccgtaaaaatatgactcggtaattacaaaagagggttgctagatgaggggtgcatactacctcttgttagctgagtctgctgcagcaaatgatgttagtaggtatagttgtataccatgttctcgtaggatactgtttactctttatttgttatgctccgctgctgtgatgcctgcgtcctatactcctagccaaacgcccacgcgatacggcgatggtggagagaggccgataggctatagcgctttcgagtattcttgtattcgacggtccatttgcagttacacgtagcaggtttattgattgttatgtgctgatactcgctagttcattgccgatcttcctcatcagaatccgggataagggacttcctacgcaggcacctaaaggctgtgccaatatacatcttggtttatgcttggcatgataagagggttgaattgaatacagtactgaggccccgacaaggtaacgatacaatgcagtcttccatatgtaccataccttgatgcatcctggtgaatttgaaccctcctcacccacaggatgtggctatgtattaacaagggtgggtaaactaactcccccattattatctaacttcctgaccaagacatttgtccgttcagttctccatataattggttccttcacttcaccctctcgttctgatgatggttatggtgccctttcctgccgtcctgatccttgtgaggctaacaactgctttgccggacaggcctagtccatgagcgtacacagcagggctgcacgcgaactggccgactgggtgccggaccggcctggctggccgcttcaggatcctctggttgacgtcgttcagcgtcgccgcgccgccgccttctaaccccagcggcttgacaactgcaaacgggtacagcacgcccgtgtccctcttctccttccctgtgaatgaatgaccaagaaatttcttttacacttctataaacatcaacaaatgcaattcttattattaaggggggttgaacagtaacaacatgactatttacttcgtccgtcccaaaatacttgtcattctagatagtttagcagggactaagatttcagaaaaaagactataataccccacattaaatggtatatatggttaggagtggagtagtagtttaggggtagaaaaggaagaaatttgaatatagaggaatggatgtgacaactagtactttctagtgataaatatattggaacaaattttgaatcctagaaagacaactattatgggacagatgtagcattttacttaaaaaccctcttcatttatagaagctatactatgaaggagtaaataacaactgaggggggcaatcaatagatgcggcctgccatgcatccatgcatgcctatgaaactgtttaacaaggcaaatacgttcgaaaccacatctgcaagactgcaagcactgctgctccccgccccaatccctgccaccgcctcagttgccacacatgcgcggcgagtgataattgcccaccggtcacccacccacccccaccccacctcacctcacctgtcagcgacgaggagcgacgaggcgacgacgcggaggcggcacgagaggacggcgatggctgctgctgctgtttgcccacgatgacgtgctcctcgcaggagtaattgccgcggcgccctggccgccctgccgctgccgctgcgtggcccgcgcctgctgcactagttgccttttgcagctgcagttgctgcgcagcgccttgcccggtggtggtgcgagaggtggcgggcgaggagttgtggttgtggaggatgggatcagctgcctctcctcctcctcctccctgcgccgctggcacctgcactgctgatgttgctgctgctgctgctgcgctgatcgggcccctctgctcctgctcccaacccgatgcgtcgtcctcatctcctgcccaataaacagggtcctaagttgttttaatgcaactactttgacactaagatcagatgtactaagtttgctgataattgactgtgatgagaagccgacagctattttgtctctagctgttgttgcttagcctgaagaaattcagccatgcagtgacgaggaagaactcgatcggagatatgattaatctggtgtttagatgtggtagtaaaagctgtccgattgaaaaggacgtgtcgatattcataatcacctgagacaaaactgccgctctccgggatcatgatattcaattcatgcatgagacccccctcgccgccgctgctgctggaatcccagaagctctgtgtgtggcaagagcaagcaacaaaacaacagcagctacgagttagctagagcaaaaggcgaggaagaagacaatcaggcacagcttgctttctgcgaggagacacgacgacgctgcactgctcttttgtacgtaagtatatgttactgcatatatgcgacattgcgacaatggagttgtgcctttccactttgctgtgatctctgttatgttcttagcactttcgttctactcgagattaattactactgctacttggaagttttacaggcaacaaaaaagtttcagtgatctcatgatctttcatcttttttaaaaaagctccagtaataagtaaccactactaaagaatgaatatattgtctaggcgccgagctagctacccactatagctacctgaaaacgcaacaagttcttgcatcaatgaatctacgatgaaccatgcatcatatatcttcgatgacgggtacattgtccatgaatgtgttgatggcatttacctgaagaaggcagtgcaggtcctcgttcgccgccgccgccgctggccgtcgaggcggcgccgccgcctccgccatcctctgccgcttattgcaacggtcgctccagtgcgcgacggcgtcttgcaggtagccactggacgcctccgacgacgacgactccggcgactccaaacctactacacacaccaacgaacctaagctcaacgacactatctcactagttcactacacaaacatgccctagctagctagcttgcaagcaaaagaggaaagcaagcgtatctgcgtatgcatgagtctacgtatatactgtgtgtgaggtggtagctagtagcagtgggtgtgtcttacgcatggccggaagaaaggcgccatgaatgccatcttgggcggcgtctcctcctcctcctccaagtgtgtgcagctgtagctgatcccaatcccaatccagctgaggaggaggaggaggaggcagcacgaagtggtcgtcgacgtagtaggagtggtagttgtctagggccatggccttactctcctttgccctgttacgtcctttcgtgtgtgtttatgtgtgtgagagagctagctattatggctgtgcagctgaatgctgatgaggctggggcttaaataggaggcaactttcgtggcaacaaaagctgtgtcgaattgggcggatgggaatggacggaattgatcaataggaggagccaggcagccagcaaccggtcaatgggaaaagaacgaataaacaagagcaaaagagcaaaggggaaaaagttgcggttgctggatggatagctccatgcatctaggcctttctcgtgattcgttatgtttgattgccctctccccctttctatcatcatcggagaatgttgccagcagtgcattcaatacattgtgaaattgatcaacagtgtccatccatatactcgccgagatacaaaagatctaaaatagatagatatggatagtacattagtacttaaaagcaatgtagacagtttgttaataatgtggtatagtttagtttgtgtgacatgtatacaaccttagaacaaaaaatattaaacgtactattttttttaattaaactcttactaatattgatgtgctatgtcatatatctagatttcttgtaactgtcatctagttaattcaaaagatttagatcaatgtttataagagctctgttaaaaaaagtttaagtacgtgtaacattgctcttttagggctaattggctaaaacatgaatttttacggaattttcacgtgacttaactcaattatcctacaaaaatctggtaaaatcatttaatccaaaaggaggaggctttctatatgttatattcatgatcataagctatttctatgtattcacaaaacatttcacgccaatgccatcacatgcaatatttgacatttgcagtagaggaattaatgccatcaagtgtgaccgaggggtggtaaagtaaaattgttgggtggggagagtaaaaaggagttgcaagtactacgtgactgttgatgtttttgttcgtatcgctgctgcaccagacggggacagcaccggtagctttagcattctttcatgaaaatctttggacgaggccaagaaaatgtgtttgctatatttctcctttttactgtaccataagttttgagcttctgccattactgccatccttggacaactgcgagcttatcatagctctgtgtacttgttacagaaactcctttgcccaacccaagtgtggggcttcacatatcaccaataatgaccaaaagggtccacacaacaatatcactatttaagatactaccagtacttaaaagctactagtagtattggatgatgtgaaacatcgaatttcagaggatgatatgaaatgtcaataattaatatgaaatttaccatgcatgcatggttggtaaacctaaagaaacagacagagaaaatatatatgtggtgtgatcattgacagattaatctgctggtgtggtttgttcatcaatcatctatatgcacaacggcacaaggaaatgaccaattaaagaatgtaactaatctgaagttctgaaccagctaatgaagcaaagaaacgtacatattgatcaataaaaggcatggtccaaaagggagatcaatcaggcctggaacagaaatgagttccccaaagggggtcaagaaagggtacgagtacttagccctgacatgaatccataagctgattcgacttttggtgtaaacccatgagttaattttacagagaaactatcgacttggaagtggaagtggcctcttttgcaggtgcgtgctctgctacttctcttctttacttgctctctcactcactctttctgctaatggtcaatgcaaaagcaaatgaattaatgctagcttccaacagttttactactccatcatgctcactcaccaatggttaagccattcctctgaagaagaaaataaaaatggttaagccaattggaccatatctacttgcctgtgtgcttactgcaactacggctagctcgactgccgtgtctctacccaaagctgcacgtccatcttgagaaaaacgtagccttgtttttttttctctgtacttttgctagggtgtgtttagttcacgttaaaattgaaagtttgattgaaattgaaatgatgtgtgtaggaaagtttgtatgtgatggaaaagttgaaagtttgaagaaaaagtttgaaactaaacaaggccctattatagtttgatttgcatatttaaccgtggcctttacctactcggttaatgattgggtgacaaacattcatgcttgcagggcttggagctagtagagtgcatgcatgccgtacgtcctactatcgtgtagaagggactcagtagcgcggctaggaaagatttttattgcgccctgtgctaattgcttgatgatctatgtagtgcattctgcggctctgcctaaacgtgttaatttgcttggttggtgacgcatttaccatgtctaatttgatagctacaatcagaaaaagattaccactatagtttatttggtggtcactagtcacaaatcccgactcaaaaggatgccggcgaaattgaagcaacaatgatactgtactacgtacactgaacaagttaattaagaattgccgtagtactacaagagtaggaacagatgatatggcctaggacaccaatagattagagctgctaatttttttttaccgctttgccgagttgtctgttgtagggtagaatcttgtactaagatgtaattattggcgactatcacctcccaaagcttttctgtcctggatcggaaactgtacgcgcgagactttgtgattatgcagcgcaaggcgcctgttgctagctgcgactgcgagagtggcaaaactggcgaagcatgtgcgagacacccacaccaaatcagccgaaagaaacagtgcgcctaacgacctaagcggagcctctgcctctagttttcaccatctccactgaccagtgctatcaggtacagtactaggtaatttagacacatggattatcctactagctactgatcactagtcttgtccactgtggtacaatgatgaacttgcttggtgtcttgtgacagctatttcaattcctctctcctcttcgatctaggagtatatgcatgttgttcagagctgcggctaatccgatcctccactaaaatttacatcccttcgagtagtagttatatactgccttgattcgaagagatggaacgaattgaaggtttgaacctcattggcatgtttcacattccccgctgatataaaacaatgtaatcggtaaggacattgttctgtccacagccatagtttatcacgtcgaatgtcgacatgtcaatgtttgttaggcaagcatttagattgatacagttgtggcaaatcacttaattatttgagctaaacttcacctgtgatcaacgatttattggtcccagtttatataatttgccacacctttaacaaattagctataaaactacttaaaacacaatttaaaatgccataatccggtaaatactttgtttcaaatggccctaggcctttgttcttttatttttcagattattgaaaatgaattatctgccccatactttaaaagatatttttttcttaaaaaacactttttcctactatattgtttagaccattttgttttaaattatctgttaagtttatttttatatattaattatttttataatgaaggccatgtttagttcgtgtgccaaaatttttttgaagtacacggatacacatttaaagtattaactatagactaataacaaaacaaattacagattccacctgtaaactgcgagacgaatttattaagcctaattaatccatcattagtaaatatttactgcagcatcacattgtcaaatcatgacgtaattaggctcaaaagattcgtctcgcaatttacctgcaaactgtgtaattggttttttcatccatatttaatgcttcatgtatgtgtctaaatatttaatgggacggaaaaattgaaagtttaaaggaactaaacactgtctaaatagataatcctctaaatctaacatgaccctaacttatttatatgaaaatcgctagctatggagtattagagccgagcatgtgcagtggcaaaattgaatggtgggcaaacacatgtactaagactgtcagctagtcagttattgcatggcaaccccaagtcaactgttgcgaatcttgaaccatctgcaaggatttaaaacggccacctacccataaccaaagcagctcgtgatgatttgttgctgttcttcaccattgatatcctttacaaacacaactggcccagcagctcagctatatatgcagcctccacattccacagttgcacacatccgagcgaggacaccggctggcgatcgagcatatatatgcatgcacttgattctttacaacgactcgcgtacgtaccagtaccatccttttcattactgaattttgctcaacaatcggcgcccgttttggttacgtctcaggatctgtttccagctgcacatgggtaaactgcttcaatctgcggcgccacattattgaagccattggtgaattggtgaggtgaaatgcgcgaaatttcacgagcggccggtcgatctcttggtgaggtgaaagcggtgaaaatctgaaatctcgcgtcagatttgttcactggagctggtggtggtgacaacctactgcaaacgtctgaacctgcaatttaacgtttatgacggccctgcctgagtggctgacacgacgatgaaaaatgaatttaatcatgcatgcatggcttgcatgtacgtacgtactacgtacgtagcaaatctgtattaacatgcatgcattgatggaagccaataaaggatcgatcgataagaaaacatcgagggccagggatgctacgtgaaggcccgaccgttgtttgttgtagcgattaattcgaacttagaagtgtggacatggggccgagacaagatcagaagccgagttaatgattacacaaaggctttgaattacatttttgctattttacttacaatggatttttaggtttctgtctttcaactttcgttcgtaggattttgtatcaaaattcatgttcatgtatatcaagcttacatatatactttgttagatagcatttatatccagttagcatatatttatactcagttacagtgcaccaaaattagattttacactattttttctagatttatgattatttatttttgttatttcatttaaaatgggatatatcattggttaaaatttttgcaagatagtcccttgaaaaaattctgcaagatttaaagttataaatccattaaaagatcaatagatatccctttaattatattgttgagctgatggttatcgtgaattatctatttattgcatggtaaattaaatattatgaaaagtaacttaccaaagaacttaaaataacttaaaataagtggtctaaataatactacagtagaagatttttttttgagaaaacatttttttttcaaatcgtgaagcaagtaatcagttttaataattttatgaatgaggccttgtttagttcccaaaacaaaaacttttcacccatcacatcgaagatatttggacacatgcatggagtattaaatgtggaaaaaatcaattacacagtttgcgtgtaaattgcgagacgaatattttaagtataattgcgccatgatttggtaatgtggtgctacagtgaatatttgccaatgacggattaattaggcttaataaattcatctcactgtttcctagcggaatctgtggtttgttttgttattagactacgtttaatacttcaaatgtgtgtccgtatatccgatgtgataaccaaacccaaaatttttccccaagtggtggtgtttggatgtagggactaaactttagtctttgtcacatagggtgtttgacactaatttagagtattaaacatagactaataataaaaataattgcataaatgagagctaatttacgagatgaattttttaagtctagttaatccataattagcaaatgtttactgtagcatcacatggactaatcatgtattaattaggctcaatagattcgtcttgcgaattagtccaaggtttatagaatatgttttataattaatctatgtttaatactctaaattagtgttcaaacatctcatgtgatagagacttaaaaaaaatttagtccctgagctgaaaagaacggagccgaagtattggactggacccgagatctcctctctgctacatgcttccattcaaatcaatcgtcggtcttttactcccccacagacatgagacacggcgtgccaacttcttttggtaaagagttgggggatggaaatgacgagtgtatgatccctagaaattcttggcgaagactaaagttgggaaaagcggctggcttcatgaggaagtcaccaccacactcccccggcccgctgcgatgggccccgaaagcctcttttggatccggactccggagacgttgtgtgctccgcttgccgcgccgcgaatccgcgtgcacgatcgggtcgctcgcgccacacatctcgccgtgcaacgcacggcggcagtcaccccggcatggtttgggcttgtgccgttgtacgcgcacgccccgcgcgcggaggaaagattcagccgcgtgtgcgtgtgcgcgtgcgcgcgggctgtgccaacgcaccaaccaggcaaccacctcggctcggtggcgccgaacagccgaactgcgggggctcgtgcagtccgcccgatcgaaacgcggccgcgatgcgatccgttattccgtggtgctgtgccgagacgagagggacggtattttcacgtgggctcgtgccatagatatcaacacgcgcggttgggctttacgctgcgtttcgcgcgcggtttggccgggccgtctcgcttagccgcgatgcatgcagagcttccgcctccgagacgaggaacggaggaaggggtggctcgcgtcgcagtttaccatcaacaaataacgcaaacgttaaagaacagggtgtgccaggtaaaacgtgtgtgaattgcagttgcagggtaaacgtgctatatgtattgccaaaaaaaaaaaaagaaatagtacgaattatccctggaactattaaggccgaccgaattatcctcttaaactcaaatacaagatattttacaccctcgattattcataccggacgaattaccccctaacactgttttgagctgttttgactgggagtttgcacacgtggcatcaacgtatcaatccagtcagcaataataataataaatttgtggggtccacctatcatctatttcttctctctcttaatctttcctctcccccgtctctttcccattctcttcagctcggggtaggcgtcggctggacggaggaagcgggagaggtggggctcgagatgggggtggcagactggcataggcgggagaggcgttgctcgggataggggtggcagaggcggctggaggcagggcccgggatggggtggtggccggtggcggaggcaggagaggcgtcgctcaggatagaggtggcggaggcggctcgaggcggggtccgggatagggacaacggctggtggcagaggcatgcaactagaggcgggactcgggaagggggctcgtcggctggtgatggagacgtttggaggctcggttcgaccccctctcttcagcgtttggaatggcggcgatggctggtggcggaggcggtgttcaggatgagagcggcggctgggtcgaggctaggaatgggggcggcgaccaatggcggaggtgagggaggagaggtggtagatcctgtcgccgccgtctcttttgcccgcctttcctgccgctgccactaccacccgccttttctactcagggtgctacgatgtgggggagggggtggggggaagctgtgcgacgggtggcttcgagtttgctgtggaggcggcgaggtcaacagtgaactccacaacctgagcaccgctgccactaccgaccccgtcttgtcacgccgagcgttgctcggcgcgagtagaggagagagaggacatccaccactagccatgcaggcgtgctccactcgcctccgcaccgccgccgcagggtgctaaaagcaacgttcagcaacgccgctgcctctaggctccaggcctccagcgccctcctcggcgcacccttccgctaaccgtagcgcgctctccccatgatgccgccgctagccggccgccccgagctctcaagcgagcgagagagagagagagagagagagtgtagggggattgggacttgggagagatttggtcgagggagggagatgacaagtgggtccagggagttttttaaattttctttgctgactggattgccatgttggcgccacgtgtacaaactcaagtcaaaaaccgctcagaacagtgctcatgggggttatttgtcgggtttgcatagttgggggtggaggatgtctggttttgttgttcagggggtaattcgatcgactgtgatagttcgcggccgggggggtaattcgtactttttttttaagaaaaaatgaaaatgctatttggattacacgcgcatgtatgtagtaggacgttactaataaagccttaattatagcttgcggttcggctccggcttagtttctgtttctgttttaccattttttattttgttataaaaatggtaaaggaaatggttgaggttattttacgactttttttttcaaatagaacatatatgtatatgttctttttaagagagtggaggtaaatactcactacatttcaacatataatatttttaggttgtttagcaagtactaaggttaattagttgaaaagatttctcttaagttacttcagttttctattttaaaattttgaatggattagattctctttgaagtcattggctctggatttatggaagtgatgtgaatcgtgggaatcaatgtagaaatcctcatattgtggtataaaatttaaataatagaaatatatatattttagaacagaggaagtaatacattagtaattcttctatcactcacattccttgcaaacacatagccattctttacaaaagaataaaagatgatcgatggacaaccctacatggcacgttacatgtatgaaagaactagcacacaatatcatactactccacaacattacagatcaaataaaggaccacgacctgatggactatctggactgccaccacgccggccttgttgcggcactacatatcgatatgacataaaacaagaacaaaaacatcgacatttctacccaacataatttatatatactatcagacataagcatcatcatttcgacccaacataatgtgtatatggattctctactgtacatgtacatgtagtagtagtcactaaacgttaggacctaggtccacatgctcgtgactatagctaccactgcatgagcactattgtagataatccccgtcaatcccgatcgtgtactaacccgtgcagactgcagaaagctatgtcgcgccgcggcaccctgcgccgatctcaatcttttgtcttgggtggtgaaaaacagctgcagattgctctgagcatgctcttcttcactctgttgggatgacgctgcatcgtcggctactgttagaagagctctgataccgattactgaatatgatgaacccaaaactaaactggaaattaattaatgcttcagatggccaaagaaactaagcgagagaacaagagttggatgattgatgcctccaggcagcatctccaatgtcgtcctctttataggcctcgctattgtaacacgaccagaagctttccaaacacgatgtatataaactaggaaaagtacatgaagaaccatgcatagaaaattaacttcagtgacaataatatatgtagaataggtcgcaccaaccatcactccccggtggtggaaaggataaaattggattaatattttaaaattccaaatatcgattttatatattaaaataactttacaaagtctaatagttttataatattaggataatatgataatattttctgagacaaatttacatatattatttctcttatttttaaactaaatatttgaaaattttgttgatgatcgaaaatttagaaatttgacataatcttgtcttaacgttaaggctctcgtttgaaacgtatgaccgaaaaacgcaagaatcgaaatttcatgtttttcaattcaatcctataagaaaatgcaccacaagaaagattgatccaaataaaagttttctaagaaatattatctttttacttatttttctatggaattgaccatgtcttttagttattttcttatgaaattgatcataggaatgaaattctatatatggtaggggataattggcttcaatccaaacaagccctatacttgtgaccgggactaagagcttgaagcgagggaagcgaatggaggagcatgttagtgtgatgagcacttcaataattaatagtactctaattacttatcttaattaatttggaggaatgccggggtccggctagctgcattatattccttaatttattgtcttccatggtatggtatgtaacacgtggtcgaatatgttgtgtgagtacactttaggagtatttcgcaaaagaacactgtgatataaatacgcataaactaggacctggacggtgaatatatactcctgctcctacgtactcggattggttgacttaagcaccgtttacttttgaacactgtaaggtggctagtttaaaatagacaaaattagttctagagcatcgaaagttgtcgattttggttttatagcatcaaaagtttacggctcattttgatagcacctaaagttacctccgttacttctgtttagcattccatccaaactccagttagttttcttttcttattattatttttcaacaaaaaattagatcaaacaccaatggtggccctcttccacttccttctcatctcgaaacagcagtcatacaggagctcaggccggtcagccatggtgcgaacacagtatgctggctccacgagctcgtcatgtaatacgtgagccctcacgagctcatccgcaagccgctgtgttcatccgcgcttgctaggtgtgatctatccacgttctagctttgcccgtacagcgcaatcgtcgatcgatctcgtctgccgcgccgccatggccatgctagagcttgttcaaatcttgcgtgctcaaccaggtccatttcctccgcggccgtgccgcttccgagttcgtccgcgtgcactgccctcggtctcccctagatgcgtcatcctcaagctcatccaatccatgaacgcccgaagtgtcattgtccagctcgtcgccggcattgtcgggtccgcacggaagcaaagccctccaaattattgtcggcgcccttgagctctctccgacatgctgccctcgatcgagctcatccatcggccctcaaattcgccccgaagcaccaccctcgcgctcgttgcgggctcgcctgagtgccgacccgctcctccttgccctggatccgttgtctaccgacccaagagccgccgcctctagcatgccagaaccagctgccaccatccaaggctccaactcgctcagcgctatactgtcatggtcgagctcgcctgatgccttgaagagtggtcaaccataggagggagagcgcaggaggaagaagatagaggtaggatggggtgagccgacggaactgctgacagaatgctaaaaatagtaacggatgtagttttcagtgctattaaagtgaaccataaacttttaatgctatagaatcaaaatcgagaactttcgatgccatagaaccaattttacctttaaaatatcatattcctttttactcaactgtatagtcatttacttaaccgtatcatcttgatataattgtccatatcaatataagctttactacgaaaagaacgtgaaaaaacataagaaaatttcagcgaataattaacgagtcatgtaccctcgattcacgcgacgaaattgaggaaacttggtttgcaagtagctagtacatgcgcaatcgccaaaaggcgcaacctggaccaggtcattgtttcagttaaatgcacttgaacttggcatagggtgtgtttagttcacgccagaattagaagtttggttaaaattggaacgatgtgacggaaaagttaaaagtttatgtgtgtagaaaaattttgatgtgatgaaaaagttaaaaatttaaagaaaaagtttgaaactaaacaagtccttaatcagtttctagtatggtcggcatgcatgcaacaaaacacgacgctgcaaataatacgcgtaaactgggattctgactagctatggagtatgggcagtcttaatttagaagaaaaataaaacaaaggaaggcaagccaagttcgttcccttcacaagcgcacctagcttgggacggttaaaggtagcaactcgcttggaacggttcaactatttttgctgcaaactagtactgcaatgatagatggcaatgattaaggtaataagatgcttcagaacgcacaggcgcagatgctccgtattaggcccggtttagttggaaacaaatttatttcgaggtgttacattggatatacggacacatatttgaagtattaaacgttgtctaataataaaacaaattatagattccgccagaaaactgcgggacgaatttattaagcctagttaattcgtcattagcaaatatttactgtagcaccacattgttaaatcatgacacaattaggcttaaaagattcgtattacaatttaacgcaaactgtataattagtttttatttttatttacatttaggccttgtttagttaccaattttttcttcaaacttccaactttttcatcacatcaaaactttcctacacacataaatttctaacttttttcttcaaacttctaattttggcgtggaactaaacacagttaatactccacacatgtgtccacacatttaatgtgatgggtgaaaagtttttgttttgtgaactaaacatggccatatactagtagagttcaaagtcatgaaataaatcaattaatactatcttcttacctactccttctatcccacgaaaaacgaacctaggactggacgtggcatattttagtatgactctggacagatgtatgtctaaattcatagtactagattgatttttaatgtaacggagggattagacttacaaatgaatcaaaaagttttatagtttcaattcccttaacatacccacccacaaatactactttcctcaccactaaaattatcttgggatgcaagagtttaatttattttaggatggaggaactgcatattaaagcaccactaaaattaccttaggctacgagagtttaatttatttcaggacaaactaaatattaaaaacaagaaaaatatattgcgaggactattatactgtaacatttttactacagtatataaccagagctaccgaagtttgttcgaacaacgatgatttgctcatactatagccttcgcttcatcagcctagagtagggcggagttcaagcaagttcatctgcctagactcaagctcaattaaagctcaagccgagcctacgaaatctttaagctaacagacagtcttagttcgagctatatatatatttgatttgtaagtcttagttaacagacagtcttagttcgagcctactgaactttgattggtaagtagaactatatatatttcaagtataatctttaactaatgtttagttcaccacattgagcggagcgagccgaggggcgtccaaatgatcatatgctcgccggggctgcacacaggggcggagctagagtacattaggggagtgcccaggaacccggttaagaaaattttttaaactataattaatctattttcaccatatatgcatccccttaatacaaacttagacaccacccgcatcagtttaaacttaatctaaagtaaaattaagcaagtagcatcatcccctatttcgtgcgtgcttgctgcgcgacgatttctattcccccgtaaccgtaaggcacaatcgctctcggtcggtgcaactgtgcaagtccgcaagattcggccgccccgccccgccgcgcaacgcaacgcaaatcggcacggttgccgcggtgcgcgcagcgcgcggctggttcgcaaccaagacgccaaccgcgtcgcggattcgcgggcgcggaacaatggcgcgcgtgcatccgtgctagtgaccaagtctcgccgtctcagcccacccgcgaggatccatggttgggctgtgccgagcgggccgtttttctttctcacgcgggctcgtcttagcgataccgccaccctcgctgtttgtgctttcgtctccaagccgtgtaggtatataacaacttaaatgaggagaatatatatatatatgagtatttggattacatgcgttcaaatgaatgtaactaagaccataattatacatagacagacatgactcatccacaccgaccaacaccagcgtacctaatttacaacactaacattagtttcacaagcacggaaagaacaaacccatacttaattagggaaccagtgacatataccaaacgtactccttatcgtgttgagcggcccagattcagctacgtgctttacgcccgtgtatggatcatcataattcataactatgcttccgcgggagcaccgcagaagcagagtaatctgaggatgctcttcagggctccgccgcgctttggcgccggcttgcttcgccgattcgtcgtgtcgtcgccgccgccgccgcgtccgttctccatcagcagctaacaaggaacaacttctacgaactaacacgggtgctctctgtcaagaggagtattggaactgtaactctgcaagcaacaaccgctgccaataagcagagccctgaatgcgtggagtataaatagatagcacggtcgctttctgtccgtacccctgagagcttatactccaaaatggagggacatttcaggcctatttcgggggtaaaaaccagggaaatgcgcactagtgtaaagtgtgactcggatgcagccgtatcgaacggacggacggttctttttttgggaaggaaatgcacttccattttcatctctcaatgaacttttgttttttcaccacaatcacaacggctaaatccacgcaaggcggcgcactatcgatcttgcgtgtgttggctgattgtcgcgcggagaaaaatagggccacgattcgctagcgacattgacgagattgtacgacgttctgcatgtaggatgcgtctaatttcgtcgtcccaggaagcgcgtgtatgtttagggtgggtttagttaacgctaaaattaaaagtttggttaaaattaaaacgatgttatgtaaaagttaaaagtttgtatgtgtagaaaagtttcgatgtgatgaaaaagttaaaagttgaaagcaaaagttgagaacttaaaccagaccttagcagagtttcacgtctcatgttggaatcttcgaaaatccaacgcatctacgagccttcgacgtaatttacatggaatatatatgtatgtgcctttgcggccgacagggtttgcccccaccaaatcttagcttgggcggttgtttttgtctcttcaggtaagcgtactgcgtacgtcgtccaaggcttcaggttcagcgtcacctcatcatttctcatcagctcgatcacgaccagatcaccagtaggtatgaaatgtttcttcttggatgcaaagccggccggccatgacgccgaaagtacagtagcttgcaagtgtttttcttgatggactgaaactgaatcatactgcatgtacaccctgaaattaacagctctgctgaaagttaagacaactctaccacggtcatcttgcatgcaatggaatatttttgtatttcgtgtgatgtttattgccctgtttagttaatcacgttgtttcgcgttaacaagtttccaaccttgcaaaaaaatagagcaataatttccgcctccacccacccacccctaaccccaccccgaaagatagaacatagtatgtttcctaagcaatacaagttatttaaaaactatccctattacaatagttaagacaaatatatgctctaatcattaatctataaaagttttttttaattatcattccttcctttcctcacccttatgcagcaaaaattactttttatcatgtattccgtacaagctaagggttgatgtaaaatttaacatcagcgtttctctctcctctcctctttctctcttacatgccagtaaatttgcttgcaacttgtcacgccccgaactagtcccgaccggaactagcccgtgacgctccaatttagcctgttaatcgataccagtcccaggaaacagtgctggtatcacagggagacagaatatcacagcaacagaggtctctttattatagagtagaagtacagtcatgttgggctgcggacagatcccgagctcacaactgcattacaaaagggaaacggaagccaggacttggaccaaacacacaggcgtgacttgggaactaggccgaaaccctaaaactcatcgtagccggcttgctcctggaagaactcctcatcagcaggatctgcttcatcttcttcagcaactgggggggatatttatatagagcaagggtgagtacgggagtactcagcaagccatgggaattaagtgtttaatgcaggcttcaagggaaggctgttgtttttgcaattgattttatttgaactcttttctaaaaacaactaagcgagtgcttctcaaacgacacggatgagacagtgcgtctcgtccggtcgaagtatgtgcaatgtatcagtctttagaattaaaacaaggttggcacccggccaacagcttttcaaacggccacccgggccaacaacttttcaaacggccacccgggcctacaacttttcaaacagccacccgggcctagctgatcccatcagctgcagatttttcaaacatcgaaccccttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccgggtcacccagcccgtggggatcagccacgtcgggagacctccaagctttcatgacaaggcatttcgaaagccgacacaggtttgccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaaacggtccttaagtgcgagagcgggaaaccgtacacccggtacgttccccggtccgcggttttggaaattcatttagttcgcaagcaccgacccaggtgtcgggttttccaaatctttcgtaaaacccaagttttacccaagttgttattcagattataagtttgaaggcgtccgtcgatactcgcacaggatgcacgaatatcaagacgcaactaggtggttacaaggggacatgctgtaacaattaacaaggaaaggatcaaatgcaacaatttaggtaagtccgccaatctgtcttgcagacgggacaaaagattaagtgcgatcctatcaatgcataatatttttcaagcaacataattaaatttcaaatataggctcaagatgttcaaaggtggcttgccttgctagagatctggagcttgatcctcgaaatcctcgcactgcgggtcttcgggctccggaactacacgcgaaacggaacaactcaacaaacggcgaaaataaagccctattaatgacctctaagcgtgccattagatagatctcgagatttgaggaattttggaagttgaacggagtcaaacagatttacggttgggaagatattgaatttctaagattattggatttttggtctaaaggaaaaggatttaattaaatcctttttggaaaagaaaagaaaagaaaagaaaagaaaagagggatggaaatcagacttttcctcgggcggctagggcgctgcccaaggtaaatggagcggctcggccgagcttaacgggccggccggcccaagacggcccaagcgcgcgcgcgggaggggaggggagagagagccggtggaccgggctcaccgcgcgcggtcccgggtgggacccgcttgttagcggctcggctcaccgtgcggagggagtttgcggcgtacgcgcgcgggcggggctgggacgcggtgcacgcgcgcggttcgcggaggaacggatgcggcgggcccatgcgcagcctcacggctcgcggtggaacgcgcgcacgggaggggctgaccggggtcggcccgtcccgacctcggctgagctggcgccgacgtggcgcctacgtggctgccacgcgggccggcgggaggtagacgacgacgccggccggaacggacggcggacaacagcggcgagcggcggagcgaaccacggcgatatcggcgaaagcgagcacaccgggtggttgcacgtgatgaggggagacgagccaacggctcggattcgccggagggagcttgacggcggcgaatcgcggcggcggcaaccggcggcgggaaaaggggaaaacggcgacgaggtcacgaggggccaattcccggcggcgagagcatccacgcggctacgggaatccgatgctagcgtcggattgggcggaactacgccgagcgaggccggcgacgagcgggtgttacggagctcgggcggcgacggcggcgagcacacggcgagcgacggcaacggtcggggcggcgccggctaactacggggagtctactcaagctactaccgaaagctagggggaggagatggagcgaggaggaagaacggagagagacactaccgtgcgggacggggcgcagtgacgagaggccgacggcgcgggagtgatctctccggcctcgggccggggaagaggaagaagagggcgcgcccggagtccccttccgcgtccacgaacgcaccggctctcccggcgcttggcgatggacggcggaggcgaggcagagcacgggagcggcgacaacggtgaggagacgaatgggagaggaaaggaagggagggggaagacgggtttaaaagggcggcaatgtcggtttgagagaggggaaccgacatgggcggtcaagccggcgagctggcgctccggctagcgtccaaagcggcgacaggaggtgacgccggcgagaggggaaaaaggggagaaaaagaggaaaaggagggagagaaagggggctcgcccctttgccgattcgggaaaaggaggagggagcggggcgactcggcaaagggagaggggctctctgcctccgccccttggaggctagcgcgcggagtggcgggggccgggcgatcacgacggcgatgatggcggggcggtttggagcggcgcgacgacacgggcgacaggcgcgggctggcgcggcagagggtgacggcggcggcgaccgggcggtcggccactcggcacgcgcgcgtgggaaacaacgggcggcgcggctgggcagcgggaccgggcgacgcggacggcgcagacgacgcggctcgggcgggaaaccacgcgggcgcgcgcgcgagcgacggcgcacggggccggctttgcgagcggggagctcgcgcgagaggagggggcgctcggcgcggctctcgcacgcgcgagtagcgagtcggggggggggaacgcgccggggaaagcgagagagagagagagagagagagagcgcccggcaagagaggagagggcccggggagagggggagatgggccgagcgagattcggcccatcgacctcgggggaggcaaaatagacttttgcggaggaaatgattttggaaggatttggattcggaatttgaactcgacgatagatcggggattgagatcttgagatggcacggacactagacaacaagcaaggaaacaaatttcgcaaatagggtttttaagagataattttcccgctaggcgccacgacggaacgggcgctacacaactaaaagctactccctccgttttaggttataagatgttttaactttggttaaagtcaaactgttttaagtttgacaaagtttatagaaaaaatatagtaacattttcaacccaagacaaatttattatgaaaatatattcaattattgatttgatgaaactaatttagtatttaaatattactatatttataacttagttaaacttgaaataatttgactttgaccaaagtcaaaacatcttgtaatctgaaacggagggagtattaattacacacgctcttctaccatttacattattacatctccgactaattagaggtatgatggtaaagggagagatcttagataatttctttttaattggtgattatggtggaggtcacaagatgatcgccaagaataatagggaaacttttagtgcaggagtcatcttggtaacatggatggtttagaaggaacacatccatggattcttctttttcttttcttttgtttcagcttgtttgaaactttgattgtttggaattggctggagcccaagctcgggtaggcagaccctaaccaaggaaaatatgtagtaaaaaactgttcttggatgtaaaactgcatgcttgaaatttgtccatgtcaccaattgtaaaaattctactctcagtttcaatcatgaaatcatgagtaaaaattttactcggactcttggtgacgtggataaatctcatgcatccatttttacatctaacaataatttttagatttccatcgtatatatggtttatactatattttccctataaccacctataagcattgactcggtcatagtaatagtatacagacatattcaggggacagtggagcgagttgcgagtatagtgaaaacgttcagaaacaagctggtaattctttatcactcaagactcatacaaaacacacaaccacacatacgtatggaacaatacaatcggcgtaaacaactataacctacaagagtacaaatcaaatcaatggaaaactacctgatggactgggacgcacggccactacaccggcctcttattacctctcatgtacacagaacaattctagatctgaacaagatgaataacactacagatcgatgtacatgaagccatgatctcatctcaacctttcgtctttggtggagaaaagcagccgcacagtacgctcagtatgctcttcttcaccccgttgtggtcaggcatcctcgattactctgaaaagagctcgccctctgctgctactgaacctgaacttaactggaataacacttcagatgaacaaatgctagcttagctcagcgagagatcaaagagagctcgatgtctctgaatgtttggtgcctccaacaagccacccatttcgtccttttatagtgctgcgggtaagacgatcagggaagcttaccgagcacatactaggaaaagtacatgaagaaccatggagaacttcagtgatgacaatgtagaacaggtcggcctagctagcaagtgacagttgaagttgggcttggatttttcactttgtgcaacaacttggtttcattttgtataattaactctgttttcttagaatgttctgtgaaaatggtacgtttaattctcctagcttagcctgtgttccgtacttttcaccgtgtagaatattgccttgttccccaagaaccgtaccggcgaacgactcgtaacgtacttatgatgaattgatcaaggtcaagacgtcaagttaatccttgagagtgtctatcagtgtgagcactttgaatattgttatattagctgcacacatagtaccttaatttgttgcatcccatggtatgtatgctagtacgcaacaagcaacaagtggtcgaatacggtgtgacaccgtgacaaccccgtgaaactatgacttggtttctgcatgagtaatggtgaacagcactagcaagctttactcggattgtttgactgaatcatgtacagttcacttttgaacgactcttctcgatctcatgctagctgagggtgaccagttgatatgagaacttctactacccagtaaattgtaagtttgcactagtaggtgtgttcggaatacccctttttcccagctcatctccctcgtttttccatcgcacgtttttcaaactgtttaacggtatgttttttaaaaaaagtttttatacggaagttgcttaaaaaaattaaactaatctattttttttaaaaaatagcaaatactttattaatcacgtactaagagcacccgcaatggtaaagtagggtgctctctataaaacatgtacatttcagcaatagactagattaatagtaaaccacctcaatagtatgtctacataggtatctatagctctctcatgcattgcctcgtttttctctatagactatctttaagctagtagatagctttgctctctctctcttcatttaatatcttccaagtaggaaaatatgctgacatggatatcttgtagatagcttatagataaccattgtgggtgccctaatggaccgttctgttttccgtgccagagagcaaacaccccgtagttatcaagcgttactaggaaaac

SEQ ID NO: 16485 - DNA, 690 bp, Oryza sativa
ccgcacatcctcaaatacaaagcacttccctagttagatgtaggttacccttcccgttcgaaaaactctaccttctacctgccctcaattaatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggcgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttata

SEQ ID NO: 16486 - DNA, 901 bp, Oryza sativa
tgttttattttttcggatgttttttcacacttaggatcacgatacaaccaaatttaaactcgaactaccacttagctaagtctgaaaatagctagcataccacttagtctactttgcaccttcactaaaattagaccatagctcatttagtaaaaccctttgatcagcatgttatacataatgcactctatcactatatgaaattacttaatctaattcaaaatataaccacatgaaatgatagccataagttaaacagtacagagagatgcaattttttaatttttatttcatttttttgatatttttttcacacttaggagaacataggaaccaaccatataaaaaataaactcaaacggacaaaatgtgacttgtagaattttccaaaactctaccgaaacggacaaaatgtcatttattaaaataggcgtaattttctcatacggactcggaatcaggcaaataatatatccatggacatctacagaaaatgttacatccgattctccccagcttcgccgggttcggcgatattaaaacctccaaattccgcttgcaagattgtgttttcgaggagagaagtttctcggtagagctttggaaaattccataggccacatattttgtccatttgagttcattttttatatggttggttcttgtgagttcctaagtgtgaaaaaaatatcagaaaaataaaataaaaataaaaaagttgcacatctctctcctctgcactagttcggagagagaggagaggagaggaaaaattctacaggtcacatattacgtccatttgagttcattttttctatggggggttcttatgtgtccctaagcgtgaaaaaaaaatatcaaaaaaattaaaggaaaataaaaaaattgggggggggggggg

SEQ ID NO: 16487 - DNA, 1860 bp, Oryza sativa
  unsure (1)..(1860): unsure at all n locations
ttattgtgcaatattgtctaccttacaatcctgagatggacctctaattgttgtgttaatacacatcaggaattgacacctctatatagatataagctgtaccagctaacagaaaaaatatctagtcctgattctctcttcttctttttttggataggagactagaaatgcaacttaggaggcgtgatgttgaacagtggatgagccatagacgcctgccagaagatttaagaaggttcatctacataacttctaaacaaaattttactaatcttttctttaaaaaataacatcatatattccttaatcttgttgcaaatcgcaaccatttattaattcagactattaatatgttgttgttttttttgctttgtcttactttttattgtttatgtggctcctattattcagaagaagaaaaacgtgtacatattcaacagttatcaggctgcttttcttgataaatcatcttataagtggaatctcatgcaagctatgatctgtgttacagatctcattttgttttgtgggtaaaacgaatgcatgatatattttgaggaaacagatttagtggaaacatcatttgtttgatattgaaatttgtcaatttagttaccaagtttccatatgcagaagatgcccnnnctctcatggcaatgtcaatgagatacctgaattttggtttgctacattcttttaggatcattatttcgaactagtttatttgtgcggaaatcaatttttaactcgcccaaaagggtgcaattttatcttttctttgacaccaaggattgatattgagtatttgccactctaaatgtgcaactaaccaacaatcgctactcagtgtattctgtcgtctttaagaaaaatgagtgtcagtttgtgaaatgttcgaaataggcttttcctctttgcattctcttcttcatctccacaatcttaatcataccagaagttaaagatttgttggagagggagggaatggtaaatctggagtattcctataatgggcaaagaacacaaacttccccaggcagaacatgaacttttacatttgttggagttggcaagcaaatgatttcctctttatttttggactggaagattgtaatacttaatagttttatgaatgtccaggagggttagacgcgcagaaaggttcacctgggcagctacccaaggggtgaatgaagaggagcttttaagtaatttaccagaagatattcaaagggacatacgccgtcatttctttagatttcttaacaaggtttgtttatatgaggactctgactgttctgggagagcaagcactgcaactagttactctatcacatttttactttccatgctcatgatgcatttaaaatttgaggttgctgatgatttacccctacaattttcaaggaaatgctgactacaattattttgcaggtccgattattcacattgatggattggcctatcttggacgctatatgtgacaaactaagacaaaacttgtatattagcggaagtgacatcctttatcaaggtggtccagttgaaaaaatggtcttcatagtgaggggaaagctagaaagcatcagtgcagatggaagcaaagctccgttacatgaaggtgatgtatgtggagaggagctcctgacatggtacttggaacactcttcagctaacagaggtctgcagtttttgcattttgtgtttttattgttttctcttttctgtgatttatatttggtaagtctccatatttctattgtttcagatggtgggagaatgagattccatgtatgcgtttggttgctattcgtactgtaagatgtttaacaaatgttgaagcttgagtattctataggg

SEQ ID NO: 16488 - DNA, 525 bp, Oryza sativa
aatttgatattgatgctactgaattgcatggcgagttgatttttctccaaagtttcagttcccaagaaaagttgggccctgttgaaattttgaagtttttgaagcggcatgattgttttcccaatgcaactattgcatatagaattttattgaccattcctgtgactattgcatcgcagaatggagtttttctaaattgaagctattgaagtcatacttgcgatctacaatgtcacaagaaagacttaatggtttggctatcatagcacttgagggtggtatgctggggagaatcaatataaagctatcattgaagattctatttcagaaacactaaaagaatgtcgcttttcaagtgaatattatgcacaggtatattattttagaccattttacattgctatcaaatatattatggagtataaattatgtccatattatatcatcacagatcaattaagtttttatccttctttatgacttcccacatggcccccaaatttgacgggacggccctaaccgagg

SEQ ID NO: 16489 - DNA, 6804 bp, Oryza sativa
  unsure (1)..(6804): unsure at all n locations
nnnnnnnnnnnnnnnnnnnnnnnnnnnnnnnnnnnnnnnnnnnnnnnnnnnnnnnnnnnnnnnnnnnnnngacactttgttggattctcttatttctactgctaaaccatcgcagtcaggtggacttgccaaacaagcattgtcttccattgcacagtgtgttgctgtgttgtgcttagcagctggggatcagaagtgtgcctcaactattgaaatgcttaaaggcattttaaaagatgacagcactactaattctgtaaggcgcattcttgatgacagatgtgttgtttaacttctgtactgtttcacttttatgtagtacttctgctctttggtatagtgcatgccatatcttggtgatccttttaagttagttatatagattttcatatatcaacatcttttatatgtagataatgttataactctatagcgttgtgaaataggatactacattctctcttaactagtttcctatgccttcgacaattttgaaaaatgactatgctgaattggagggatcatgctttatttttttcaatttgataggatcaccctaaattgtatagtctgaaagtccttggtaactgttgatgtgcttgtttgattctgatccatgaaaattgccattgaagtattagttatttattaattgcatgaattcaaataactcaaatatgatctctatcattctccttgtattcagctgactgcctatctttgtttaccaggctaaacagcacatggccttgttatgtttgggagaaattggaagaaggaaggacctcagcaatcatgctcaaattgagaatattgtcattgagtcatttcagtcaccttttgaggagatcaaatctgcagcgtcatatgctctcggaaacattgctgttggaaatttatcgaagtatttgccttttatcttgaatcagattgacaaccaacagaagaaacagtatctattgcttcattcactgaaagaggtttgtccccattaggatttggtttgatgtgcattctccatgtatttgttgcttaattcttgcttgtactttaaatcactcaggtaattgcacggcagtctgttgaccatactggccagagtgagctccaggattcaaacattgagaagattttggcattgctctttaatcactgtgaaagtgaggaggaaggagttcggaatgtagttgcagaatgcttaggcaaaattgctctgattgaacctaggaaattaatccctgctctaaaggtgaaatgggattactatctaaactattttcttcattttgttctactgtcatttaatgattagaggtcttttggttcattccttgcgtttttttttgtaggaacgcacatttagtcctgctgcaaacacaagagctacagttgccattgctataaaatattcaattgttgaacggcctggaaaaatagatgaaattatgtactccgagatttctaccttcctgatgttgattaaagacagtgacagggtatggaaattaagcacagttcagcgtttttacttaatgctgtctagatgtggtgttcattgtttccttttgcactttgcagcacgtgaggcgtgcagctgtgctggccttgagtacagctgcccacaacaagccaaatttgattaagggtcttcttcctgaattattgcctcttttgtatgaccaaactgttgttaaggtatagtttcttattgacttcttgttttgttgtgagctaggactgttatatcaagtaatgttttttgtatccatcttatcgtaatgattttttcctgtgcagcaagaattgatcagaacagttgaccttgggcctttcaagcatgttgtggacgatggtcttgaactcaggaaagctgcctttgaatgtgtggatacattgctggatagctgtcttgatcaagtgaacccatcatcatttatcgttcctttcctcttatctggtttaggtggtaagtactgttacactaaataatttatcactttgaccgaacattccgtttaatccactgtagtaatatagatgtataggtggtgtgtaatctttaaaacctttacaccgcacacaaataagtcatgtttattttgtttacttgttcgcagtgcttttttcactagtattcgtatcttcttgtttatgcttagtatacacacgctgtaataactgcttttttgttgtcttatggaaccactttgtagatcattatgatgtaaaaatgccttgccatctgattctctcaaagctagcagacaagtgcccttctgctgttctggcaggtttgttgccttaatctaggtccttacggggatgtttcatacgatgcaaatgccctactctgagttctttttgctaatattcttactatgctgtctcagttttggactcattagttgaccccattgagaaaactataaatcacaaacccaagggcgatgcagtgaagcaagaggttgatcgcaatgaagacatgattcgaagtgctcttcgagcaatcgctgctctaagccgcataaggtcaggcatcattctgtcctgccccgaacactttttttctggtttaaccacacttttaactgtgctgtcatctttctcgttattagtgaatcgccacatctttattctttgcccttgataagcgataactagaaacaaatggttacctcattttacttgcgatacagccattctatacatgccatatgtttgttcgaaagtgacatctgcattctaatttgagtatcttaccttgttttgatcttttgggttacgtctgcagtggtaatgattacagcatgaggttcaagaatctgatgaacaagataatggcctcacctccgcttgctgacaagtacaactcggtgcgcagcgagtaagagctgatctttttgtatatggtagaaaatagttggagccgacttggtatatgtgccactgcctattctgaggtgaagattcaacccagcattgccctatatttttctggtggagctagtccgaaacactgaacgatacagctgagactaagaggtggtttgaaaatttgcgaacacaaatggctggttggaagctagactttttttttttgtcttgtacaaagtatggcggcaattcactagattcagtaaagttggattatattttagccgtcttgtgcgtattttttcattgcgtggtactagtaattcttccaatctctagacgccgtccttttccaagtttggttcaagcgtgatattgaaaattaaaaacttgaaaatcgaattaaaaacgatcaatttttaacttgatcgattttgtattttttttcataaaaatgttgtatttcaatgttcatctctgtaccttccaaccttggcccttgtaagctgacgtcaggccacatgcttcgcatgacgctccaagctcaaacatactgccctacatatcaaaaccatcgtgacctgaacgacgagtcgtcgaccgggaaaccgtcggggctggggatatcgcacctcggctggcggtaagcatgtttatcgcgtggtaacaatataaaaccatgcaaaatttgttaaatattcaaattattttttaagtttatttgaatttaaggaggtactgtggtatttatattaccgtacccgtggtaaccgcgcagggttaccgacggcaaaggaaaccctgccgacgagaaccacatgatttcagctaaagagcactgagcagccatgtcccatgtctctctcttgtcgccccggccggccatccaccgtgaacttcgcctgtcgccgcaagacgaggccacgccgccggcgtcccgaacagtggacgcaccggcgacgtcgcgctccgagcgtgtcgtgccctgtgtcagcaaacgacgctttggcattgcattgcatatgcggcgtgccatgtggtgcccctcgaccactggaaatttacactaggagagaccggcctgagaccccctctgaagtctgaaccccatcatgtgcctgcctgcctttggcaatttgaccgtatgggctacctttgcctaccctcttctctaattcattgtgccctcttctgcactgctcacatgatcatctcttgcaaccagaaaaaaacacacacaagaatttcagttacaaatttagtaggtgcagtaccactatttttgccatggctaaatttgctgcactgcacttgcccttcccatctgtgcatctgcacttctgcatcagtgcattgctagtttgctgctaccactatttttgccatggctccatttgctgcactgcacttgcttgcaaaaggctggaggtgaactaggggagaaagagagaaacttcctggtgctcaccatgtgctgcaaatggagactagtctttttccacaatggcaaaaccgaaaaggagctgtgtgtacctgcttctgtatctctttgctctgcatcatgcatgtgactgatggagtgtgtatctgtgatatatcatcatatcagggagcacttaaatgagcagggaaattggtggtattcattgtttgcctccacttctgttctcccctcacatgctgaaacctaggaaattgtagcatgatgatgcatttggaacctacctgttttatttttcaggtggttgttatggcttgcttgatttatttgagcaggagattcagaaacagtttcttctctctttcttttgaggtgaggagattcagaaacagtttagaattggctctgtcacaatgattaggaaagagggcaccatgatgctgataacaataatgcaagattggttgctttaggtgtataagtaggttggatctcttctgaatcttcttccctctgagctaagtcacagttaagtagttattgtcaattgtagtactagtcaatctctctgcacatggggatgctgcttcttctattgcaaaacatgaattaaaccacagtttctatttatatggtggtacaaaacattggattcagaaatttcatggaagcatccacagagaaactgtaaaaaaccatatctttgatttggtgaaagtgtcaactttgacagctgcattacaagagagaaacaacagcataatatgactcaaatgcatttgtggcttcattttctcctaggaaaacacatatctttcctgaaatttcaagtaaaatatcagtaccgattttctccccgaaatcttcccttcagatcaagcaaaatactgaggagacactgcaacagtgcaacatgtcatgcatcaagcgatttcgccgcggtcaacttatcgccttcgctgaagacgatttgataccaatgtttcctagcttaaagagtgaacaggagaaatgaacagccaagtcatcagccatggctgtctcatctccccttctctttttcagctgtgccaaaccaaagccgtccttctcatgacagcctgacgatcagttaagggtcgtaccaagacaagacctgaagttcttcaggatgcttccttcctgccctgcccctgtcctggccatatatctcaacatgcaaacaaacattagcatccatccaatggaaatctggacctttttcttctcgacatgaaaacgaaataacgaaaactcttgctttattaggctgaacaatctttccatccataatttccacatgcagagtcttttaggctccgcgtcaaaatataagggattttggctgagtacagattagtcaggtttttacatgcggagtgcaatccaaatgttgcaatatttgagtatttataacttaaattttctatcgagagaatttcaaattgaaaaaaaaaaaacttgtttgacaaccggttgtgaagattttttttcagaaaatatgtcggcgctgattataaatttgtaataaaaaggcagtggtacggttgcaaagggagcagaatgccctgctttctttagcagattctgcttcaatcagtaggttggtttgccatcttaggccggaccaccaaatatctcagggcatcacagcttgcttgcactagtgttgctttgtgcccccaaaatgcattgcaagaaaacatttagtactcctacttagataaggacataaaattcaatgcctgggtcaccaaaatttagtcaaaatccagataatccgtgatgttcacaaaaaaaatcatgtgaatcttttgcgttgttctcttaattgggagaaagattattatacttcttttcttaattagatcttatagaacaacagataaagtaaacaggaagagtgagggaattaaagaaacacaacaacattgtgctctagtaaaaattactactacctccatataataaaatggcatcaaactagcctcaaggattacatgtatggttaatgctgaacaccacaaaatcctccctctcacaaactactgcaaatcctagaactacaagggggtaagaaaaaaatgaacacccatagttcttcccatccatcagcagctagtagtagataatactactgctagtagtaacaaatagtaaataaaagaaatcacaaatctgtaggtgaaaaatctagtacccaaatcccaatcctgccctccatcatctgcaatcaatcagatcaccagcagctcacaatccctgtatgtacactctaatcctacccaggggtaaaatggtaaaatggtgtggccacacgcctccagtggcagaagagcgtaaaatgcgccccggccaagaagagggcggcgccgcgggtctcgccggcggcgagctagcagtcgtaggaggaggggtattcgccttcgtcggcggcggcggcggcggcggcggagaggcggaggaggagg

SEQ ID NO: 16490 - DNA, 25665 bp, Oryza sativa
  unsure (1)..(25665): unsure at all n locations
cgccgccgccgcctgcttcggccggagctgctggtacgccgcggcggcgggggagtcgtcggcgacgcgggagagccgcttgaggaggcgcttggccttcatggctgagctcgccggcggcgaggaggaggatgaagcgaaaggtgggttgtttggggaggcaaaggcgtgagctttgttgcggtttgcggtcggtacaacaagggtagggggggtgtgggcttatataaatgctgtgggggtttagtggttgctccactttagaagttggagggtaggagtattaatttatttctagttaattactgattccattttgcaatgtggagtaatattttatgccttgcatcctagtataataagtatttttttagttcatctcatttatcttaaaattaatttattatttttagcattggtgcatcggagtttataaaagaaagatataaatgtaatgagagtaaataagggaggaataattgtattgagatttgaaaaattgggtgggagggagtgttgcagtccttttcttattggtgcttgtgggatgggtgaaagtaaatttattttgtgacagatagggtgacatcttctctatatgtacaataaaatgttgctgataaaaaaaggtctatatacataagttccattgaatagcacaaagtataagtaagccttacacccaagattcttacgatgcgtgacaatttgaaattgtgcaacaacaatgcacgatagtttgaagttgtgcgtttagggatataatggttaagatcccaatggttgagactattgccgtttctaatatagatctaacattattcgtagtagatggcaacaaaccatgataaccatctattgtaggcatactatataattaattcgtatatattcggactgctctcatgctttatgtcaaaccattcatattcatatttatttatttatactcactcgtgcaaaacacacaataatatggtaatttataggatcatttaatactactacataacactactcctacccattagtacacgtgaatttgctagcgggtgtttccttctcacggcacgatgcatgcgcgtcttctgtataactatgtacaaaatagaaaacatttcggcattgtgcattgaaagatataatagttaagagtccaactttgttgtttctaatatataggtctgacattattcacgaagagggaaaaactacgataacggtctatttgcatacataatgctacttctacacatcagtacacatgaattttccaccggataatcctttaagtgcacgtgtgttacacatgaatttttttaccggataattatatgagcgcgcgtcggtgtgtcacacactcatgaccatctgatgcatgcacgtcgtctatataaccgcggagggaaagaagaagaagaagaagaagaagaagaagaagaagaagaagaagaagtacctaatttcaccggcacaacaaaatggttggcaccacgtaggtgtgaggctagcagataagggcaggggcgagagggtagggtacaagctggtaccgaatagtgtacccggcaggtacagggcgacacaaagccggtggcgacccggaccccccatcccatcgcgtcgtgaccacaccacaccacacgccttttactaaacccggtcgccttggccggcgcggcgcggcgcccgagcccgaccggttggtgtggtgtctggtccggtcgatgcgagcgtgagccgccctggtttgccgtgccgattccgtagtccggctcgtacggtacggctggggggcgggccagcgaaccgaccgatggcgaccgggacagcggggacgcgggggacgagctggctcgtgacagcgacacccgctgcaactgcgggggatgggcgggccccacctcggaattccgtaccgatggaaatgctgctacagtgctgctactaagggggtgtttagatggtactaaaactttttagcccatgtcacatcggatgtttggacgctaatttagagtattaaacatagactaataaaaaaattaatttcataaatgagagctaatccgcgagacgatttttttaagcctaattaatccataattatcaaaagtttactgtagcatcacattgtcaaaatcatggcgtaattagactcaaaagattcgtctcgcgaattagtcaaagcttatggaatgggttttgtaattagtatatgtttaatactccaaattagtgtcaaacatccgatgtgacagggacttggaataagtccctggaaaccaaacagcccctaaatcaattttccttttcctttgtttgtttattactcctacgtcctagaactccctgtatgacaccgttaactttttcgaacaatgtttgaccattcgttttattcaaattttctgtgcaaatataaaaatatttatgtcatacttaaaaaatatttgatgataaatcaagccacaataaaataaatgataattacataattttttttaataagacgaatggtcaaacgttgattaaaaagtcaacggcgtaatacattaaaatatggagagagtattacttttcaaaaagaatatttttgggcaattgcaaatttgccactactttgaatcgttattgcaatattgtcactaaaattataaaaatgccactagaactgtcatccgagtggtatcctaataatattaaaaaaactgatggcaaatttgtaaatgcctcgaatattttttttgttggtgtgatgggctgaactggcgattttttttcgtctctcatctggacttctcgttattctgcttgattttctatacgttacgtgtgtgtagtatgaagtcctggatgttgtaaaattttttgtggttcatagggaattgattttatgaagctgtgagaaaccgagtaatatcacatatcctatatttttttttctagagttaaatacgctggtggtaccacaaccgagaaaaaaccagataatatacgtgtagctattacttctcgatcaccatctccatataaataattgatggatagttatattgctcgatcgatgcccaaacatatactcgctccgtctcataatataagggattttgggtggatatgacacatcccattacattgaatttggatagacggtccgtccatattcactgtactaggatgtgtcacatttacctaaaatcctttatattatgggaagaggtgaatagtggattggtggtccttccacgtatgtatgaattagtaggagacattgaaagtttattaatactaatagctacttgtcctagctagcaagtcacatatatctacttgtacctgcacgtacaatagtgtacgtgtacgttgccctgagcctgaagatcttttggctcgagttctggctgtcttcttttctaagcgataaaccaggaaaaagtatatgcacggtcatgactggaggattaattgaagtaggagtgtttgtcacatattcacatatactccttttaattatgccatcattaaattggtgtggctgaaattatttcagcgtccgggggacaacctgcgcaattaagcagtgtctaaatcgtattgtcgatcatcgatcgtggtcacgagggatatgtatatatatttgtgctaaagagccatcactgatagattatggatggtgggagaactagagcttatcatgcatagttatttaggcacaaatgaattaaataactattataacaaatgttgatgaagaaatattttataacaaattgtatcgtttagtagcttagaaaacatgctcacaataattttgctaccataatagtaggaattaaagaacgggccctaatatgcacgagcttgcctgaacctcccacacatgcatgtagaagtttttagatagtcggtacatctagcatttgtttcagtatatcaagttgcaaccaatctcacccccacgttcatatgcggccaattggttcaccataacacatacaaaagacagagtgaacgtagcccaacatattaggtttctagggatggaacctgcacatccaagttcaacattaaccacttagtatgagtgctctcaattacggctaattatttttagtgattacactggtggagaaaccctttgtagtcccggttcgtaacccccctttagtcccggtttccaaaccgggagtaccaatccgggactaaagatcgctatctttagtcccgggtgaaataaccgggactaaagatagagctgaccttttttttttgcatgcccctgttgctgcatggtttacatatatatatatatatatatatatatatatatatatacatatatatatatatatatacatatatatatacatatatatacatatatatacatatatatatatacatatatatacatatatatatacatatatatacatatatatatacatatatatgtatacatacatatatatatatatatgtacatatatatatgtatacatacatatatatgtatacatacatatatatatatatatatatatatatatatatatatatacatatataaaccatgcatatatatgtttcaatacatatatatgcatacatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctatgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgatggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtttgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggtgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcatacatgtatttcacttccgccttttcgattggtgcgactcctagcaattgatccgtagttagaccggtgtcagtaataaattgttctatcgtcatttctttaccggtcaccaacggctcgatctcctggtttggttgccctccaagttgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgtaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggaggagtcgatgctggagcctgcggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttaccttcattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgtgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggttggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcctagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctatgtgacgtatattatacaaccctagctagtaaataattatatactaaatctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaaaatgtattaggataaatgcgaagtaacatatatatatacatacatatatacatatatatacatatatatatacatatatatatatatacatatatatatatatatatatatatatatatatatatatatatatatatatatatatatattgcatttcacgttaacgttcgtcctctttcgttcgctcgttcaagttccctagctcgttcacgttcgttcgctcgttctcattcacgttcgttcgtttgttctcattcacgttcgttccctcgttcttgcttgtcttcgttcgatcgttctcgttctcgctctcgttcgttcgatcgttctcgttctcgttcacgttgtcgcggcaacgtacgttgacgtgttcgttctcgctctcgttcgttcgatcgttctcgttctcgttcgttaacggcggtgtggcggcattggggcggcggttggcgcggcggcgtggcgacggcggcggcggcgtggcgttgtggggccgtggcggcggtggcgtggcgtggcgtggcggcggcggcgtggctggcggcggcggcattgcgcgcgcggcggcgaaggcggcggcggcgtggcgacggcggcggcggcgtggcgttggcatgcggcggcggcgttgcgcggcgtcgaaggcggcggcgtggcgtgtcgtcgtcgtggcgcggcgtctcgtggcgggcggcgcgacggagagagatcgagatcggagagatcgagctgcatgaagggagatctggcggcggcggctctcaccccagagatgcagcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccggttgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattcatatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacaaatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgaagtatccaacctgttaaggtcaacagttgtcatcccactgtcatcaatcattacgcctccaccagttcacctaacccattgggcccgggacaaaagaacctttgagaggcccatagtcaagttcccatatgtcctcgatggcaccgtaaacgtggaagttgttccatcgtgtcccatggcatcgacacgaacagcgctgttttggttcgtgctcttcatgtcttgggctctcgtgtagaatgtgtacccattgatctcatatccctggaatgtcgcgatagacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagttaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagatattgcaccacttcattctgaagggcttctaatctatccggatcgatgaccttctgcgaaattgcgttcatgaatgcacatagctttgttattgttgcccggacattgtctggaaggatactccttattacaactggtagcagttgtgtcatcaacacgtgacagtcatgagactttaggtttgtgaacttcttctgcttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcatgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgatgatgacccatgtatacaaccttcctacagtgcttaagatacgtactttctgtttcatccatacagtgagtgcaagccttgtaccccttgttggactgtccggataggttgtaagtgcaggccaatcgttgatggttacgaacagcagcgctcgtaggttaaactcctcctgtttgtcctcgtcccacacggggacacaatcattcttccacaactgtttaagatcttcgaccagtggtcttaggtacacgtcgatgtcgttaccaggttgctttgggccttgaataataatcggcatcattatgtacttcctcttcatgcatagccaggggggaggttgtacatacacatcgtaacgggccaagggctatggccgctgctcatttctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacctctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttaacaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaattgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtcctggttggtgctaccaaccgggactaaagatcccgggggggcctgacaggtcctgacagcattcgaaccgggactaaagatagtcccggttggtaacacaaaccgggactaaagatcaaatatgcccgttaccttttgaaccgggactaaagatcatctttagccccggtttttattgcatccgggactattgtggaaatcggccgaccgacgaaagatggtttctccaccagtgttagcaatatactcgtcgacagtaagttgtccgtgatgattttatcaatcccaaaagatgtcggttcagtcattaggttatcataccgcttgtgtttgtagtattgtgtgtttataacaaaaaggatgcatgcaaaaggctagtccaggtcaagaaagactgatatatagaaaatgaggcagcttgatgtatatatgcgtgcatgccacacacacacacatatatatataggcaacaagtctaaatttaagtatttttccgagtcaaagtagactagctacgcgggtagaaaacgactcctgcagccaagattagtatatatagtagtatgtatagaagtacgtagaattggttcttcgtcgtagatgaatgcagcagcatacacagcttcctggaaacaacaatctttaaacggcgatcgaagtcaccaccggcaacggctgttttaccaccgtcgtcgcacgctagctagcttagctgcgtgccggccggtcaccgttgttggctttaatttctgatcggttggtttagtttgtgagtggatggtcggtgggacccatcgaccggcaatctaggatctattcggaagagcttctgacaactatactttatcttagaactagaaattcccctaaacaatacatttttttcacatttaaaaagttatatacaagctgataaaaaccctattttttcggattttgatcagaaactaactaacagctactcccttcatccctaaatataagggattatgggtatgtgatatattccaagactatggatctgacatttgtccatcctaagatatctgtccagatttatagtcttaggatatgtcacaatcacctataatctcttatattttggtagggaggcgggagtatttctcaaagtcttaaattccctaaaacaagtctctaatgacagtgtgcagtgtgggtgggtcccatgtcgatcggtcggccatgtgcctgcctgcctgcctagctaaaattaagagccgtactcccgcgttactgaacagtacacacgcacgcgcgtggacacgagattatatttgagatggagtatatatatctagctagctatagtttgcatgtatgaatgtatgggccatatgcgatgcaatgaaatgcaacttggtagagagggtagcgatcgaatatccaccaccgtcacggcgcattaatttgcttaagttggctgttcggcccgtgcatatgggtgtactcgttttcgatcgatctctcaaattttaagatgtttctagtggaactatgatctattgcctcttacatctcgctcttttgtgcatgccgaatggctaaaaaatttagttggttcggaacagatgattagcttagatttttgaaagcatgtaaaataagatatccctccgtcgcaaaatatagcaacctttactggataggacacatcctagtacaataaatctagacatactcatgtctagattctttgcacttgtcccatccagtataagattgctatattttaggacatagagagtaagttatttctatatggtaattagtcgagtattaattataataaatttagaaaaatatatttattaacttatatgtaaaaaacttttgcacgaaatgtatcacttaacagtttgggaaatgtattcatcaagaaattgtgatgtagtcgcttcaagtagctatttaaaacttacccttagttattagtgatcatcattcgagtgtgcaagcgaacaaatcgtataaaattataaacatgatttaagaaagtcttctcataaatacaatcatacaatgcgtttgcaagaatgacaccatttgaaaatccgtgaagctatagttatactatgtgtgtaggattttttttatataaaaaaacaactttttataggcaaattgctcataaagatcacagtacatactttgctttctcagccacatatcgatgctttgtgacaacaagatcaaaagggctaaaagataacaagataattggattcctacggcacgcaatgaagtacagtactacgcatcttggagatcgacttggagcgcaccatgcattgcatacacacacacacgctattgttcatcgatccatgaacagcaacctacaacaagtagcaaagcaaaagggcaccaacccaaaatggggcacacacatgcattaattgtcacgatgacctgtcacgtactgtcatgtggggcccacacactgctctgctagtacgtactagtacctacctgtcctcccacgtacgcgtgtacggcgatgacgtcagcggcccactgtcgttggagtccacgtggaccgtacacgcgtacgggtgctgtccggaatcacggtacggtgtacacgtattacgaccctatctcttctcactcttttgagagaaaattcaacgccgcatgcattacatgtgcttgctagcaataacaattactccctccgtttcaaaatatttgacgccgttaacttttttaaacatgtttgaccgttcgtcttattcaaaaattttaagtaattattaattattttcctatcatttgattcattattaaatacattcttatgtaggcatataattttacatatttcacaaaagtttttgaataagacaaacggtcaaacatgtggtaataagtcaacggtgttaaacattttgaaacggatgaagtattaagagtcaattactttgaccaatgtaattttctctccgttcttgcattagtcttagtcatgccggcctggttaaatatatcaccactcgtacatgtgtaagctcctcgagttgtgtcaatcgcacgaagcttcgtaataggttttgttttggtttgaagatagaactgtcgtatgatgctttctgaatttattcctgatcgatgacctacttatacgtactaaacgtgtgttaaaaggctgaacttaggttgcgttgttgtcctgagttgggaaccttctcctccggaaaaaaacaaaacaaatcattagcgcatgattaatcaagtatcaactaaaactaacttaaaaaatatattactatgattttttaaagcaacttttataaatattttttttaaaaaaatacacacgtttagccgtttaaaaagcgacgtacgcgtaaaagatgaggggtataagttggtaaagctaattaccaaacgagcaaccttaaaagtgtgcgggtatgcatgtgcacgtgcatgtaattgaaaaagaatagtatggaaatatactttgtgaaatataaaagtgtcctgtatatataattaaccacgcacgagtcaaacttgtgaattgtagacctatttgggatttaaaatttaacggtagttgttactactgctccactttggtgcatgcctggatcgcatatcatatctcatgctctccaatctttatcatatcttcccatgctttccttttttctttcttgatgaaaagaaaaagaaaagtgaaaaaaaaagatgatactactggattgttaggaccgtttggctcatctttccgtaccactagctactaccataccgtacctacgcgtacgaatactgcacggtggtcaagttgcagcatactataatatggtactattgcatgccacgaaagcgacccgtcggccacacgcaagaaagcacgacttttgatctcgatacatcaaaccatatatgcatatctttcggttgtcaccaagaacaacataactttaatttgacgacagctatatataaaaggaaaaaaaataattaatcttccttttagaatatgattatccttgagaaggtcgggacgggagagagtattttctaatataaaatttgatagtaccaggcacgaggtattttaaagtatcaaaatctttaattagtatataattttagtataagtatgttttcaaacactgtaaatttctttttaagataatggaatgaattatgatatttgcttcaaacaagcttcaatcgcttgttacaacggacgttctctcaacaaagataaactaaacaatttcaacaaattaatggagggcaaaagctaagactaatatatctaaaaaatatatttatctaagtatattataaatcttcatctgaaatgggtaaatatatgtataactatatatggactccaaattttagcatgcaacatgtaatagttccttgtaaattaattaacgtctaggatcaggagcaagaataggactagacgatcaattaattagctcggatgcatcatgcgtgagatatttcaaacacgggtgttattttaatggcgtactatgatcagttcgctgtttgtttttcaaaagctatctgctgaaaggcacgttgtgcttttctcctactcacatcccgatctttttgactcggagtctactagaatggactatgtcttgcgattaaattaactcacgaataaactaactgctaatctagacatcggaccttaattaaaaaggtgttgttagttatggtacggtcccgcttaattaaacgacgagtatgcatattttactgcaaacttcgatcaactagctgcttctagcgtgatatataccttaattttatgccgccttaactagttaactgtaattgtcttgtcaaattagcatattcttatgagatggtttagtttctagatactaaaaattatccataaatttcaataacttttggacagtccaaattatgttaagatctttgcttacactacagtaaccatcgttctcttctccctcaccgacatgtattccaaaatacatattccaaactatcaatattgttgggctaggtggcagctagctcaacgtattccaagtctttgatagctagcgccatatatctaagatgctctcaccttcaactaggggtggacaaaaagctcgggctcgtgagctcggctcgggcttggctcgagctcgtgaagctcggctcggctcgaagattaaacgagccgagcccgagctctctccacagctcgtttgcaaatcgagccgagcccgagctagctcgcaagccgcacagtaggctcgtcaagcctgtggaaaacatgagtacatgtcctgacctggcccattaacaagttgtttcagtctagcccatgagaaacagagaaccctaccctaccctaaccgctcgctgaccctccccattccccatcccacgcaggcgcaggcacgccgccgctcgcgcgcacgaatagcgtctggcggcgattggcgagaggagttgccgggccgccgcctccggctccctcccctgcgccgccggcccgccgtctccctccccagtccctagtcgcccctcggtgccgccggcccaccgcatccctcctctgtgcggctgcgccggctccggcctccctcccaagcgacacttgacgatcaacggctcgacgcttcgtgccgccgcggcaccgcctccctcccctacgttgcctctggcctccctccccagtgccgctcgagctcgacgtcccctgcgtcgccggccctacttgttgcttacatcgcaagccggctcgagccggctcaagcttttatacaagccaagccgagctgcactttttgctcgttccatttatcaagccgagccaagctaagcctgttcttgatcaagctttcacgagccgagccgagcttagctcggtttggctcgtttccacccctaccttcaaccactccgatttcccatactcacaatccagatccacccttatagcaatcccctaatctaattaaatggcaatcaagcatgcctgcatgtatactaagtgtcccttctatcttagccatataaacatatcgatattaaaagttgcttagggctgttcagattgatgttattttcaagcatactgttttttttacaaaattatataaaaaaacaagtgtctaaatttattttttttgttaaacttagataaatacataagaaatcatgctaaaattttgacaatattgacaacttgccaaattttcggtgttgccaaaatttcgtaaggtttattttggttacgacctgaatagccccttagtaaatttatagacctcaccaaattaacctctacatttgcgatattgagatgaactgacagccatgcacatacgaaacctatcaaccgcggaactgccaaatagtttttcgtaggtgaagtatttctggtgtttataacgacgctaattaaaattatggatgattcagtaaattgaaggcatcgatttgcgtggcgttgtatctcgatgccacaatattttacacggtgtttgtaccgtacgtgtgaagagctagctagcacgcgagaataatggtcgtcaaaagcttcgctttctacggtgccgtcctcttgttaatttcccctccagagtcttctagaagatctcctcgatcaatcgatcgattctttaatttctacacctgctaggtaggagtagctagcagctgcctttttttttaatttcttttttttctgaaaccaaatttatttttcctttctgctgacaacgatagcagagggcgattttttttggtcgtcaaatcgaattaattgtggttgggttaatttttaccagcgcgtataaatatacatcatctatacgtgtcttgccgtctctgtgccgtacgtaggtaatcgccgtgtttagttttcaaaatatttcttcaaactttcaacttttccatcatatcaaaactttcctatacacatatacttccaatttttttatcacatcgttttaatttcaaccaatctttcaattttagcgtgaactaaacatagtctatatgtacgtattctgtggcgtcgacgtcgagtgaaagcgtaggcggccatcgtcttctacaaaccgtgtagaatttaccttccgtcgacatctgctcgatcctttttccactgatgatggagacaccggctagctctcacagtctcactcttggtccattcacctgtgactgtgaagggacatgtaccgactgggctggaaaaattaatctagtgatgatggataactgtattttctcctttaatacatgctgcaaatgttgctataacattgttccaaattggagagatttctgcaagaaaggtattggcatcacaattcacacaagatctatcatagctagtcgaactgtaatggtcttatgctagtatgagtagaggacgtactcatggaatgtgagtgtacgtatcttccatataatcgaagagttttttttcttttttacggttttgctatttcacttttgacagattttggacttctatctttcgttttttttatccgtatatgatattgcatcaagatttatatttctataaatctaacttgcagttacactcagttacagagcacttgcactcacttacgatgtatatcaaaattagattttacaacaatattttttctctagattgacgatttttgatatatttgtctttttttttgttttatttcattcacaaagatatgcatctattagttaaaaatcctgtaagatttgaagctctccatcgaaagatttgataaaatagtcccaaaaaaatagggggctcctagctaacgcgtgctcgctgctagcgagcactcctcccctattaactacctctattaacactattagttaatatacttaattacctctattagttaatatacttaacactaatgatagtaattagaaaagattcgggagatttttttactaacagattaaaaaaattttatgttagatttgaaaattttcgatttaaattttaaaatttaaagttaaattttgaaaactttcaactcagaaatgaaaactttcaactcaagattcgaaaactttcaagtccagatttgaaaattttgaaaactttcaatttaagatttgaaaactttcaactcaagattctaaaactttcaagtccagatttgaaaattttgaaaactttcaaatcaagatttgaaaactttcaactcgagattcgaaaactttcaagtccagatttgaaaattttgaaaactttcaaatcgagatttgaaaactttcaactcgagatttaaaaactttctagtccagatttgaaaattttcaactcaaaatttaaaactttaaactcaaaacatgctaaagattaaaaaaataatcagaaaaaaaggaaaatgcgaaaaaaaatgggtaaagaaaaacaaaaaaaaagagtgggaggcgtgcgcgcgccggcgctgggccttatgggccggaaacgcgcgccgattagcaatcgcgcaaaaaataggaccgaggaaataataaatcgatctcgtattcgtttgggcgttaggagcattgggccacggcccacatagcccaacagagaagctcactgggcctctaacttccctctccaacgtcctcgccctctctcgntaagacgctaacgaccaaagcgtccgcgagtcgcgacagctcaaagccgcacgcaacgccaccactgctccgccgccgccgccacgcgccgccgcgattcctccccccgccgatcgaacgccacgcgcgcccgccgcggaaaccctagcctcctccttcgctcgcccgagcgccgtcggcgggaggaggattacttttggtcctgcgcgcgaatcgcggatcgcgattcgcgctagggtttcggccccgtgtgccccgacggccgcctggtccccgctacgccggcgacctcacgcggaatcgagaggtaaagtggtagtaggagaggaggatgagggtgcgacgggtcaggatacctcgtgttcgtcttcgatttgtgttttgcggaggtgtcgtgggaatcgccctagtggattaacttctggcgatttaaaattttgccgatttcttgggggtaacctagagattctggatggtgtcatgatagtttgactttgtgctgctgctgcctgtgtgtatgtgaattctaagccatggcatatcgtaatttactaccttagaattcggaggcttattgagattttaatcatgatctaatgaatcaagtatagtttttgtttagggtgcctgtgcagttgctgcaacagcatttgactttacaacattgtgccaagtccagtggctccacctctgacacttccatgtccactatcaaatctacaattttatatgcaaaatcatataccaaatagtccaatttctatcgtccccttcattctccaccgtcccatctacgtacaaaatcgtaaaccaagtggctataatatggaatcttgtaacttgtgaagttggtttattacttggaattgctaatcacatggtggagggatttctaagaaggggaacagacacttgctataaaaaaaagtgaaacttgaaaagtggaatttgatattgagatgattagcaatcaaaggaacgtcctcttgattagttgattgaatgtgcagtagaagggtgccagtatggtggttttcgtgttggcatttgcttaaccttgtgatatcatgcatctcttacaggacagtagaaaaatctacacccaaaattctgaagatctccaagaactttgcagtctaacatcagtgccgaatatcagaaatggatcatgggcgttatgctccacagcatggatgggagaacaacagtgtaattgaagcctttccctttattagctaacaaggaatagcagatttgctggccatgtggttggccagcattgtgatgtaaagaatttgaagaagcggccattgcttaaatggaatgggttacatgcctgttctgtagacttacttgctgactcaacttctgttgaatctacaggcattggatgggtatggtgtcatcaatggcccagattataggtaagtcaataagctattgtgatggtatgttagattgttagcggttgtagtcatgcacatcttccattctattcgacttacttttgaagtgtgctcagctataatttattgggagtagttgcaatatttttttccattatgacatgttgtccactttaatgtgctctgtcatattaccatattttctacaattgactcaaattgcagggccggtggatcctacaatggtaggaggtttgtggatgatggcttcccaggagattcatatggaaggggggcattctatcaggacacacatgatagaaatgtgtatccacctgcaccctctgtccccatgttgtctcaacctcgaaggtttcatgatgatgaatattcaactgctagagat

SEQ ID NO: 16491 - DNA, 8368 bp, Oryza sativa
tggttggtttgttgccttgcttagctgcaaatgtggaactctacattcccctgacttgtagtaaactgtaatttttcgcgagttgttgaaggcattttaattcgaactgacacttttacacttgcaagtgtaactgcaagctactaaaatggtagtagaatctaggggctgtaattcaagttacctttgagcccagcttatcttaaggttgtttctggtgcaatactctgatatttgctagaatgatagatgcagttaggaaaataatgcagcatattgttgtttagttctactgaataggtatgctatgtggtttctgtcacattcacacatcagtagttcacttggtggtgccttaagtgaagcgcttatgattcacgctgatgtgttgcagtttgtgttcaacatcaactgaatattgggtaggaattaatgtatgtgctccatttgccacaggatttcaagtctgccactctctaggaggaggaactggttctggtatgggtaccctgctcatctcaaagatcagggaggagtacccggacaggatgatgttgacattctcagttttcccctcaccaaaggtttctgataccgtggtggaaccttacaatgccacactatctgtccatcagcttgttgagaatgccgatgagtgcatggtacttgacaatgaagctctatatgacatctgcttccgcactctgaagctcgccacacccactgtaagtgaaaacatgccataattatggtactgtgctcagttatcgtactctgctctatgtggttattgatcattgatttcatcctggtacatcagagcagtttataatcagtcacctttatgtcagatgccactaccaatttactcttttgtgaagtacggagtataatgaattagctggtccatgttccccattgttgtgtgtttcatgcatcctggcactacttgatcaattaatgagtatgtctggaacttgcattcgaatacactgatactgaatatatagatgataagtctgtactacatgtatggggtctacagtgttgatatgaatatgggtttcttcatgctgttttacctaattctgactctgctttgtttctttccttttgcagttggtgatctgaaccatcttatttctgcaaccatgagtggtgttacatgctgcctgcgcttcccgggacagctgaactctgacctccgcaagctggcggttaacttgatccccttccctcgtctccatttcttcatggtcggctttgcaccgctgacctcgaggggatcccagcagtaccgcgccctcactgtcccggagctgacccagcagatgtgggacgccaagaacatgatgtgcgccgccgaccccaggcacggacgctacctcacggcgtcagccatgttccgcgggaaatgagcaccaaggaggtggacgagcagatgctcaacgtccagaacaagaactcgtcctacttcgtggagtggatcccgaacaacgtgaagtcgagcgtgtgcgacatccctcccaacggcctgaagatggcgtccaccttcatcggcaactcgacgtcgatccaggagatgttccgccgcgtgagcgagcagttcacggccatgttcaggaggaaggccttcttgcactggtacaccggggaggggatggacgagatggagttcaccgaggccgagagcaacatgaacgacctggtggccgagtaccagcagtaccaggacgcgacagccgacgacgaggaagaggactacggcgacgaggaggaagacgaggttgctgcctaagccacctacctgcctgccattcctctcgctctcgtcatccatcgtagatgatgattgagatgtgctcccttgtgttattattacctagtactgtattgcaactgtcgatctgggtcgtaagatgtttattttaggtgatttgatgctctagttactcttttttttccttgtgttgattaatggtgtgttgtcgatgcgaattgtgatactagctttaactgtggacttaaattactagatcctggaattgatactgtttgccagtaatatcgtgtgttgcgtgatcattattttttccactacgaatacactgcgatgtcattagtgggcgtgtgctaggatgtaaacgtggatgcagttgttctaagcctccgtggtttgcttgttatctatcttatacagccaaaatttgaaatctggaacttaattttaagttaattttggggttcattcatctttcatttcccatatcgacttttaaaatacaatggcatgtgtatataagttgtgcccataaattactttggggtgcttagttcatttcccacggctgatgagccgtagatggaacaatcagagctgcaacttttgtagtattcgttttctgagccctaaatagctataatacttatacttgtttggtttgttttatagataatggaatttatttgagacaaatcggagtcagtaatggactttttcaaattttttggattcaagaattgtatcgatgtcccattcgaacaggcatcaaagtcgttgtagtatagtggtgagtattcccgcctgtcacgcaggtgtgacccgggttcgatccccggcaacggcgtttccattttttttaatatgaacgcgtctagtccgaatcgaattttggtcgggtacatatattttttacaccgatcgattcataccaacgatcgatcctacattgacaagttccaatgttgcgttgctccggcgaatcagatcatcgtcgactaatggccggtaccggcggcggcaaccagcagcgtcaacgacagtatggacggctacctgcttagtagtgtagtgttctggaaaaacattccaaatggtaacaatttttttgccaatgccaacaaagattagcttcaaacaaaatggtgccaaattttggtatggttgagaatggaaacaaaccaaattttggtatggttgagaaatatcacaaacatcgatatttaatagtcatacgacaagagctctcaataatttaaaatttaatcatactatatgccaggatcaagtctgctcaacacaagcacaatcaagtgatgcagggacaaataccacgagtaaaacattactacatcgacattacaacaaaaattggcaatacagctcaagacatctccctgaatcttgccatagccttcttctggatgatggttttgtagctatcaccagcttgcgcctccagcgacgggtcagaagatttccgctgctgacttccaagtccagccctcacatcgacagatttagcctgcactggttccttgatgccactaccagtttttccgagaccctgaatatttgcgaaggaatagcaagcaaaagagattgccaatgtatactcaagtcagagaatattcgatttacacagcttccagactgaggaaatattggcaaattgattcttctgcagtcacagttaacttctcttgtctcacaaactactcaagcctactggagctattttccctcaagcattagtgatcagtaatttccacatttattctagccttacgaggtagagccaacaaacacaagtaaatcacaagaaatgatagtttatgggtcaaacaagatgataatataatccactaaatttccttgcgaggaagcctaccagcgagattcgacaatcaataagtcaatacattagctttacccataacagataaagatttgctcaactcagtcacaagtgcaggaaataaaattctacagcctatataatgcaacggcaagcccaatataaaaaacaatgagtggctggacaaacaaaaacggacaccagaaagaattattcaaatacaggcagcagcaaggaaagccatcaaagagtaataaacaaaattagttatagaacgtaccagtccttcttgccaacccatattgcgcagaatacgattgcccacattgctctcatctattgctctatcagcagtgataacctcataattttcagtattgccaatttcaccgctagaacgttcacccacccctggaggaaatggcattgaccccatctcacttggaccccttcgagggtactcaccagcttgacaaggaatatccagataattaatacaagtcgatcaagctatataaagagaaatagccttttattgtgccccctccgattgtgaatacctagttctactacaagtttacaactttatcaatttacgtatatttgtaatctaatgtttccttaaggtcatgccaaaaaatactccactcaactctacccatatcactgcgttttactatcttttagtttgcatgcttgtggtgttattgggagtctctggtcttattttattcaattcatgatgtgctttggtcaaagtgacaagtatctatgagtatattttacaagctaaatagaaagtactgtaatgacaaaaaaagctatgctgtggatggatagtaaactcttgtgctaaacaaatgaggctagaaaataatgtctgtgagagcattcttacttggatccagtccatcattatcacttccaagtgaagaagatgatccatatagatttcgcctttctgcagcccgatctctgtactgtgaatgtcctggagcctcagaaaaccgacgtttaccactccctgaaactccagatggagtataagatgctagagcagataattctgttttgaagggagcagaagtaggtgccccagcatttgctgttaacccacatgtgcttgttggtatgttggagaaagaatcagcaccaccagcatcagatggcgcatgaaatgcagtgtctgatctgactattcctctaccagagcctcttatgacacccataatggtagttcctaaactgttactgacaggtgtaggctttatatcagaatctatcatttctgtgggtgcagctgttcgtccaagagaattatagctagcaggcgagttcatgtccttagcatttccaacatcagatttaggcttagctttcactgcaaatccagttgaattgtgtaaattgtttaatttatcatcagcagagttggatggttccttgtcatcaaggatagcacgccctgcctggccttcttgatttctttgtttccacattgctaggacattattcatctttttcttattcgccaaaagactaccttttgatgccaacttgatctcttttgctctctccttttctttcttttctgcagccagcgctgcacttgcagcagcttgaacagcttcaggtaatgaagttttctcactttgtttaatcgtggctgcaggtgcagaaatcactacatttttaccactactttctgaggtcttcgtgctagtatttgccatgtccccagctgctttactgctgttctgttcactacaagggacatactgttgagtttgttgatcatatgaataccacactccagcattaccatcatagtaaagtcctgaaaacaaatacaaggttataaactgtaatactttaacaattgacatggagcaaacatttttttttaaaaaaaaggaaaattggaaaacatttcaaaaacaagtcacatggaaagtatttctgaattgatcatagtaagaaaattgtggcaatatacataccggtatttccatcataatagaatcctgaggctgaatcatagtaataaccagacttttcatcccaaacaaatccagactgtggagcagagccactgctctgaggttccgagttgctattcagtttgtcatcaggattgtactcttttggggcccaacctatagcatcatactggtccaaagggtaaaagaaataaaataataagcatcatgtctataatctgcataaattgtatgtgaaaaacaattgcaccttaccctacagggtgagaaattattggttttagtgcatcatttaatggagttacataacagcagttctcattttcttcaatgcactgtttactttcctgtgcacatggtgacaaattacaagtaggggctacaactgacctgctgagaaaatgatgcagcctcaatggcagctgcagcaaggctgtttgactgtgaagcccctgataccggtccatgtgtgcttttagcataagttacacgtaaaacctgaccattcttctcaagtgtaatcccattcgtagcttcaagagcttttgtagcttcttccacctaacacaattggatgcagataaatatgggagtagacatcaaaggaaaactcaacatttttcccaccactacttactgaatgaaaatggatgaaagcaaaacctctggacacatgagtaaacttatcccgaacaaggcgaatgtcctgcacaacaacagcatgtcattctctcaacagaaacggaacactgcaaatttcaagagtcataagcttcttcccacctttataggtgcatgcttggcaaattcatatcgaagcatttcctcgtcagcattttcatccagaccacgaacaactaaaacatgagttggacctgaaaatgctagtgtctaataaggcaactggcaaaatagttttaataatcctacaatagaagaacagagctttgcctagttcagatcccctttttggatggagtggagtagaacttgttggatcagctggtagagaatcttccgttcgtggttcattacactacaagaatagaatgcaattaggcaaaaaaaaatcaagagcttaaataaacaaacatacaatcagttagaaagaaatgttattcccctgatgcctttataattgtcatcttggtccttggagatagacaaagtagttttcatgacaaattcactaatggcattttccatgtgacacatcttattattttgtttatatttatactagtggctaatgatccaaacatcatgagttaatccaaaagcttacagtttatgcaattatgacactacttaatttgcaacttctcattaacaatagggatgtgaatcgaaagggaaaacagtactccatcaaggaaatcgaggacagagaaacaatccaagcatgctagattggatttataaacagaaatgacatcatgcaaacttctgtaagacaatactaaatgcaatgggtattgcgatgaagaacacgcctacaaaaataatttacaacaatacagagtaaaacatacctgaaaacatgaagttctgcgagcaaagttcatgcatccacatatagtacatatccaatcacatggcgcagcagcagtcctgtgcccatagttataccttgtaaaattttcttctccatgagaaggcccactcatcccactagttggtttactactgcagtaaacaagttgccagcagtaattacagtggaagaaaaagatataagtatatacttttgcaaaaggtaagatgcatgtaaattgttttttctcaatgtgtccttctgcaaaactaagcttgatgcaagtaatacacactagacaaagacatgaataacatccaaaagaaaggaacgagcaacttaacacactgtgaatctttaacacaccaatggtagattgactgttttgcatcgcaagcttatcacaatataaaaacatttacatgaccttagcaatatgctaccaaaataattagatatttttgtgccctatttggtcagtcatatgctatttggatcattgtattgctaatgcaatcacatagttcaattgaaaaaccttaagtgggaaaatagtgagcagtgaaacaacaaaaggcagagccacacgagaatttggtatatgaaagacatgctccagtgaaaaattactattacatgatgcacccagtttaaacagttcaaccattattgaaccatcgaatatgctgcaattgtgttgttcacacctcagtatcacgtaaagcagactactcaacaatgttacatacaagtaaactggtgaataaatatagacgacttcagctattataagaaaacaaaaagggcacgtacctgtactgaaaaaatacctttctaccatcaattagaaggccattgtctccaacaccttccatcattctgcgggcagcttcctgtagagtacaataaaatttctgagcatgacactacacgacggtctgaacaggtaaggtgatagatcttttacggttaataccacagtagggaagtcgataaaagcaaatccccgagacatgccagaagatcgttccttaattacgcgcacactacggagagggccccactcagcctaaaagatatcagactccaaatgattaaatcgaaccagacaatacacttgcaaccagtttaacagtttatgaagaggaacttgtacaagaatctggtttaggtcatcttcattagtcttctgggac

SEQ ID NO: 16492 - DNA, 1099 bp, Oryza sativa
gccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagtgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggg

SEQ ID NO: 16493 - DNA, 364 bp, Oryza sativa
acctaacttagggccttcaattgagctaccactgctactatttgcatcattgaaggtcttctgccttttaaagttaagtttctctatttttgcctataaattgaatcatcagtgaaagaatgccaacattgggttaccaggcgtaagcacctgagatagagtaacagatatcataatgtggagaaggcacctctgttatgctgtttatatacaaggatttgtaggtacaaactgaccttaacagatactgtgcgcaatgcacacctacatctttagatatcagataatcaacaagcaccaagtgatcatagtgcagctgcagaatgacattaaaataaacaaatactattatcctcaagactca

SEQ ID NO: 16494 - DNA, 1102 bp, Oryza sativa
ccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacg

SEQ ID NO: 16495 - DNA, 39625 bp, Oryza sativa
  unsure (1)..(39625): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctttcattcttttctgcttctagaacggaagatatgattggccaaatggtcattccaatgaggttacagccatttttcagaatctgttccccgtttttccaacacacacatgacaacagagagtatacgcaattaattatgcatgtgtatacgatatgtaagtacgtcgtccttgcatatagctaacgttgtcatgagtcaaaacatctctgtcgagcctggatgaaaagtccaaccattggtgtcgtcgtgtctgtatatctaaagttcaaatgcattctaatttctgtatagttttagccggcatatgctgcgaaactatgccgctgggttgtctgggagactacactactaagggcatttcttgtgtcctaatcactagggagagtccgtacgtcctgcaagcatcgttcttaactaaacatgcaagagcttgtgcttttcatctagagttagttctagatggtaatgtgacagactgacagttatggttgtaacagtgttgatgttttcattgaaatatattgttgagagaggtgtaaattttgtacagtgcttatcttatgaaatataaaaccagctaagctggctaaggtttaaaaaaagagagaggtgtaaaaacagaagcaaatttgtcgttgcgtactaaaaaataataatcaatgcaagcatgtacgtcacaaatgacagcttgaaatatctttgtgacaatcccaggtatgaaagtagtatcgatggaattgagagttacaactgctagcctgctaactagagaagatatcactgattaaagattattgggcacagatatcccaatgtttcggacggctaagcagtatacggccagtaccctagtccacatttccacactaatcaaatccccagataatgtaaaaaagagtggaaaacaaagaaacattaacatttgctctctagagtcagaaattagcatgttaaaaaatcagtaggaaataaaatatttataatacattattgatatggcaaaggtcagtggcataaaaaatatagttatagtaaagtttttaccagtgtattagtactttggtgtctgggttggaaatcagctattcaaagcctagtgaatgtattgcaaatccaagcgtttttatgcagaaaggcctccacctgaggcagggcctagatatagttcggcccagaagttggatacaaagataacaatcagggcctaatcgttttggaggaattttaaaggatttggatttctagggattaattcttatgaatatcatacggttcataggaatttagatataagaaaaccaaaataaattttcctttctaattgtggagagaaaacaagggaaaattttcatccacacaaacctcatgaaaaaaatcctatgaattgaagtgtgcatgcattcctattactccacacacacatgctcccagctaatctgccacccaaagtaaaatcaagttgcgcgttttccggcaatgcgcgcggctagctagctttctcctgtccgctccgctgcatgattcgtgctccagtaacgcagcgatggtgcggggggttgtggacttgtggatgaacaccggaaaggcagcgtgcaatggatcaatatactgctctttctttggatctctagggcctctcatcaaatttgacgatttgggatcagtgagagtgtgagacgcttatgtttctcaatgcaaacattaattgtcagaagaaaaaacagtctgggcccgctccgtgctcatgttgtacagaagaaaaatatgttgaggcgccacttgaattcagaagcattgcactgaacaatacattagcacattatgagcaagttgggcttttgtttttgggtggataaattgtgctgttcttttggttcattgaactagttgcaagttggttacatccacgctgtactactacatatcaagttgcagataaaccatttcgttatttatatcaccaattcaccatgtaggctttaaccctttgcccaggctggaccatgtgaacagtacatgcatgatgtgtaattgtgttttcaaagtacagttttgagccccacaggtcacacacgcttagagagaagtatatccttttctgtcagatactcatccaaagtatactctagcccagtcaaaatccaatatcttctattgcccagaaataggtcaaaattcattgaaataggaatcagacataactaatggagtggtacctccacagaagaaatcagctgagttagtcatatttacagtttgctagtttggttcccatgctgaaagagcaaagatgatacgccccttccaaccttgcagcatccatttgttatcttcgtcaactaggaaatccctgtggtaggatttcttcaccttgtatcttgccttcttcaccgtctcttggttcagtggtagctgcttgaagcctgccctgatgttcctcacctgccattgcttgtacgtctctggtctttctactctctcagtgccctcacaagcaaccacattaagagcttcccggccgaagagatctctttctatcagcagcctgttttcgtcgacccgtgaagcagttgtttcaagcatatcaaaaagtgaagagtagtagaacaaagcctccttgaatcgtgtcacgaagaagggcgcattgtaggtgccattgacaacgccatggatgaacaaatttggattcatctttcttattgtcttcagaacctgcattcttgggctgtcatctgtcaccatttcgtccatcatgtttctcatccggaaaaggcagttaacaacaagaagttcatccttgtctttgtctatcttaagatcttcgacacggatagtgtcccacttggcagcaatagcatggtattcaaatggaacattgaacatacgggcatagtcatgcaaccgacggcccgtcgcctcaatgagttgtgcagggcggaatcccggctgtggtaagtcaacaccggtgattcgaacacttggagggccaccaggtctcttcgagatccgctggaagaagattggccactggaatccatactgtataccatagtcaacaatgtgcaaccttgtcatacccttggatgcgttcaagatggcttcgatcgagaagaagttcgatattttcttgaacgggcatgctgtaacatacagcttgaatgcattcaatatgtcataaacagaagttcgcttggcagcaagtgaacggtaaatgttgctgccagtgccagctagccgagcctccaacgcattagcaaaacaatgtgctaacctctgaccggcatctccatatgcagaagaacgctgcctaatttgtttcagcaactcattggagttccggtgatcatcgattgcagcggcctgggcacaatgaatgagtagggtagtgagatcaaccgcatcatcctctgcagatgctccagattttcctttctttcggcctctcttatttccagatcctttcacgtacaccccgcagttccgtgcttcagctggcagtggtgcccggagctcgcattcgccattacacagaagcaccttgtcaaacatctctctgacagtctcctcctcagacactgccaactgcttgctcctcctgctctcttcctcgaacaataggcaatcatcatgcgggttcttccggcctttatgaacagcacactcccccttctccttctcaaattcacaaggcgctggctggcaagcggcatgtgtggttgtgaacgtatcaagcaatcctccattccccgtgaaatcacaacaagaatctatccaagaattctcttgacaggcctcttggctagcagtgaggatgtcaacgaatggcttctcgacggcgaggagggcagagtcctccaccgatgtgatggtgccaggacaagattcatcttcctcatcttcaagaagaaactgattgatgtatgctaggaccgcatcgtcggcggattcagacagatcctctgaattttccaactcggttgtggttgatgtggggcttggggtcgagccaaacataccagctggtgatctatgggaatcatcagcagaactgatgaatccgttggaagggaagaactggagggggaaattgagcaagtgaggcgcaggtggattggggatggagaacaaatccccatagtcaacatcatcataagaaccagaatccaacatgactcttgaatcttcgaacaagatccacccttttacttactgactaacaatacccttttctctgcaaattaaacacaaggatctcactaaagagaactgaacaaataccataaaaatctgttcttttttaccataaaaatctgacggtgctatggtatagaaattttacaagcatgccatggtaccttattgtttcaagtatatactcctactcatattccagaatgtaaaaaacacatgttacctcacaaagcgaaagccatggaagaacaggctcttcaccaagatctgcgaaaaaaaaaaagctgcttgcttgctagctagccgcagcttgcgactccaagaacagaacacttgctaagcactgcagtctttttcatccaaaatcaatcttggatttttgcctttatgacgcagaacttcaggaagaaactagaaagcagatggtgatttgtggtcgttgcggtggagaggagaggcacagggagtcccaactcccaactcccaagagcctcggttggcttggtgctggaggcgaattgattaatgtgtgatgtgtttgctgttaaaagcgtgacagcctgtcttctcgctcgtaaaagcgtgcttaacgttaactaatcgccccccctcataagagcaaggataataatgggctataagcaaactatatactttatgtggaagagagataaggaaaagtgggtagtattggctctcatgcaagagttagctccacacaacctccaaaaaatatgcattaaatttatggagtgagaaagagagagaatggaaaaaataaagttaaccttatagaaaaaataaagttaaccttacaactaacttattatataagttaactctaaatttatagtaagcagtgagctttactattaaatttgctcttcgccattctaggaagagtatggtcaattggttaagtatactagtactactttcattagtacacctgcagcttttaagcgattaatcaaacaaggtggtcaagtgggaaagaaagggggatgcaccactgcaagggtacctcaggtctcaacaggacaggatgcgaaggtggaggattttctgcaacagataattgtgcttttaggttgagccttgttgatgcaaccaacgacgataacagtcctccgtcatgttatccgaattgaattaatacaaccattccaaaataagctgatataaaataaatatattttaatataatgttccaatcttatactagattagtttaatttgacgaagagagtacgaattttttgagtccgacaaaagctgtacgtatatgtttcgttattcatcgttcatgcgcatgtacgacagtagaatatgttggagagtcgggtgtgtttagttcctgaaaaaagttgaaagtttgaaaaaagttaggagtttgaaaaaaaagttaaaagtttatatgtgtagaaaaaattttgatgtgatatgatgtgatggaaagttgggaatagagggaaactaaacacggcctcgaatactcacttgatccacaccgatgcatttatcacgattgtcatcctgtttggtcgaggtatccgttgtttgtcgtacagacatatgtatgatagtagaatccgttgaagagttgaatactcagtcaatccatgccgatacatctatcacatttgctagttaccgtatcttttcctttcatttcttaaagcatttccgattggtatcattttgtccgactttagctcttttcatgtgtctttaattacaccacacgtgatctatatgccgaggagatccatgtaacacttgttgatgacgttgtcataggcctgacacccatagcggtggtagtgggcgagaaggataggcaaagcgaaaggatcgcagtggtgatggcatgcatgtcgaccgttcagagtacagtataagctctatgacgagtttaaatacgtgttaaatatatagggtgatgtgtttctagtaatacagatgtataaagtatttatagaatttccaaaccatccgacagggtacaacctggtgaaaaattagcacatgtgatttaaaaattttggaaatggtaaaattagaaacgcctgctacgtgtcgcatgattacgctatgaaccacttgaggatgttttgggccgcatggactctcatggaattgctggcacatgcgatcggagggaagatgcagaactccacctgtgcagtgtgaacgctgcgagatgccgcagcaccagatcagtagaccaggcggctgaccacacagcgaattagcgatcaggtcagccaataacgctgacaatattgtactcatgccaatatttgcctcttaaaaggataattctagagaacatttttgtttactctttaggtggtgtttggttcggatgtggtaacgtaaacgctaatggtattgcctccagccgtaacggataccaatttatccgattacatgattagtttggttgcaggcggtaacgtcatttatttacattactgcgtttggttgcggattgcggatggcagccaaggaacgggaggctgatcaataggacacaattcgaaatttgaaacagaagcctttgggaagatcatttgctccgattacactaatcaaagaactgcttgcttccagacaaccattgatcaaataactgattatacaagtatgcttatacaagtacgcaattaagcatatgacataagctatgaaacattcgcaccagacacactccagtactatatcaacagcagctgacatcaaaagctacataaagaagctcaataaattttgacatgcaaatgtttgaaagataactcgagagttaattcctatacatgcaacgagcagagttttggcagatagttcataatattccaaacactgtcacctcatgtttggatacaaattttgacagtgagaactcaagacaaaaagacattttgcagattagtaaacaataagctaggggcaatacttctgtctgaaaaacaggacagtactttgatcacagaatatatagattgtcatggttcaagcaaataaagctgaagtactgaaactaaacatccttaggacataggtagtctccaatccccaaggcctatgcttatatggaattctaataattcaaaaacagataatgaacatcttgtagatcatgcttgacagccagcacatcagtacatcaatttttctttgcctcatctgataacaaaaaaaaaattcagaaattagtgaaagaaacattaggtgaaagaaaatatatagtgctcagcatcataccaaattaagaatattcttgcacagacaagccatatatgatattcagaaaaaaggtagcattttttaactttaggagtacaaaaactcccagttaggtgtaagcaagtaagcaagagaccaagcacatactccagttagaagtgaatataatattactatggcattgagatggacagctgggtccattgatgcattatactagtgcaaggcaaataatatgaatgcatatatgaaatgctaagtggtaaagagcaatatgcttacaattaatgatcacaaaataaagtgatatgtttcctgttgcatttgcaacactacaagattgatcaagtgaattaccagcaagtattttcagtacgtactccctcctgagagactctggaagagcgagaagcatactcatttgagccggcacttttacaaaagcagctgcagcattgacaacttcagtaccagtcaatccaatcttttgacactcaagaatagcttcgttctgaattttttgtagtgggtcctcctcagccattgccttctcttggatctcagcttcacgttgcatagatgccaccattgctcccacatgctttgtaacatccctcagatcaccttgaacattggcaaagacatccataaaagggtcacttgacaaggtatttttcagtttgttgctgtctttcttcctcttcttagagcttgaagcagttgaatcaatgctccgtcgaggtgtggctgaatcgatgctccgtcgagctgcagctgaatcgatgctccgtcgagctgcagctgaatcgatgctccgccgaggcgtttctctagacactctctcttcatcctcctcatcttcttcatcttgaatatcttgaacaatttctttctccatattagcaacagcctcaccaagaccctctgcaccttctccagtagcaatgtctttaccataaattgcagctagtgtatcatagtgagggaatgctacaccatatagaccctttgcctcattgtttttctgtaaaatacaaagaatgacacaaaattaaggtcatggtttagcaagcaaaagagagacctatgcagctacaattgcatgaaaaacacaagagaacatatgtatgagaaagcatactactagaaaaccataatgttgtctttgcaaacatttcagaggaattttacatagccgcttatttggaacaaaatttcataaaatatcttacagtagtttcacatatttcaattcaatgcactcatgaatcaataaataaattttctactccatagttagtttgatgacttaccctgcaatgatcatcgtattgttgtttctcacattgtatcatctttctattgtcatcccaagaaaagccacttttggttagcatcacttcaattgcgccaaacttggtcctaaagtgtcttactctcgactctatgtgcggaacagcagtaaggccagaacttggcaacttcttagcaagcacgttctctagaacttggcagtatccatttttgaaacccccttctgatttccagcttggatccaaagcaatctcgaacaatgccttgatcagctcctcatcctcaaagtacgtccaaatcctcttgttcttgcctctcccacgcacaatgcttgagcttccaagatgctccataactgcaatattagaaattcaacagaaaactaacatcagtaagcatccataattgtaccaacattttttttatttttgatttgcaaacaattagaaattccatttaaaacacaaacctcaatgagccctatagctattatacatcccctgagcaagagtgttgcgaaaatttgtccaatcatcagatgtcgaaatagctgagataaactcaggttcggcgagttctccctcaagtatatccaatggtatctcgtcctcatcctcatcctcgtcctcatcctcaaatggatcactagacatcttttgcaaaattaagttgtgcaataaagcacatgccattataattcgacactgagttttgataggaaaatatgatggggacctcaaaatcgcccaacgaccctttagtcttccaaaagacctctctacaatatttctagcacttgcatgcctcatgttaaagtactcctctgcactatgtggtgggttacgtgctgtgaaacggcctaaatgatatctttggcctcggtaaggggctaaaaaaccatctgcttttgtataaccagcatccacaaggtaatagcaacctttaaaattttaaaaaagaaatatcagtacaattcaggctgtggagtgtcaaacttcaaaataaattgattggaaaaagactcgccttgagggacacgaagcccgtccggcctgtgaattgcatcacgaccatcatgtgcagaaccctcccaaccaggtagtaagtaaatgaactgcatatcgggtgcacaaacacctaatacatttgtaacaatgtctccttttcttgacatatatcttccttttatcctagttgggacagttacttttatgtgtgtaccatccaatgcacctaggcaattctacaatccagaacaccacatcaataaaatatggtacaattaatagtgctgagatgtgattttttttaaaggaaatgtgatttattttttagaatgggttaccttgaaatatttccatctatcgtcggtggtgtcctcaggtataggttctggcttcttaagtagaagttgatgaagcctcagaacagcaagtaggcataaattgaaatgcctactcacagtctctccacttcggtaaaaaaactttcctattgttctattctttaaatggtgagatagtatatataagaatgaagctactgattcctccaacggcatatttcttgtatcctcaatacctccgacgtctctaagcatgtcacatagaatgtgaaatgtcctcctgtccattcggagctcgcttatacaagcaatatcactctcacgaataagctggaatagtctttcactcctaagttctctagttctgatcctcctctctattttccaatattttctcttatatgaaattaaaaacagtacaacaacatgataatacataagtatgacagcaatcatcatatttctaagccctaaatttcttctccgcgttttggtacttaagggaaggcgagccatagcactctacaaatatataaaacaaaagcattaaccatgtccagaatatatcctgctagcacgcataatacatcaagctaccactaaaataaacacagtacatattttttttattgctaaacctaagtgatttgctagaacacaatatcaagcatccattcagggatatttacatgtatctgttgttttacacaaaactttttttccaatcttacattgtggaaaatgatatatcacctggcagtaaaagaaatcaaaattctcaaaatctagatagtaaaaatgagttggtcaaacttccctacactcaaaaaaaatattcactaatattcaactttcctgcaatctgggaaaatatattctacataaccatgtgaacttatgaagaaaacatgtatgaggcaggattaatacatgagattcactagtataagctacttcatgatttgttaatgaaaagattatcacaggatcatcactcatcagcattcacaatttataaagagaggtggtttcagtaggggaagggttctcaccggcgaggtgattgatagatgacagcaacgacggaagtccgatgtggttgatggcaccagccccttgtttcacagcctcgcctttgttccgggagttcttccggtcaagatccacatcggaagacggcggtggtggaggagcgcaagacggcggcgtcggcgatgcgcggggggtgaggggacggcgccggcgacacgcgggacgatgggaaggcgcggggacacgcgcggggcgagggggctgcgccggcgatgcgcacagggtgaggaggaggcgccggcgacgcgcacagggagagggggcggcgatggcgacgcgcgcgatgtggaggagaagctgcggcggcgctcgatctggacgaggcgcgtgaggagagttaggttacgctccgtatcggtatcgttttccgcccgcctatgagtgtaatcagctttgtattgggccggaattcgtttgcgggctatccgattacgatccatctgaaacaaacatgtgtaatgcaatctattcacggtgggatctgatacgggccaaaaacggcccaaccaaacagctccttagtagtgtccaacacgccgcatggtctttctcaggtcagaacaccgtacacgaaaaaaaacaaacaaaatccaaaacacaagtagaaaaaaataaaataaaaattgtcccagcaaatgtttcttcacgtagaacttgttgggctcgccaaactgggccagagagcagaggccggttattgctttttcgccagaaaaaggccagtaaggccttattttggtccgtgtcaaaaaagtcctcgtctcggtgggccgaaatctaatccgtcgcatacaataggcctccattccagcccatccatgtaactccaggaaaaaaatggaacaagttcacttaagatccctcgacttgatgttgagttcaaattgcgtcctcaaccgcaataccagatataagtatataacacattctctaacttggaaaatcgatacaaattagccggtttaactagcatgacgctgccgtggtacccaacacaaaactaaagggtaaagaaacatatgtgtctcaccaggcaatcccataggagagactgcgatgtgcgccgccgccggtggtgctgattttgtgatgggttcgttctcttgttgggtgcgcagggggtggaagtggttgtccctgttcaggttcaagatctggtggatgatcccgatggtgggcgaggacgtagtcgcctcggctgagctgggcatgtagcaccagaactctggtccatgtgattttttatttttcatattttttctttttttgtgacatgtcatccaaaaacatatttaatacttcctccgtttctaaatatttgacaccattgttcttttagtacatgtttaactgtttgtcttattcaaaaacttttgtgaaatatataaaactatatgtatacataaaagtatatttaacaataaatcaaatgataggaaaaaaaataattattatttaatttttttaataagacaaacggtcaaacaagtgctaaaaaagtcaacggcgtcaaatatttagaaacggagggagtactatcttagactatatttgcaccagtttaataaaatgagggacacgttatatccagttttgcggtttaggatggaacaaactcgacatcaagttgaaggacctcgagtgaacttagtcccgaaaaaacatgagccgatcacagcaaaagcaacgcggcctaagacctcattgtgatgggcctcattctagcccttctaatcggatgggcctcaattccatcccatccatataacgctagaatatacagggcgggtcaaagcccaagccccacactacgccgtttcacgcccgcaagtccgcaacacagatcaacacaaacgccatagaggcgtttctcccggccttgtgcagcatgcgtgcgcggcgccgcggtgccacctcccggacaggtcgggcgaccgccccgactctatcgttaccgtcttcactgtccatatccgtcaatactaacaaaaattaatctatcaccgaaaaacactaccggcttgacggccattgtgccggctccgccactagcggcggccgctcgaccgcttttcgatcgatcggcagggattcacgacgccgtacgagaggtgaaattcttcgccaatcgccgccagtacccgaaggaattcagttagctgcatctgtctccccactctctcgatccgctgcacacacgcatatggcgctcatgcgatcgatcgatcgatcggaggcgtgtgcgaagcaattaatgcggcgagagggtcgcgcaggcgtgggacacatgcggccgcctcggcgggcgcgcccgctgcctgccgcacgtgcgacagcgctcctagctcgctctccatggcgctagcctcgcgcgtggatgtgctcttttggatattgctagcttccgtggtggatgcatctgcgtgcgcgcgcgcgtactgcggagtacgtacgccgccgcgcgcgctgcactacacacagtctcaatctctctcgaatatctcgagagcagcggccgggcgcgcgggcacgcagccggcagccatggacgtacttacgtacgccgccatgcgcgcttagctagctagctcgctccggccggctcgatcggccggatgggacgcgctcacgtgaacgcatgtacatactctatccatccaataaaaaactaacctggtgttggatatgacacatcctaatactacaaatcttaatataactctgtgtctagattcgttgtactagaatatgttacgtccagtcttagattcgtttttttacgggacggagtgagtacgagaacgccatacatggtgggtagctagctagcttagagctgcatcacgtgtaccacccatcacaccgtacccccagcactgtatatgcatcatgctcatagctcatttgctcaactgacggccgcagggttaatttcatgtcgcgcatcgaccaacgcttgctaatgctagctccgtttgatgatttgattaactgaggctaatctatgaccgattaaaacgtgcatataccgacccccatgtggccttcagatccggccgagatcgagctagctatccgcagttctgcacccgccaagagtcaaatcggtggtaattaacagcgtatgtttcagcataattaattaatcaagtaagcgaacactgcaaataaataaataagtaaataaagatatgcgcgtgtacttgagagcgttgagacgatggagagctagatagaatgtcaaatgattgctagcatagctagactaattattattctccgaaagagtttacatatactaattgaccttattgtctatggacagaatcaagcacccatgcatccacacacaccaaagccatacttttcaatgaatcagtaaataaactatgcacgaaacaccacatttgcggccatgtataaactatagcgaggataaatctagcaggatatagctagctagatttgacatgacaaaataaccatttaattaaggcactaaattaaggggttgaaagggtgacaaatcaatcattatcaatcacagggcgctgtgtatatgcacaagcaaactctttgttggtcggttaatattttttctctcgtccttgaaaaatactcctatgcacacgcattttcctttaggtcaacacccctttattgcaagcttccgtcccctcacatttgcgccccatttgccgtctgatgtcgtcacttttatcaggggcccatatgctacttagcataaaatattggccttaataggtgtagtgcttatctttatatggccattaggttaaaggtttccactctggcaagatgccgttgagccctaaaatattagggtgagcaagctaatcgctcattggctcgtgaaaatagtgggtgtgagagagggggtgtctctggctagcttcaacttggcgacatgattaggtgaggcgcctcccagcaaacaaagtctatgccgaattaatctttatttttcttttcgttgccgcgcgccataataaactatactgctctctctctctctctctctctcaagatctctcgtcactttaggatgcttatgcaggtttgattggtgagacgttttgtcgtcgtcttcttagtttcatctccaatttacttcatgaacatttaatttgtagcatgcgtgattcatctcaacttgtgttccacggtttcacattgaatatttaatactccatctgtttcaggttataagatgttttgactttagtcaaagtcaaacttctttaagtttgatcaagtttataaaaaaatagtaacattttcaaccaagacaaatttattgtgaaaatatattcaattattgatttgatgaaactaatttagtattataaatattactatatttgtctataaacttagctaaatttgaaacagtttgactttaactaaagtcaaaacgtcttataacctgaaacatatggagtacattcgatcgtgtgtttacatgcatgcatgcatgggaagtgtgtgttcatgtaaaatggcatccatgtgaatgtccttgaatcataatatacatagatatatgtcctgcgcatgcaggatccttattcaaaactaacaaagatgtctatataaacaaagacctttcatatatagcaatgaaaattagctccaacgaaggctagcgataagtatgttagtctcactgaggctgtgttcggcagcttgagatgatagctaatccctagcgcaggtgaaatggaacgactcattagctcaagattaattaagtattagctaaatttctttgaaaaatagattaatatgattttttaaagcaactttcgtatagaaattttttcttcaaaaaaataacgttcaacagttcgtgaggagcgtgcgcacaaaaaacgaaaaatgtgggagttgggaactcacactaccgaacacagcctaacctcttaaaatcacatcttaacacctacatgtgattattctgggtatatagatttgaattctaatgggtaatgatgcatctacgactttaccatcacacctctagtttcttccaataaatctatatgccattaattctaggtatttaattttatgtcaaaagaatttctagttattttcggaagttacataataattttacaaaaatcatgatatgagcttttgtattcttctagtactattactagctaatattatcagtacatggtagaaatgcaccaagccatatttttggctaccaattactcagaaatgctagcttttactcgtgcacatgcatgatatatagaaaatcattcagatgttgaagacttgaagtgatgacgctctctctcgtggcccgatcttctggtgagggggataactctcgctttgatcgagtgcgacgtttgcgacgtggctaccaaccagaacaagtccaggacgccgtgcaatcgctacaccacaaacgatgtcgtaccaaccgtgacgcgcggttgatgatccctgcaatgcaaacgagagaacactgcaagaacaagataagatgcaatctaaatattgcgaatagggaattaagcacaaaggaatagttgcgattgaagtggtagatctaatcgacccggcaaatcaacacaccaactattgggggctctgaatctatagtcgccgactaatcgagcgaggactagagacaaggtgaatggcacctagcaaaattcaactaaacaaaacccaaatgtttttgaggatgtataaagctatttatagaggaaaataaagctagggttcagtgctaattcgtggaggtggagggtgacacttccgagatgggcctagtctattacaaggcccaaggcccaagttcggtttcagcaacagcactgtcttgttttggcgattcccgttgactcgagatgaatttggacatgagaccagatgcgtttgaaaggtagcgagataatctttccacgaagtccaagatcacccaaatcggagttggcatgaaggcgctaggtccgtttgaagtcagtgctgtctccggaggccgaactggacttggatttggaattatcattggagtgtgtgaagttatgagcgtatccgacgaagtgatgtcctcatcatgaattcatgctttgtacgcgcttattagaaaccaagttgctctcgcccacagtttatccatggcgtggtaataaaaaaatggccagtacagtgactataaaagatttgatgcaacaaatgatgttgatgttgtcctgcgatcaagtacttacgattcttatattagtagtaacctacaaaatgaactttttgtgttctcgatcgatattttaattacgtaatcaacagtagtactatccattgcaagtgactaaatataacgaactttccgtgtttccatagctaggaagaaaatttatttagacttttgtgcatacacaataaagaaatccaaggtgctcgtgtactcattacacttataatactgaccctcaaagcaaaacatatggctgtaattatatgtagtttactcctgtgaggtaaccatcacacatatgttaacattatcccattgtaaactttgcagaagtaatctaatatttgacttgaattggagctatatatattgcgtgatgttagtttataaattaacacatggctctagctgctaattcgaggaatggacataaaatatatgaggccgtgctcgaattgtttgggctagtttctttttttatcttctttcctagggcaactaattacttgtaaaagcaaccaaagcaagtagaaagaacctgcaggagaataaactagaattagaagttacttttagtaccaacatgtgagttagtgtacatttatctaagcatgcgttaattaacttctaactttcttgcattaagtagtagctagtgtctcatcattgagtgattgaacagcagaatcttccaacccttccgggatttacatgcatttatatactgaccgagtaatatataatcaccaggcaaaggacgatcgagcgtcataaaattaagaaggctgagagcccaagacaacacacgcatatatttcagccaaatttatataattgtgcatgctcccatgatacttaccgcatctatatatgttagattaggttgactaaaacatttccatcagcagatcgacacgccagtttttttccctagagattcaataataataatgcatgtatatcaaacactcaggtgcactttgatgaagacctacaattaatagataattaatatgcatgcgtgtggaacatatatatacatatagactgaaacatgaaacaaatatagtagtatcctatgctccgggacgggcgctcatgcaagctcagttgctcgatctttattctaaattattcaaattcactgtgttggtcctcggatttttgttggaacatctcatcccttttatctagcttgtatcttatcgccaagttggaatcgaggaaaatatcaggtggaaagcactaattcatctctctgaaagtctgatgaacaaattgaagctgatctcgatgaccctatgcattcatgcatgtgaggacttaactgtacatgcacagtaagccaaaagtgcatatgatgcccattagccgcgaataacactgtgcaaccctagccaggactgaaaggaccagacgggaggacaaagggttgcaacaaaacaaataacggggttactacgattctgctagccgacagcatttctcggtgacatatcccaaatcacgaacgaccatgggctacatgccatcccggaagttggactttcccgctgttgctttcagttttttttgtgtggccaagaacagcgacaggccaaccaaccagctagctgatcgatcgatcgatcgaatgatcaccatatttagatcgacgcgcacataatattggcagcgaaaccgatcgaataatatgacctagctagcagctgctgttacggacgaacaaattgcctggccctgatctcttcttcttcctccgatcctctcctagctagcttagctagctcctcaatcgatcgatcgccttcgctttgctatagctttagctcactttcggactcgacgagggggattaggctaggtttaatcactccattagccattagctagcgccggtctcgagcttatccaaccattggcccaaaggcaacgtgcttgtcgggattagggaccatgacacgcacaataatgtattcgattagcgattaacttaatcccgcctagccttggctttcttaaagctaaagttgccaccgagggttagaatattgcggctggtacgggtcaccgtccttggaaccaccaccggtcgcgcgcacgcagctgcccaagatctagggcctcgacctctccatcgtgatcggcccggctacggcgccgacggaccgaccggtcaaaggatgcatgaagccatggctagctagctagctacgtactactagatgcgtatggcgaagataacgataattgatcgatcagctagctcgtcgccggccggcaagccggagatctccggctcaccgccggcagtacgctgcgctctggccggcatgtgcacccatcctattaatcaacgatgtagctaggttggaattggataaactggaaatttcatgcagaaaataaataaatactggtcgatatttttttatttgatatgaaatttaagggatcaattgaggggggggggggtgtgcaagaacacgtacggaagataatagacacatcatcacttcagagaccaagttgggatcaagaattaagtttgacaaacagaaacttcagaatttgctcagggtaaaagcgtagtggattcggttaaagaaataagccgattggtagatacaagtttatctagaggaatcgtgaagaccatgcagtttcatatttttaagtatatatattttaaatcggcataattagttattttccttaaatttcttgttaagagtcttgtgtccgatcaaaacttgtatcaacccgattatataaatatgtacacataaagtctttgtaaactatcttcatatatcaatacaattacttttgacgtatcgctaccttttattttggcaagtccttagtttcaagttgggtgcatcggtttcgatctccggcgaggaagtaaattccgtcaacttcacttgtatcagcgtggctaaaactttctcgttcaagtccgatattctatctaggtcgatgcaaggtgttgcctatctgatatgttcgttatatctttaattgcattgttgtttagagttgtattggcctagttaggattttgtcggttaggtacgatattcttactaagttgatgtttttctaattatattgttgttttagattgatcgatatatctatcatgcttatatagatctatcgggcaacagaaattttaagccatggtcgtcgtcttcttcttcttttcttatttttcaatagtaattataggttgtgtgcatcctaactatatatatgcagaggctagaaggaagacttagagtaattatatcatattgacgtacttgtctaatatcaataaagcttaatttctttatcgaaaaataaacgtctgaatctacataacacacacaaaaaaaaatataaaaatgtttttgagacagatcgatcgagatgactgaaaaattcgttgagggaaactatcagatcacaagacttagcatcaatatacaggtcaacaaaacagcgcaatgttaaatcatagaacttcagcatatatatctattatgcgaactttaaccaagaactaaatagggtaggggtatcatatgatggcatgatgcacccacttggccggacaaaccaatggttggcaatgtatatgcgaagtacacgcagagctacatatattactccctccatttcaaaatgtttgacaccgttgactttttagcacatgtttgaccattcgtcttattaaaaaatttgtgaaatatgtaaaactatatgtgtacataaaagtatatttaacaatgaatcaaataatatgaaaagaataaataattacttaaattttttgaataagactaatggtcaaacacgtactaaaaagttaactgtgtcaaacattttgaaacggagaaagtaatatttaaacaaatcgataaacttctgcttcaaaatacatgaggagcaactaactagactgcattattgttactaactaccctcaactaatagtataaggtatccaaagttgagcgagattggtgtattttggcgggacatgggacatggttaaattaatgattaacaagatggcaaatttattaatttacaagcgcacgcaccttcaaagtaagagacctgccaggaacagcatgaaacctaaatctttttaatccctcaccggaccaagctatgattaacaccctgtattattttatgacaggcttagaaaagtggtagttgcgacctactaattaataagatacctgaaagtagtgagaagagggaaggcagaattaagctgacacgtaccgtgaattgtacttacaaattaaacttatccgaatccctttcgatgaatctatatacgtctttccgatcgacctcgaacgtcttaacttgtcgataataaacaaaaacacaccaaatcgatcatcatatttttattatcaccagagagttagcagaagtacgaggcactgtttacagatctctccacctccaaaatatatattgctagctactttccgatcgaagagatagcttatatccactaacccccggcccagacaaaaataatctacgataccataataatgcaagtagcatagctctaggagtatatgttattttcataaactaacagatcgacgtacaaccatggacagcataatttatgatcgatccatggcagcattattaactgccttacctatcttcagacttcagattgatcgacgtgtgtgttagctactagtactagtatatgtttgctcgtgtgcgcaagtaaattaactattttctggaaagcagtttaactttatcttgtcactgaaactttctagctagcgcagaaggtaattaattaactaaacagatatagaagaaattaattaaaacgagcacaatagttgcagctgttcattcagaacgaactgatactacaaagcatatcctgcagtattcgtctttccttctctcttgtctcactgcaacaacttttggggagtccttagggttagggttcttgcgccatgctttggggctgtggtggtggggcccacgtgcagtgggacgcatgggctggggttggaggtagcgaggcagagcgtggtttccgaggaaagcgagctcgtctctctcatcttctctctcttttctctctctccggtgttgctcggccatggccgacagccacgccgagttaccgcctaggggcagccgcgcacttgaccgcacgtgaccgggcacgtgggggggcgagccgtagcgtcggctcgcggctgcacagtcggctcgatcgatcggctccctggatggggatacttgtcgagaactgattagccaggcacaacttgccgtttttaagtttgggatcgagaggtacgtattgctagtagcatacaagtactgaaatactaccagccagcgcttcaccatacattagccaaaaattatcactatttacttctcattgttttccttctggcatgtgggtctgcaagttaatgtgccgtgcatgagatttctgctaaggaattactccctccgttttaaaataaaactgcacactaattttaggacggagtataaacatatctttcactaaatgtagttctaactgttaggaaatcatatcttactagttataacccactaaattctaaaacataacatgcgaagatgttacatcatcatccactaacaattattacatttaaacatcatacaaacatgctatgttatctacaattttataatttactaagttttagagcttttaaaatgcaagcatgctaaatcaccatcctacataattcacataatatttcaatatatcttttcatcattttttaataatatcgcatatatccatataattcatactcggttaatattatttctcttttctctcatcaagccatatcacatcaattgattttagtccttagatgattaatatatgatccaaactatctccctcatttttttctctcataaagccacatcactttacttttacatttgaatcattattctatatactctctccgtttcatattacaagtcgctttgacttttttcctagtcaaaattttttgtatttgaccaaatttatagaaaaatttagcaacatctacaacaccgatttagtttcgttaaataaaatattgaatatgttttaaaattatgcttgttttgtgttgaaaatgttgctttcaatagaatttgagtgaggctaatgcactcacgcgctaatgcactttcaatatgattttagcgaggctaggaatttatgtactgttgacctttcgatgcatctctttgagcatgtcttatggaacacattcactggtgtatgagtgtggtgcgcgcgtatatgtctccatgtaattgaaaagagcaaattaaattgaccgcattcattttcaaatataagcattcacatgattcaaattatatgtacaccacaaacatttctacaacattggttccaatctacgagaatctaaacattttcagtcaacagatgctcacttttttgggattttttttaaggggggggggggggggtgtttattgctagtagccctcggactgtctttgtagtgtgtgcatttgtgtgatgtgtctacatgtaagtgtagagattttcaacaaagaaatataaggaggctgcttataagaacatctatttgtagagaagcttatgtacgtgctggaatattcttattgcacacaataaaaaattggttttgcattcggagtttattgacacaaaaattgaggaacatgcatacatgcaccactaggagaaggcacgagtgagtgtttgaggatatatatagctggatttgatgcatataaaagtggtaagtagttgtactttcagttaatttaactaagactagctagcttgttaattatatgtattgtcattacactaatgtaatgttttgttatcttgagacctacttttcgtcatatagttaatcttttgatccagttgccatatagtatatagtatcaagatacaattatgtgtttattatattaaattgaatatatataattgtgtgcatgtatatatatactccatcatatccacacgttcttaagaacagaggttatatttgctcatagatttgtgatgtcaacaataataataataataataataataataataataataataataataataataataataataataataataataataataataataataataataataagagatgtgcttctatactttaaaaaaaaaggttgcacgaaaatcaaagcacataagtggatgagattaaaagagagattaacactctaatcctcattagcgaggggtatttttgtccatggaattttgagccccggtccaactctgcagcgataccaaattaccaatggcgacgccgattcctccacgactacgaccgctagtccgggatgctctctccttgggtagcgccgctcctcagcctcgcaagcaccgcccgcgcttcccttgcctcgccacctcccctccctcttcctcccctcgttgcccggcttcctcttgcaaacagcgccgccgctccgccctcttcttcctctcgacgcgcggtgcagcacgacgctccattttgtccatctcacagccagtagtcataaaacaagtatctgcataccattgtctaccccgttcatttacagctcaccaccatcacaagtcacatcgaacttgccgttgcagattgcagacaaacaaatatcaaacaagccaaagcacgaagggcacaagcttattttgtgttatttcttctgtttaaactttggttcaatcgaattgcgacttggccttaaatgaggtgtagatcatggcaccgaagaagctgctgcagctgtcgctggggtggcctgactactgccggcacggcggcgtgctcaatgtggcagtggcgacggcgcgaggtggtggcccttgatgaggacgtcgacgttgctatatatagtcctcgtgctcgaggctgatcatgttgagcatggcggcgacgatcttcattgtggagcagcatattattcactggagctcccgctcatcgtgttgcgagcgaactaccaactcaaatcaccgcaaatccatcgatccatcgatgggatctagttagggtggtctagcagggcagggaggtgaagcgggtggcgcttacgttgcagaggaaaccagcgggcagtggcgctgcctgacgaggagagaacgatatcgttgtgggctgaaatttctatggacgaaaatacccctcactaatgaggattaaactgttaacccacttttaatcacagccattgatgtgcttcgattttcgtgcaacttttttttaaagaagtgtagaagcacatctctaataataataataataataataataataataataataataataataataataataataataataataataataataataataataataataataataataataataataccaggcatggatccacgacgtctgtccttattctcttaaaagttaacgacatatgatttatagacggttatgttctactataataaattacataacaacgaaacctgctaatacgtacaccttcagagaaaaacatatggcatatgttttttttgggatatcttatttctctttgatttgttattgtctggatatatatatatatatattaaatttgtttggtgctccatggtgcccgggcaccattgttgaaattgagtatatacccaattcaaatgagcatgaaacttttttaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttgagtgattttgtgcatttgaaaccatggtgcccgggcaccatggtgccccatatgagtgtcctatatatatatatatatatatatattgatgtgcaattcttttacgcgttaaaataatgtaggatcgaaacacaagaactaagccaaccagaggggagggtgaatggttggtatacccaaaaacccaaactttttgcggaattaaaagttacccttaaattcgacggatcgcggtctgaccaaaggtgttgcgccgatctgaccgcctggaagtcgtcggtccgaagtagaatgtccagtcgaaccaccaagatcagcagattcctcttgtagccaccgccggtctgaccgcagatatgacaccggtctgatcgccggtgtgtcgccggttagaccgctgaacccgatgaaacacaaatcgaagaactctcaaagtagatgccaactttattacttctctctgtgtttacaaagtgcaacaacaacacttcttacaaaaatctcgactaaactcgaaatcctaactaaactatcaactcagttgttctcaaaagcgataccggaaagcctcatgctccctctctatttatacatgaggtaggcagcctaaagccacgaatcaaactcatattagaagtcctaaaccacctaggaaaccttctcgcacaagaaacaaactttacaaactccaatcataccaaatttggactccttccaaattcgactccgcatcccatacgcacacaatacctccatcgtatgccatatggaatcttcaccaaccacgtgcattgaactctagcctaagtatcccgcatgatatctgatcgtcaaggacatcgccttatccccaagtcgactcccgatctatcaccggcaatactctcctgaggcatcaagtcacctacacatgaagcaaacaaaaaaaccatattccgagaccaagctatctccaacttgactcattattagcaaacaacagtattacatacgtatagtatccatctagaagccataaatatgaaacaatcacagatatccaaacaaacaacccgaaaccgaaaccgacacagagtcggccggtcagaccgcgggcttgccgccagtctgatcggcagcacatgcctggtctgaccggaccacatcacaacagttcctgtagaccaccagtaaaattccaatcatctccgtaaccacttcacaaataaattccaaatatcaaaaccaataatctcatatgccaattgttcatcacaaaataaggaatcaaaaacactttgattttacaaaaaatagatatattttattttggttccttaaaaagttatgcattattccatgcgtctcggtgtacagaattgaaatctaccgtgttcatgtgcatgcatggtcgtgtttcttccaaggcgaaacacatttaaaaagctgtaaattaatattcggaaacagttgcgctcgaggttactcatgtgttaattggtctctcgtgaaaagatggtaaaaagtagtctagtgtccaaagttttgtggtcatcgatcagacgtagtgaaagtacggcatgcaggttacgcttacaagaactgatcataagatattgcatataaaattcagtttgagcgcgagcatgatgtgggtcattcatttgacttgacatttgtaatatattgaaagtaaactataaacgcacgatcaattataaatcttgttgtctaaaaatatgttgtaaaggacaaaggccaattaaagaaatgcatcaatcaattcgcgggcatttttttttgttaattattagagggtgttgcacatctctcatgtatacatgtacacatgtcaaacagatgaattaatgaatgaatcgtgtattgtctccatgagcatatacatatgggtatagctacctagataagctaaattaatgttggaatatatttatagtcgtgatcaatataattcgtaaaccaaattaattaggtaaaaagtgtcaactgaaactgctacaaagttatgtatagattttaccaaaggcaagccctcactactaattatattgtgtcatgaaaacagtttattacaaaattaatctattggcagaattttatacaccatgtgtaattattaatttggcaagattttgataagacctttaaaattaaaatacgccctataactataattatcaaaattcaaatcggagtaacaaataccaaaggcagctggctacctgttgggcgtatgtaactctttgtgaccgcagtgtttggagcaaattaaccattgaatttgttaacaaagactacggagaaccaattattgtagaagtagtgcaaaattaatccacctctcgttgtgcatctctcaagagctagccagacctaaccatggccgcagacgatcctatcgtggcatgcgctggtgtgggcccccacgaggggccgcattatggacgccctctaaccttgattagtagccctaaaccacaggtttaaccgcttaaccatggttaattagcaaaaggtcacgatgacacgctagccatcactatcgacatgcatcacatttccgcatcatagttcatcccgctcctcgtctcctctccgaagtctcctcttgtcaccagcacgcttgagctcccgtgaggctgacgcgtgggccctccctcgtgtgcgtgttctgttgggcccacatgtcagtgaggtgatctaggtctcctctgcttagctgtgcaagcatacactagaatttgttctcccttggcacctctccccttattttatgtgttgcacctcctacctctggttggaagaacatctcaagccctcccttttctctcctctttcccctgtgcatgtctctcttcttcttcttcttcttcttcttcttcttcttcttcttcatagcttgcctttctcccttctcctctcctctcccttctccaattcagatcaaacagcaatagctctctcttggtgttctctcctccatgcaagctctcttgtgcttctttttttaatttctctctctgtttgcttctctgtgcatccaaaaattttaaaaacaaggaggagtataaacaactcccccactttaaaaatcattgcttccttttccaacaccgccttttaaccctaaaaacaaaacaccacccctgttccaattcggtttttttcctctcttttttctccactttttttttagattttaaattttttttgctagagctagagaggcgctctgctgctgctacatcagtacatgagctagtggagaagcatggcaggtctcgacctcggcaccgccgcgacgcgctacgtccaccagctccaccacctccaccccgacctccagctgcagcacagctacgccaagcagcacgagccgtccgacgacgaccccaacggcagcggcggcggcggcaacagcaacggcgggccgtacggggaccatgacggcgggtcctcgtcgtcaggtcctgccaccgacggcgcggtcggcgggcccggcgacgtggtggcgcgccggccgcgggggcgcccgcctggctccaagaacaagccgaagccgccggtgatcatcacgcgggagagcgccaacacgctgcgcgcccacatcctggaggtcgggagcggctgcgacgtgttcgagtgcgtctccacgtacgcgcgccggcggcagcgcggcgtgtgcgtgctgagcggcagcggcgtggtcaccaacgtgacgctgcgtcagccgtcggcgcccgcgggcgccgtcgtgtcgctgcacgggaggttcgagatcctgtcgctctcgggctccttcctcccgccgccggctccccccggcgccaccagcctcaccatcttcctcgccgggggccagggacaggtcgtcggcggcaacgtcgtcggcgcgctctacgccgcgggcccggtcatcgtcatcgcggcgtccttcgccaacgtcgcctacgagcgcctcccactggaggaggaggaggcgccgccgccgcaggccggcctgcagatgcagcagcccggcggcggcgccgatgctggtggcatgggtggcgcgttcccgccggacccgtctgccgccggcctcccgttcttcaacctgccgctcaacaacatgcccggtggcggcggctcacagctccctcccggcgccgacggccatggctgggccggcgcacggccaccgttctgacatgcgcatacatgggtgtagctccggcgaaaggagaggagatgagaggagagatcacaagaagcaaaggaaaggacatcgcaagggttcatggccgcagcttgcaaaaggttagcgaacgcacgcatgaaccacgtattcagggttaccaccgatcgatctatatctactgctctatttctatctctatgtacaattatttcgtagtgtttgctcgatctctgattatgtgttttcgttattgttctttttttcccctttttcttttattgtttcttttgaaccttaatttgtggtgtaacctttcttaattgtcaatctggctttaataattaagtagcctttaaattgttcgaggatgcatgggcgttctatttgttttgctgttgatgttcaatttgttactggtatgtggatgagagattcgcctcaaactgataattataagaaaaaggttttatgtgttcgtgtggcgtaagctgtcaattcttactttatcatgcacatatagatgtgctggtgcgtgcttttggagttttagctaattgtttttgtgtgatacgaaggtgttagatgtctttgtgtgatgatatataacaatcagtgatgtatgtatattatagtatttgtagatagttcagctggggaaacataattatatgcatgtcatcagttcttctggttcaaaatttatgtggaagctaggggaatgcaacacgagttacaactccttgctcccacgtgtgcatacttgccttagtttaaagatcaaaagcaattagcaactgcatcctctcaaaacaggctagctagtgttcatggggaatcctcaccaactgtctgcctatcatcttaccactacttacagtgtgtgtcccctcatgttctttcttgtcctatatgcatagattgcaagatgctcgtaagagtaaatggaagaacagagaactagttcctaagttattgggacttgaaccttcaaagaattgagattcctaaagtttctattgacgacatgtgttctatttctatgggctctgtctttgcatcagcgctgctttcatgttttatcaatactgtgtttatggcttaactcaccgcgccgcttgatcgcgcaattaattcaatgtgctcagctttggaaaacattggaatttcttgcaacaaaatgttcaggtcttgcaaattgtaacctttttcatctgtaacaataattgagctttaaatactttcttgtatcaaaacctgtaaagcccctgaaaatacatcagaacggagccccggcctaaaaatacatcatctgctgttatgtattagtattaattttcatgggcttcagaggatgaaaaaaaaaatcacctccttgcttcaacctacaaactataagcccctgaaaaataagaaagttcagcaactatatatagaagaaggaaaaactgcagcctgctaatttcagttaccctgttcagctacaagttacatgaaaccgaactaagtagtctgtgtgttaggtcgtagagaccagcatgatttttagcttcactgactagttgtcaatggattcaattcagtatctatatgccgcacgcatgcgcatactgcagtatccatttaagtatatatttgattgcctacagtatccatttcagtaagttttttagatccaaagggcatgtgtttgttgtattgtagttccgttatctaaaaaaatgtgtttgttgctactctatgttacatgcatgaaccatacttttttaacaggatgaaaattatagagaactaaccacttagtacttgttttgacaaagttcaggttcatgtatttctttatattgtgtttgcctctttttcattattatacctcaaatagattcctaggtacatcatgctttgatgtcgaaatgtttcctagttacatatatatattaagtaattacaaaatgttgaattgagtgaatcatttagtattagcacatgtgcctgaattggagagggagacaaatgttttcttccaaaatatattgaaatcctgtaagatcactatgcatgcaagctgggttaagttgcagcgctacgctcacgtacgtacactgatagtagtaactagcttttcatgatttgaagatcttaacttgatctgaagaaataacatgaagtgtgtgtatatctattgattaattgattgtcagatcgtgtgaagagatcgatcttcaatttcgtgtgttcatgtatttgctgatctaatatatgcttccaactaaatgtcctgtgttcttcacacgaatgacacactttgattttatggtgacaaaatgataactatcgcttatattcagtaacattggttgcctgatagcatttctcgtagtctcagcattaaggcacatgaaaaactagcctgattcctgaaacaagatatgcagcccgggaatgtcaagctacatactgttcatatatgactatgagagctgttctctgtaacttagttcagaacttcagattcttgcctgtatacacagatacggaattcccacagatacatataggacatgcagcgcaacctttcttttctgaactgaagcaaatttattctggatgtatgcgaagttttgttagtattaaatactatacctcgacgcacgttttccataaatattggatctatctgaaattactctacatcacagagcaggcttccgggttttcgttactgaggaactgattagagtgtgagcaatgcaagaaaaccgtgtccttgaatccatggagttcagggtgtgagtaatcgatgaagtgagggtgcgtgcaggggatgaagtagggagcaacgacctccttgaccttctccttcaccttgacctcctccttcttctcgccttccttcttcttctcagcttccttcttcttcacctcaaccttctcttccacaatgatctccttcttctcaaccttttcgatgaagccgtacttgcgcgttctatggtagatgtattcaaagagtttcttctcctcaatcaccccctcgacgacacacaagttcttcccaaggtcaatcttagccgcgtaaatgcctgaattatttattcattttgcatgcatatggttactacattagtatctgcagtttcattctgttggattgagataaaactgtccgaggtacagaaattaattacttttgtgctcaagtagaacctctttgaccctggctgcgcactctgcgcaatgcaagggaacccttacagtgatgatcttcagttcctgtattatatatccagaaaaccaaaatccaatttttcaggcaagtgaaactccaaaaataacttaatcaaggacatagattaattacctccttcttgctcttgacctcagtgactatgtccttgggaggaggcaccagctcaactctcctccggcatcccttctcgaccttcttcctgagcttctcggcgtcgaagccgatgcccttcactgtcacctttcctccatccaatttcacctctctgactcctgttcatgttattactacgcaattaatcagaatgtaaatcgtgcgcaggcgccaaattcagacggcaaaaaaaatttttttgcagcggcctgcggggtactgaagcaggcacacacctgggaactgcgtgaactgtgtcacgatggtgttcgcgcactgcttgcagtggacgtgcaccttgtacacggccgtcaccagctgttcggctttggtttctcccattgctacgtcgttaccctcatttgtgctgttgctgcactgcagctgctgtggagttgggtgctggggctagctgtgatatgcatatgctcgttgcttgtgggcacggcttgagcgggacgctttcgatcaggatctgggatttgttggagatttgttggaggtggttcactagcttgatggatgagacaacagtgagaaaacgtattcggtttggggagctcactggtgcgctgtagttttgtgactttgtcaatccaaactgacgtggcttattaacctgtcaaacccaagccaatcgataccgatgtcacccgaagtggttgtgttgttcttattgaccaacgaacaccgggtcaacttgtagaaacagagagtaatgtgaattctcgtcgtgttgtcgtggttctcgtcgtcttcagatcgaaggagctggcgatttcccggtcaaccttttttttactgcttccaaaagagagaaatgtgaaatcaggaataagttcactggaggtcctccaacttaagagcgagattttttgacgtcccttaactgcaaaaacagaaatcttcaccctaaactatacaaaaccgtccaatttatatctcatagaagtatagatatctggtttcgctaacatagcatcctagtaaacaaaatataaaaaaatatgtgaagcccacgtatcagcccatcaacatctctctcttcttcccaggcagccggcgggaggggggttggcaacacgccggtggaagaggaggaccggcgagagaggcagccggccgcaccggcgagagaggggggaggagaggaggtggcaccggctatgtggtggtggcggcgaccactgcaaccatgacggcgaggaggtagcgtgggggtgtgacccgctgcaacgacgagattggggcggcgatgacaagacgccgactagggatggcgaggaggaggcagcgacttagcaccggttgtcggggggacgcgctggtgccctcggcggggcccaccccgggcggctccctctcgctatcctccatcgacaacgacgacaaaggccaccaccgtctgcatctccatcgacttcatccaggtattcccctccgtctccaccgaagccgtcgaggactaggccgcatcggtcgtccactaccaccctatcgccggccgcatcacgaatctggtcgtcgggaagcctgagatcgacagcaccggcggaggggtgtggttcatcgaggccaaggcgagctacactgcctgcgcggactctgtgcttaccgccgacggcaccgtcgagattgagggtgagcgcctccccttctctcctccaaccccctctccacttccccctcccctcgccccggctcgacctcaccagccacaacatcctcaactttcggctggtcgagccgccgccaccactctgccggcctactccactcctcctctagccacctccgctgtcgtggtagtggggtgctcccagatccggtcgaggcggcggcactgctggtcctcaaggaatgtccctaggactgcctcttcgccgttgggagcgggggcaaaggggacaggggaagcgacgacgcagggggtagaggaagcgatagcgagcgagcgcgtgtgcgtcagtgcggcgacggcggcggagctcggccaggctcgcctcgcccccatttgccatcggtggcagcctccctgggagaggatctgaagagaagaaaaaaagagaaaagagagaagaagagaagtggtccccacattttctatctcatttcacttaatgtgggatctatatatatatatatattaattttgctgactcgaatgccacgtcagcgaaactaggcatctgtactgtcatgggacctaaattggacggttttgtatagtttaggggtgaagacttctggttttttttttgttaagggacgttaaaaaatcttgctgttaagttgagggactctgatgaacttattccgagatgtaaacgtagagcccaatcaaccggccgaactttcccacacggcccagtcagtcggtagatagccccataacagatgggcctcagaatctcccatgcttcggcctgcacgcacattgcccgatcggagcccaaggtcttctgtcggaaagtctcctgagaagcatggctcaacaccgagatgatacgcgcggcagggtcacatggcgacgcgccccgtccccgtccgtccgtccgtccccacgaagcaaccgtgctactgctaacctgacctgctgaccaacgcagcgtgagcccgtgaaccaactcacggtttcgctcccgcgcgcaccgtgcaccctcgtacccccgtactacacgcgagcgcgcgcggttgggtggtcgtctcgtcgtctgtcgctgttgctggacggacgcggacagggagcggcggggtgggttggttggttggatgactggatcgcggatcccggttgatttgccagcgtaattgcccgatttgccgagccgcgggccgcgggcatgcaagttttggacagataagtttggggaggaggggccacatccctcccgcgaacccgtggtgtttatcgtcctttgagcatgccccaccaggtactcccagtactactctcgtgcacgatgtgatgggccccgggggcgcttttaacgtcctgtataaacgcacggtggctcggcggtgtccggcagatcctgatgggttacacctttttttttttgaaactaaatgggttacaccttttgcacgtacaactttatagctgacatctggaaagacatatgacacggaccatacgaacaacatggtgacaaggagcatgtcaatgtcgtccgatttgtgtctaacggctcggatcaaagaacctaccgtacaaaatctctcggctacaaataagtaaatccctcttagtctgtaaaatcttgggtcagctcagtgcaaaatttgatctgttcccaagaaaaatcttgggtcaagtcctttttgacattttttttctcagagacatgttgtctctttcacgtagaagttataatatttggcaaatttttctacttgacattgttaagcaatttttttcccaaaacaaggttgattatatcaattatgataactaacttataaccatgttctcacaataataagagaataagtgactggttattttaatatggttgcatggggtttgtgctaacgggtaacaaccatcaaacatgacaagaatagccgcattgttggaataagtctcctgtcgtttggcataaagtaagaaccaaaagataacttgaaactaaaaacttttatatctatgttctaagtcataagtcaatgctgcaaagtaaattatgataaaatatctctaaaagcaacttttttttaaaaaaatcaaattataaaattcaaatcttaacaacggcttataaatgggaggcttagtatgtcactcaaatattggtaaaaaaggtactccctccgttccaaaatataagaaattttagaggtggacacgattattaaaaaagtaggttgaagtgagtggcggagggttgtgattggatgagtaatggaggtaggtggaaaaagtgaatggtgaagggttgtgattggttgggaagagaatgttggtggaaaagttgttatattttgggacaaattctgagagctaaaagttgttatattttggggcggaggtaatcctccattttaatcctaaggaaggtacgtgatcaaattttaccatcaaagaaaactgtcgttattttaagtcctaatacttctgtggacgtaaatcgtagtggaacattagtagttgtcacgtcctttttcttacttgaattggaagatatcattcttgccgaagaaaaatgagaactgttttccccacgtaacagctatagattagcaagattgttttatcagctacctaatctaaacgaaaatagttaactccataccctgaaaactagggtttctatcctcctggcggcggcgacaaggagtctctcggcgatttacgttatcgactcggtttcttcccagatctcgagtagaattcaacgtgcttgcttatagcactacaggataaggaaggggaacacaacagccatggcgagcgaaggttcaacgtcggagaaacaggctgcgacgggcagcaaggtgcctgcggcggatcgggggaaggaaaaggaggaaatcgaagttatgctggaggggcttgacctaagggcagatgaggaggaggatgtggaattggaggaagatctagaggagcttgaagcagatgcaagatggctagccctagccacagttcatacgaagtgatcgtttagtcatggggctttctttgggagtatgcgctcagcatggaactacgcgaaagaagtagatttcagagcaataaaagacaatctgttctcgatccaattcaattgtttgggggattgggaacgagttatgaatgaaggtccatggacctttcgaggatgtccggtgctcctcgcagaatatgatggctggtctaagattgaatctgttaatctctatacctacccagcatggatccaaatccatgatctgaaggagaagatcaggacgggtagcattgcaactcagcttgcgcgtagagctaggagcattgttaaattagatgcagcctcggttcggggaagcagtgagggggcccgagtgcgcgtgatgctggatgttcgtaagccgctcacgagggtggtaagtaccactctaaataaaaagaagtggatgttccgcgttatgtatgagaaaatgcagattttttgcggtgtttgtggttttgttgggcatgtcacaaaggagcatggtgatggtgttcacccacccgaagctatacaatacccggataatgtgatagc

SEQ ID NO: 16496 - DNA, 8785 bp, Oryza sativa
ttcacaggctgaaaatttttttgcaggaactgctccatcgcgaagagatttggtggaagcagagatcccggatcacctggctgaaagaaggcgatcggaatactcgctactttcatttgaaagcgtcttggagagcacggaaaaacctgattaagaagctgagaagatcagatggtatgatgtgcagtaaagaagaggagttaggagagatcgcacgcagcttcttccgagatctgtacacgaaggatgaaagccttaatccaggtgagctgttgaatatgtttgaaccaaaaataacagatgaaatgaatggcatgttgacaaagccttttacggatgaagagattagtgacgccttattccagattggtcctctcaaagcaccgggtcccgatggttttccggcacgcttctttcaacgcaattggggtgtcctaaagagggacgtgattgaaggtgtccgagagttttttgaaactggagaatggaaggaaggaatgaatgatactgttattgtcatgattccaaaaacgaatgcaccggtggagatgaaggatttcagaccagtcagcctttgtaatgtgatttacaaagtggtggctaaatgcttagtcaatcggcttaggcctttgttgcaagagattatatcggagacccagagtgcctttgtgcccgggcgtatgattacagacaatgcattagtagcctttgagtgctttcattccatacataagtgtacacgagaaagccaagacttctgtgcgttaaagctggatctttcaaaagcttacgacagagtcgactggggattcttggatggagcattgcaaaagttggggtttggaaatatctggagaaagtggataatgtcatgtgtgacgtctgtaaggtatagtgttcgactgaatgggaatatgcttgaaccgttttacccaacaagaggtttgcgggaaggagacccactcaatccatacctatttctttttattgctgacggcctatcaaatattctgcaaagaaggagggatgaaagacagattcagcctctaaaggtctgtcgctctgctcctggtgtgtcgcacctgttatttgcggatgacagtttgttattttttaaggctgaagtgatccaagcgacgagaattaaagaggcactggatttatatgagcggtgtacagggcaactcattaatccaaaagaatgttcgttattgtttagtgctctctgcccgcaggagagacaagatggaatcaaagctgtattgcaagttgaaagaacatgctttgatgataagtgtctgggactcccaaccccagatggaagaatgaaggctgagcaattccaaccaattaaagagaggtttgagaagaggcttacagattggagtgagagattcctttctttagctgggaggaagctttgattaaaagtgttgctcaagccttgccgacttatacaatgggagtgttcaagatgccagagcggttttgcgaagaatatgaacaactcgtccggaatttctggtgggggcatgaaaaaggggagaagaagggtcattggattggcctgggagaaacttacaagcccaaaacttttgggtggactgggctttcgggatatccgatgttttaatcaggctctccttgctcggcaagcgtggagattaatcgaatcgcctgatagcttatgcgcacgagttctgaaggcaaagtactatccaaatgggacaataactgatacagcgttcccgtcagtttcatcgccgacatggaaaggaattgtgcatgggctagagttgctaaagaaggggctgatatggaggataggagatggaagtaagacaaagatatggaggaaccactgggttgcacatggggaaaatctaaagattttggagaagaaaacctggaataggcttatatatgtccgggagttaatcgtcaccgacactaaaacatggaatgagcccttaatcagacacattataagagaggaggatgcggacgaaattctgaaaattcgaataccacaacgggaggaagaggatttcccagcgtggcattatgagaaaactggcatattttcagtaagaagtgtttatagattggcttggaaccttgctaggaaaacatcagagcaagcttcttcaagctcggggggagcagatggaagaaaaatctgggataatgtgtggaaagcgaatgttcagccaaaagtgagggtttttgcctggaaattagctcaggacagattggccacttgggagaataaaaaaaagaggaagattgagatgtttggaacctgcccaatttgcggacagaaggaggagacggggttccatgcaacagtggagtgtacgctggccaaagcgttgcgagcttcattgagagaacattggacactgccagatgaaagcttgttttcaatgacaggaccagattggcttctagttctgctagacagactaagcagtgaaaagaaggcccaggttttatacttgttgtggagagcctagtatattaggaatgaggtggttcatggtaaaggtaatgtccctattacagattcggtgcgttttttgattaattatgataacctacagttgcccgcccgaaaacacatggaagacatcaaggggaaaggacctatgtttcaggatccatgtcagaaagagcagacatgtcagttgaatgcagagaaagaaaagtggagttgcccgcctgatggaagtgcaaagctcaatgtggacgcagcttatagaactgaaacaggcgaagcaagcgctgggattatcatcagagattgcaggggctagtactcctggctgcatataaaactttgcatcagtgtacctcagcggctgaagcagaagtgctagcatgtttagaagggctcaaagaagcaatgaagtggattcatatgccgattattctggagctagacaatgctgatgttgttaaggctctaacacagcaggtagcttcaagatcctcctgggcgacgacggttgcagaaatcaaaggtgtgatacaatgtatccaacgggtgcaagtgcacaagattaagagagaagctaatagggttgctcatgtgttagcacaaatggcaatgagtactaggtcgtgtggggagtagaggctgtgcgccgcccccgcataatcctagacttgttaaatcaagaatgtaaccctctatttagtcattaataaagttctctcttgacttaaaaaaaataatctaaacgaaaatagatagatttgtagaaaaaacaacaattttcatcacgaaaaaggttcaaatacagtacagtagtaagtttcctattctcgtcctgacgccgcggcgagccaggaggcagcgagttattttactcgatatctcgcgttttctcgtcactcagatctgatctgatctgacccctcacagtgaggtaacccctctcgcctcgccacctccccccctgttttctccatttctcctcccaatttttttctccgcatccgcagaaattctgtcccctcctcctcctcctccatttccgatgtattttattcgatttcgagatttgttttccggtgcatagagctcacgtacaaccgccgcgccgaacggtgcatgtgaactgttcggcgaaacgcgcaggtgaggagaggtcgcgaggagcggctgctgcggcggcggcggcggcttcgattcaggtgggggtgggtgccctagggtttcgctgccgggatggatggccgggagcagcagcagcagccgcgcgtgagctcgccgccgccggccggcggcggcgtgatgatgcctcagcacccctacggcgccgcgccggcgatgccgccggggtcggcgaatgttatgcacggggtgccgctctcgttcaaccccatggcgtcgccgaccgcctcgtcgcctatgaagcccgcggatatgtcggggaccatgtaccgcaccgatcccgtcgtgcagggcatgcagcagcagcccggttccggcggtggcggcacggcggtcggcggaggggagctcgtgaagaagaagagggggaggccgaggaagtatggtcctgacgggaacatcgggttgggactgaagcccgcggctgcagcagggacggaggccggcggaccttcaggtggtgcaggatcgaactcgaaccctgacgggaagcgcagagggcgacccccaggatccgggaaaaaaaaacagctagatgctttgggtaagcctgcatcatttctctgctttgggtttatatctgaactctgaaatgatatggcttaatatgactgaaaagtgcaatgttgcttggcctgtagctttggaaaaatatggtccaagcttgtggcgggtatggagtgtgattgttggaaatggaattaattcatgtgtttgcttgtgtgcattaaaaagggcatgtgtggaataatttttttaaggatccctcatcattctgaaggaataaaaatatggcagaatagtgcaggcagagatttgaataataaagaaaagtacaagcactctttatcctttcctggtgttgcactgggcacagtctaaacaggaaaagtaggaattattcaaatatgagcttagtctttgaatattgaacattcattggtgattggtttcttttatatatgttactttctattaagagccaatctatgtgcatatactgacaaatggacaatattttgctgatgtcctttttgcatgttttgaattacaataacttctacacttgcccctgcagaacagggcagtgtcaactcggtttacatattagtagtagtttgttctgttccatagtccttacccatgtggcacggtcagaatgataatgataatgccatttgtcagatttcgtagtttttttttgggtctcttttaacctcaactgaacttgaccactttgtgtggatcaataattatatgccagatctgatatatatgttcttttatgtgctgattttcaggatcttccgggacatcttttactccccacataataacagtgaagcctaatgaggtacctgaaaatgctcccctctctgctatctagtacgagctgaaattcattatttgtctgcttatgttgtcttgttgtgacaaagttacttttggagaacttaagtttttgatttcttgcttgtggtttgtaaattgtaataagtctttgtgccttacatattacatctgtctgctggtgggatctcaagtaatacaaccaaatacataagtgagagctaagaagagagatgtgtagcataagcttcctataataaataccaaactaacatataatgtattcttcagcatctttaaacttgttccctttttgagtttatttgagttgtcaatgccatttacagaatactccgtataaacctttcatttgtttctgaattagtaattttacaattcaggagattgcatatatttatgtcattatttgttgacttgattctgtcttggccaatgagtgtccttcctggctttgatcatcatacacttgccacttggttgtttttttagcgccaatctactacggattggacaccttttagcctattctcctcttctatgtttctacctgaagtccaagctgatgagcatgcatgcatcacctcttctttttggcaggatgttgcttcaaaaataatggcattttcacaacaaggccctcgcactacatgcataatttcagcaaatggcgctctttgcacagcaacactacgtcaaccagcaacttctggtggtatagtaacatatgaggtatattcaagctaaactatctgtgtgcagtgtgcttactgctcagagcaatgcttgagctccactggtgttctttctgtgaaatagtaatgaatatgcttaattaaagttttctcgatgtctttgtttcattacagtgcagtacaaaataggtggctagatttttcttagtagtatatgtgctactgtacagtggtggatccaatgcctcttgacaccgatgagttgcccaggcttgccatcgagccacagtagagcagtgctctgcagtctgcacttcctgtgttcggcaacaccagttgctacgtttgcctgaactacaagaaactccagtgtctgtcttgcactaacaaaccagatatatacatcacaattgccagcaacccctttttgaactttgtatgctttggtaggatgcactcagttgtccagctttctggctatgataacttattttctgatgtattccaatgataagaggagaaatgactagtatagtagtatgtttagaatgttatcacaaattgggggtgggggatagaatgaaaattttattcttctttgttctcaacagtcacaccaggtgcaagtaacataatatctaaatctgatgataaaggcttctggtcattttcatttacagcatgtggttgttagtggccatttctatgtggacagacaaattcgaacaatattcagttgctttgtttataatataattgtatttttttattgtagaaatcaatatatgaatatgaattcttactgtgatgtttcacagggccactttgatattctctctctgtcgggctcatttctgctcgcagaggatggcgacactcgtagcagaacaggtggtttgagtgtggcacttgctggaagcgatggacgtatagttggaggttgtgttgctggaatgctgatggcagcaacgcccgtgcaggttccccattcatctatttgctgctatcactttgttttcagctggtttgtgccctaaactagcattttctttggccttctgttacattctgttttccaggttgtagtggggagtttcattgctgaaggtaaaaaaggcaaggaagaacatctgaaacgtgagccaacatctgccccgacgccgaaccacgcagctggctttggcgcagccacggctgccagtcctccgtctgatggatcatcaagcgaccactccgatgacccagggagtcccatgggacctaatggcagcacattcaataattcaggtcatcccatgcattcttcgtatgctcctgttagctggtcgctatctgggaatcaaggccgttacgatcccgacctgaagatgatgaccgactagataatcctgtgtttttaagctctgttagctgttgacccagtagagtgtagggatcagggattcagtgtttcctgcaccgacaccaccggcagcgttggccaataatccggtgcgctagtagtaatcagtatcacaatgcctgaacaaaagagatcaggaacaaataagtagccccagcgcatggcttggcctgtcaggtagctaatttttatttttctcaatcggtagcttatttagcatgctttgtcagttgtcagcctagttgtacggttttcttatgaatgtttgtacacctttttcttttctcgctagtattcggcgtgtacgaatcttaattaagattggaatgacatgttattggatattgtcgtttttcttcgctgtgtttcaccctgcaaaaccattccactactgatgcgttttggtgtagggatcacatagacatgaattctgatcgcattcatacatggtaccagtaatggtgtgtataagtctatggcaaagtgccaaaatctatcgagaatccgcaaggaaataacttgtaaggacagtaagaaaataattcttgtgggataggaacactagagaagaattaataattgtgtttaaagacaaggtatttgccgtcagctcggcctacagcttccaaaatggtggcagcaggtgcgtctctgttttcggtcaaaggcacagagccgccttcgattctctgtgtatgttgatctgctggaagctttggaaagaaagaaacgtaaggatttcgattctatgttcatgttgatctgctggaagctgtaaggatttcgattctctgttcatgttgatctgctggaagctttggaaaggaagaaacgtaaagatttttataacagaaagggtggtagaacacttggtggcagacatcaggaggtcctctgatctgaagagtggccggaattttttctttcgaggagtagcagcatgtttttggcctccttaaatagttttcctgttctttttcgaggtttcccctcgactctgtaatatcatgtatattgtattaccctctttttttatgtatattgtattaccctctttttatcttaaagaaatttggtttacgttctttttcgaggtttcccctcgactcgacagtgtaatatcatgtatattatattaccctctttttatcttaaagaaatttggttgacgtccttccgccgacccggcaaaaaagttttctttttaggctatggaaatgatatatttgccgaacaagttttctttttaggctatggaaatgatatatcagtatttcgttctaaaaaggtgaaacaatagggatactaagttctaaaaatattttacatgaggcagaggcatgttggatcaatttgatttaagagaggcacgtggataacatattctcttacctttattggattggcaaaactaaggatgtcaatatcttgtactccctcggtttcatatttgactcttaaaactcctttatgtttttttgtttgatcaaatttataaaaaaaatagcacatatatgataccaaaataatttaattaaatatatcattaaatatattttaatagaatattcattttgtgttaaaaatatcattatatttatctttgaattctatccaacttcaaaaaaatggggaaaaaat

SEQ ID NO: 16497 - DNA, 22709 bp, Oryza sativa
gcaagtagttcatcaattatatttatctctgaattctatcaaacttcaaaaaaatggggaaaaaatcaaaacgactagggagcacagcatacactgacacggctacatgattacattcatcgatataagtagatccgtagatgcgtacttcaaaaacacatgaaaacgaaagccctttcattgaacagaactacatcaagcatgttaattttacatctgacactttttattccagcacacgcatgtgcacacagcatacacgcgtgcgtacgaacacaagctaacacgatcagcggccgggctgggaccagatcactcgctacactgaaaaaaaacacactagcgatccagatcgatcaagcccgcccatgtccatctaccccaaatctagatgtacgatttgtcggacgccgcgtacgtgccggtgccggtgccggtgccggcggccgggtatgcagggtcgacggcggggccgccgaccggagcgtggtggtggcggttgccgccggccgtaagcggcacgcgcgtgccgtggcggcccgtggtggcgttggcgcggtgctccgccctctcctggtgctcgtcggccttggcctgtgccttgccggccttctcctcctgcttggccatctccttctcgccgtgcgtggccgccgtcgcctggccggccttgccgtgcgccttggccgtcccctccttcaccttctccttggcaccgctcaccatgtcctgcaccttcaccttcgccgtctgcatcttttcttttcttttgctcctacagtacagtagctacgtgcgttgcgtatcagtgtgagcctgtggattgagattcgttgcttgcgttttgtgcttcgacttgcgacgtgttttggacgattgggttgattggagtagagtatatataggccatcgacgatgatgggatggatcatggatgagatcgagcggcggcgttgggtgttcgtgctaggtggcgcgcatgcgggggatgcgggaggaggggatctgcacgtcacggcatgaggtggcgcggagcttttgggcctcggtgggcgcgtggctgcgtggcgcaccgtcgagccgccatgtgcctagatgccggccgtacgtcgtccgtgctcgtgacctgacgggcatcgcattcccatggccaggtacgcaacgcatctactccctccgtctaaaaaaaaccttaacctaagcaaatatgtaacatgtctccccgcaaaaaaaaaaatgtaacatgtcgtagtacaatgaatctggataactctttattcagattcgttgtactagaaaatatcacatttccttttaaatttatttttttttctgaaacggaaggtgtggagggagtatgtgttcagcttttattttttcccttcctcttaatgacacgttggagtctcccggcctattatcgctagactcaaatggccggccctgcagcccatataaggattttgtagtgaaaggagtacatgcacatgggcctgatctagaatgttgaccggatcgattaacgatgcgtccggcctgtactttgatcatctcaaggacagtaccatcacattttcaagttcaactctcttttgttctcgagagaagttcagttgtctccaatgaaagtcaacgctttgctcctctctgaaggtttcgatacagaattttttgtttgaaaaggaggattttctgtattgattccaagtcaatggtactagttttgctcaactaaacaaaagtacaaaacacacgtacatgtcgaattcaaacatgttgctagtggatgaaaaacgccccagcttttacacagttcccgttcttttttccaaaacaaaaagttagacgaagattaagatttttgtagcacgcttttcaaactgtttaaataaacagtacgtttcgtgtaaaaactttctatatgaaagttgctctaaaatatcatattaatatacttttttaagtttgtaataattaaaactcaatcaatcatacgttaataccacattgttttgcgtaaaaagcttaatcttaatcttaatcttcatctttagaaaaaaaacaccacctagattttttttcctatctcctaatgcacttgaattgtttaatttcaaatttctatgaaaatcacgcagaattcatgcgattttagacagcccacacacaaacacagatgcatataccatgctgaatgtcctgctttaatctcctgtattcctacaaaacaatacacatccaatttctcttaatttacaatttacaaatcactttactgatcactctgaaagatgatcagttgagagatttgaggtagtccttgaggtccgtggggaagcaagggtactgcctccagaacgcgccgtgcgctcgcagcatcttcaccgccttgtccttggtcgacggcgagctctccacttgcatcagcgccagcagcttcgccacggcgccgcccaccaccatgtcctccagcaccctctcggcgggggccggggcgcacgccaccagccacagcacgttgacggcgagcctcgtggcgagcccggacacccggagcacggcgcgcgccacggcggccaccgccagcccgtgctcggcgaaggccagccgcccctcggggcacttgcacatgcgcttcaggaggaggagcgaccgctcggcgacgtggcggtcggcgtcgaggaggagctcggcgaggacgcgcacggcgcccagctccacggccttggcgcgccgcgcgccgcgggagtaccgcgccgtgacgtcgaggagcacgtcgagcgcgcgggagctcagcttcgcggaggcgccgtcggagaggagctcgaggagggccttgaccatgtcgtcgacgtcgacctccgcggtccagtcgcggacgctggccctggagatcttggagatcatggacattgcgtgcagcctcgcctcggcgctgccgcgctggaccagcacggacacgggccttatgcactccggcttgagcaggagctccaccgacgcgtcgtccgagagcggcagcgtggcgaggacggcggcggcctcctcgcacgtccggaacgccgagaagtcccccccggcggagctctcctccagcgcctgcgtcatgacccggccgagcacctggatgccgccgcacgccacgaaatcctcccgcgccgcctcgtcgccggccatgcaggacttgaggttcttgagcgcggtcgccttgaacggcgtctcctcaatgccagcgagcaccgacggcaacctctccctctccatcgcgtttgacgacgacgacgacgacgtcgtcgccggcgagccggccgtgctcggcgacgacgacgaggaggcgcggtccagccacgacgagatgacgcgcttgagggtgtggttgggagtgaagtcgaaggaagcaagccgctgcatggtggccgggcacgtcgtcttgccgtacttgaagaaccaccgctcgatgctccggcggtcgtaggtgacgccggtggccaccgtgacggggtcctccattagctccatcgagatggggcacaggaacaggggaggaggctccattgccattgcgatcaaacaaagcagcagctcgatttcttggcttgagtgagaaggttgagggagaccaagctgggatgttggttttatacctgtaatgtcatcatatgcaattaaaaagtcaagctaacccaaagtacagccgcaaaatggctcaaattcaaataactaatgaaatactcccttgtcgaaatataggtatattttgtttcgttaggataaagctttgactaacaattgttatactaatatactagctctatattacattgtaatagatgacgccgttaacttttgggtacacgtttgaccattcgtctagttttttaaaaaaattatgtaattattatttattttattgtgagttttcttatcactaaaaatatctcatatatttacatacaatttttgaataagacaaacggtcaagcatgtatctacaaacaacaacgccatctacaccaccacaccacatttcattatatataagaaaaagtttttgatatgaatctaacaatatcaaccaaaaacatatgttctaatagactaattgttggtgctagaaaatctttgagaaaaatgaagaatctcagacaatttagtgctagaaaattgtaatacctgatgctcgaaaatctcagagcaaaatgaaaaaaaggtaaatcatgatgcacgagaaaaatgaagatgccatccgtctccttttcatctcaatagcaggttaaatatatgaaaaaaaaatgttttcttaataacgatacgaagatatgagaaactatcaaaccaagtcaacaattcttccaaattaaaatcccgtaggggaaatgcttaaaaagtacagcttgcagcattagtacattatctgttatgatttctaacgatctgtattgatgtaaaatactctagtcaagagtcagacgggcagaatagtaagcgatcgatcgatggctacacattaaagtgccactgtgcaatgcatgcaaaataaataatactaagtctatggattggccgtgatctgtattactcaagacttcgtctcttacctagagcttatgttctatggatcaatttattcgagattttgacgaagaactagagactttttttattccttttgttttgctgcgtgcagggagcaattcgatgggcgtcgactggagcaatctgatgggcgatgatgaggtgacagtttcacaagtattaacctaagacttggtgtgatgctacttgtcagaaacgtaatgaagagaacacacttgcttgcttattcctttctgttttcttcttcttcttcttcttcttctttttttgtggagacagaagaagtttaatttttcaaaacggcaaatgcatctttggagttgttaaatggagattggggaggagctggcagaggatgacggtggatcttgaattgttaatctgtccggttctatttcttcttctgtttgttcacttgcatgttctttttcctctgtctgtattaattagttgcgagcggttgagcgtttcatttgaccgtgattgggtcatccatccatccagccgcattctcatattttctttggatgaaattatattatagagataagaaatttgcctgtaatgtcatttagttagaagtttcacacctctcaacatcatattactgacggcggatgattaattaatggtaaaaaaaacaaggtggattgcctcttgtaatcttgtatctatacaccatcttctgtacccaattatattttacctatacaagggcttttagcttgttaatgctgacttccctcccatgtataatgtatttttcagaaatgaaagatcatgtgtgccagattacttgggagtcaaaattatggtttctcttaatgtggtttaggtgatagtttggcatcattacgacatctttctttgtcatgcaccgtctgccaactcctgaaactaaaatggaacagaaaacgagtacaagtgcagttccaactaaatcactgtctgacaaacgagtactgtcttcagttcatcatatctgagctatgaagatctatttcatcacagagaatctgtttctgctccaattaattagcaagtagttttaacaaaaataattaataagtatcttgtggttgtcatgccttaatctgccagcaaaacattttctatatgattaaaatggctatatcaaccgtactgtagtgggaacatggatgatggatcactttgttgctttattttttatatatagtattttgctaacgcaagccaaaaaaaaaaaaaaatggttggccttaagctgtccattagtgcaccgccagttagcggaagatgcaattttcaaaacaaaaataaaaaacttgcacgaaattatgtttacgaatacttgcatatatatatataagcacccactagttaatacccacttgctagttgctacactgacgttccacacgtcctaagatcctatcgtttgctcttgccatcgccatacgactttaagagtttttatttttaagtcttgtactttgacaaaattaggcatatcgtcgaacaaacgctccctgttcgatttgactgtggcgaaatattcttttgaacagacgttgcaatcggcgcagctgctgatgatcatccataaattgataaattcgttgactaatcgatctgaaaacaaaggagcgtcctgacaagaactgtcaccggctggtggggttacaatatttttcagaatttggaactgctcagagttgaattactagtggtaataccgacacgttactcttactaggttcttatcctttctttgtccaacagtaattaactttaaattctgttcctgtgaacagaagcaataataattccactgcggtgacaaaactacattgacaattggcacagagatcttacctgttcgaacttcgagtttcttctcgggaagacttcagatttcttaatttcggttaagcacacagcgtttgacattaatcagttgcttgtttttgcatccatttcagcaggctaacgttttccaaacgtatgactgcagattgtagaaaaaatgatggtcggatgattcataacgttcaccgaattaacaatcgtgcttccacttggagcagctacctgtacctgcatgattcctttcaaacattgttgtttattcctacattgcatcttgctagtgggaattgatcctgacagtttagctttgaccatcacatcaactgttgtttcagcaaattttgtacctgatatctctttccagggaaagacaatcagattgtaaacttcagctctgtttcagacggcccaaatatatattttttcctgtcattgccacaaatggtaacattacaaagtcgttttcactattcatccgtatataatactctatcgcatgcgtgtacatcgaagtcagaagtaacaaaagaaaaggaaaaaacatgaaaatgatggtctattccaagtgttccacggcattgccgacaccgaattggggatcactcaatcctctgatggtacacattaaggacatagctgttcagaaggtcaccaaatgtcttggttgagaacttctgcacaacatggccccttgcttgtttacccatcttaactgctagatcgtgatcgttcacgagcttcagcatggcttttgaaaattcaggggcagagggctcacagagaaaccctgtctcgtcatttatgactgtttccactggaccaccactgttgcatgcaattacaggtttatatgcggccatggcttccagaggaacaataccgaaatgttcatcctgcaaaatgtcagacgcaggtttattatgggaaaattctcatgttgttgagaatcaaaagacatgccagatatttacctttggagtgtataacacacaaaggcagttggagagaagttcgttcctttcagaagttgaacaagatgtcacaaatttgacatgttcagaaaccccttcactcgctgccaatcttttgagctcctcaaggtattcaacattttctctgagacgcttatcatatccaccttaagcataatcttttgtaagtaaacagtagttgccagttggtaattcataatgcagtgacgatgcaacattcaacctgtagtggaaaggaaattacctgctactgttaaggttacttcctgtcgagcatcaccaggtagcatagaagcaacagagcgaagcagagaaaatgctgaaatggcaagaccaagattcttttttctctcaaaccggttaattgagaggaaattcaacctgcgcagaaagatgatggttaaatttggctagacctgaaggtgcagaaggtgagaaaaatgcttacacttcacactatactatttttttttaaataaaatgaaacctaagcgagttacagagagatatacaagcatgcagttacttataagcatgaggttcctgaaactgttcaacagagacagctggatatagaacagcaggctcgactcctctagcatgaaggctgcaaaaggtcctggcaaatgttgttgcagtgaacttgctgtttactagaatcaaatctgccatacctaatacatacaaaaaagggataagcactacagatagaacaaacactagggaatggtaaaaaacatagcaggcaacagttctagatgaacaagaccataccagtagttgtttcttcaatcatgtcaattggcttgcgatacaacctccgaagcatggtagtatgttgagcaagcaacatatcaggaaagtgacaataaaatactatctgaatacacgggaaaaagaagttatcaacatatatctacagtggaaacatactgatcacataaagcaagggatcaataccttggattttgccttcagtttaagcagtggaatcacaaccgaaacctggtctactaatatgatgtcaaatgagggccaccaaagtagcacacacattgcaacaaaaatgcagcgaagatatgcacagatagcgtggaagcggtaaaaaatatggcgaggcaagaaatctccatatactttaacttcaaatggacctgcaggacaatagaaaatcaagtaaagtttccattggcataagaatccctacacactattgagcgatttgagtagggtatccgaggaaacgttttgtgaaattttgtacgtaatcaatcgacaattcacataggaatatatgcatatcctctacaagtccacatcaaatcagtcatagtacatagtaagtctttaacacaaataggtactgcaactaccatagtaagagagttataagcaacattcacctcagatagagtttagatccttaccagaaacagtctcttcaaagcatcggtttttgtcatgatgtgatgtgaaaacatgaacatcatgaccatggaccgcaagctgacaagccgcatcgactatcaatctctcagcaccacctacacaaaaacatatgttttctttgaacaattgagatctagtacaatgctagaaatgctgccacacttagtccattggtcaatgtcctataacctgctgcaatactgctacaacattttttttctcgaaaatgttcttaaaaatctcacctgcatataataaacaagccgcaagtcctacattcaaatgaaaccgtgcaacggcttccccaaaaaataagccaattctagggcatcactactcactacttaactagaagtatcaacacagtatggaagtgaagaagaagaaaaatctttccctaacactcagactaccccgtaattgcagcaagcaactaagcatacgtcgaaccttgagcaaaattgaggaacccaacaaatatcccagctacaagctcaggcagcaacggttcctcaaatctactgatgcttccaccgcgtggactcggaattgctacatatcgaccaatttacaaagtagcacgcaaccaatcgtttcggggactcaaccggatctaccaaaattctgcccacgagagatgagggttcacccaagcatcgacaggagcaacaggaggggggagagagagtagaggcgtacctatcccgagatcggggtggatcacggcgaccttaagctgcttcgtcctcgtccccgacggctcgccggcgactcctcccgccgccgctgccatctccctcgcgtaaccagatgggcttcggccgccgccgccgccgccgccgctgcgggccgtggatctctgctcgctaactcgctctcgctagtcgtgtcgtcacgattccagctgagttgatgtgcgggtggattgggcctcatacagcccagtatctgataacgcgtgcgaatcgcttacggcccagtagcccatatcaatttgatggcatcgagccgtcgagtactcgagttcgagtgctcgcagaatgcagatttccatagcatattatttcggggatggctaattagcgcgtacgtgccctttacctaagtcgcgcgcgcgtagagaagcggtgggcccacttgttttcggcatcacgtacgaagaaaagccaaactcccgttcgtgtttctctctttttttttccggaaaaaaaatcgtcacgggagtgcttaattctcttaaacacttttaacttagatttgaatcttttcaactttgattcgaaaactttcaactctatatttgaaagtttaaatttatatttgaaaattttcaagtcaagcttgaaaacattcaattcagatttaaaaaattttcagctcagatttgaaaactttcaagtccagttgaaaacttttaccttagatttaaaatttttcaaatcaaaatttgaaaactttcaactgaagatttgaaaattttcaactgaagatttaaaatttttcaactcaaattttaaaacttttatcttaaaattcgaaactttcaacttaaatttgaaaatgttcatgttaataatagagctaattactggaaaaaagaaaaaaaaaagtatgagatcatagcgctacgtactcatgttaatcacgttagatatggcgttaatcacacactaattgtatgagttggcacctgcacgtgctttactaatgagcctgcgaacgtccgaaacgcgcgctgagttgacccgttggcgcgtacgcacacaacagcaaatccgtattatttcttgcaccaggatcctgataaaagatgtaggtatacaagtggatcacccgcgaagctttatagattaaattaaataaataggcaacccacggccggttcccgtcgtcaagttggttagtaagtaacccgtggattaattcataggttgcccactaattttgtttaagtgggtacactaattttgtttaagtaattttgtttaagtgggttcacggtcaactcacttcacagattcatcttgacttcaaagtaagacttcaaagtaagaggaaccgtcacatatcatgaaaaatttgcctcacagcagctactgtacatatctgcttcgatctaaactgctcatcgactcatagagtcataatgcagtcgtcctactgctacaccagggcctcaaaagaagaacaagatagtgatccactgcatttgcaaaacagttttcaggtaactgctgtactgattttacacgcgagaagatttcaggccatgatgcatctttcacacataagaagggcagtatcccactgggcagttcatcacaagaccatatacagtcatggcagttattaaggccaagggtcctgatcacagtctcagcatttagcgacacacgctgggacacgatatccacacttggaagtgtaagcagtaacatggtcacacggttaattaagcctaagcagcagcggtgtccttgggagagcacggcgtaggctgggcatcaggcgacaggttggagatggagatgagctttgatctgtacttctctgccccgtcatcgtcgtggtggtggccattcaccatggcgccgctcggtgacttgatgttgacggcttctcctgccgctggaacagaccgggagatcgcaatcagagactgacgggcagcttcctgagtgaactctctcggtgatgcaggtgaggccatcaaacaaacaaaggctgcaattcaagcataacaggaaggtgtaagtatacgatacagcttattagaaggcttggcatataaatggaatgaataactaattaagtagatgctagtcattgagctaaattaggcagcttataattgtactactaccaacactcctaatataaagcaataaaaatagtaatgttgaaaacacaacgtaatggtccacatgaaagctcctaaaatattctgcagtaactgcatgtcagtttcatatgaaaaatgttatacataaagggcgattccatcctccaacctctgcttaagcctgaagtgtgctgccctgattgagtttccgaaaaagtagagttattcaatttaagtggagcatttggtatacatgggacgaacgggttcagtttgtgtagtcgcacaaataattgctgagctatgcacccgttagcacacactgttttagcatgaaagatgctatttttgttgcaaatgatccacccataaatctgttgtggataggatatcaggcagacaggcaccaaacaatcacactgtattcttgctaaaaaaaatgacttgccttttgaatgaagagcattttgatcatgtgactactgaatttagactggaagcatagactgggtacataatctggagtgagattttcatgctgcttgaaacgatttagtacgtttttcagtactaaggttaaacatcaaaagagtggtagatcgcaaaaattaggtaggccatcactcaaacagtccctcatatatagactaaatacaaccggtcgttttggtaggaccagctaaaatagactacttactagaaaagaattactactccatataaggaaagacaacctcaaattgcagattactatttcaaagcgtcgctactatagttacgtaaccttatcctcagcgtgaggtgcacctaccaaaccgaaaggcaccaaagaactcacaagcatttcactagtattacgagcttttcggagttccagtatcagccatgtggactaaatcgttgacgctccgaataccgcgaaacaggggcggatccaacttgggacatgaactgaacccccaaaacttttggggaaacaaacaaactgtttacttgtagtaagttcaaggctctgaaattaagagaagagcttcttccagatctagaagagaagctaggattgacgaacgcaagcaaaatcccagacaacagtactcccggtgggagagagatgaatcagaaagagggtgtggatgctcaccaggatcccctcccctcccctgttcagccgcgacgcgagatggcgcacggagctgaggagacgacgagacgggtgtttttccttttacgccaaagagaaggggagagatactcgagaaatgagtactccaccttatatctctttttttaggatgattggtggcccacatatcagcattactcagaaaataaaaatgcaacaaattcaactgggaattgtgtcgatgtcaaaatttggagtgattctctaattggttcgcttaaggaaaggagtcgattgatggattgaagttaatcgagagatcaaatttatgtaggaatcgtaaatattacgacatgacaaattaattttatctattaattagacaagatttagaaactttcctttttatctttggtaagtttcatctagtgtccgatgacttgtatatttccttttacttttacttttaggaaacttgtgtcgtgtttcgatcacgacttatatcaatctataagggtataaatatatacacttaggatctatagaaaatatttctatatatcaatacaattatttttggcacaccatcatcttttgttccagcgagttcttagttttgagttgggatgtatcggttttgatctccggcgaggatgttccgtcaacttcgcttgtattggcgtggttaagtccgatattctattcaggttgacgcaaaacgttgcctatttgatatattagttctatctttaactgtattgctgtttagagtcgtatcggcttagatatgacttttttaattagattcgatattctgactaagttgatatttctctaatcgtattgttgttttagataaacatattgtattttttataatattgtataataatgagataatttattgaaccttatttataaaatcttacgtccgtcattaccgcgaaaactagaggcatgacaagaaaatgttttcaatactgtaatagcctcctgaaaagaagtactccactacactactaaagaacagttaactaaatctcgagggagatcaaatcaaactagtcaggatgtgttcatcgccataaacaagactctttgctggtgttctttttttctgaaaataaatatgaagatgaagattaagtttttttaaagtaaaacgagatggtattaacgtatgattgattaagttttaattattacgaacttaaaaaataaattaatatgatattttacaataattttcatgtagaaagtttttacacaaaacgcatcatttaacagtttgaaaagcatgccacaaaaatttttatcttcaaccaactcttgttgaagaaatgaacggacctttatcccaacaaatcatgaaatctccccacacggaacggtagacaagaattacttccatggttaaatactcacgtactcgcgactgaaccaaaatcaagtaatcaaccaagcgacgagcggtcaagcaacacaaaccaaccacgatatactgtcagtacacaatccaaccggagggacgcctgaccagctagcaataatccggtgcagaaactaacgcgcttataaatacacgagatgcagagcgagcgcttaccagataatctggcaggacagcgggaggctgcagggacgagcgatgaggctgcagcctgcagggccgaagatgagagaaagctatgggcgatggagagttggagacgattgggggaaggaggccaaccgaggatgacaaggacgacagggtgtgggttcggtttctttacggagtatatgaccgtgcacgttgatcacgacgcgcgggggttgagctggtcggtgagccatcgtggactaccgccgcatccaccgctcgtttgctcggtggatggtggggtatcaggctcggtccatagaccaggttctgggcattatgcctcgcccgtgatgaaacggacaagagctcgagttgtaaaacacttcgagaggtgcacgtgaggtgtcgtatctgcacgaatcgcgaggccatgtgtctctggagaagtcggcgaggtgaggcgcgctcggagctgcgggccccacccgcagatacgtctgtagcctggagcaaggtggggccgggccgtgctggaccgaataggaaggggagcggacacgggctatcatccagcccagtttgttcgtcactattctgttccggcccaaactgctggtgttactgttacgctccaaacctaagaaccatcttctaactgcattgtgtcacatgtaattctgttgcaaaacctcatggcagccattttgttagttgtcgaactactttcatttcattaatgaaatagaagaggatctcctctctttctaaaaaaaaactcatggcagcttatttattcttcgcgttatccaactctgaaatagtttggctttgagagtttcagttattggttggaatagctagcttttctttgcaagctgcacagctattttatcgctcgaatacgaattgtatgaatgtgatagttctggaaatagtagtgatgcatttgtgctcattagatatatgcgttacacttgaagaagaacaaagtgaaaaaacacacatcacatctatatgcagcaagtatcaacggaaccaaacgttcccctcatttattaagcatggattacacttgaaaagcgaactgaaaaacacgatcagagaagcagcgtcgccaactgccgctgccgcccggccggcgaggaagaagctagtcagaaccagcgccgtacggaaaatccgggctcgggctcgccgtccgcgagctgctcggcggcgactccgcagctgccacgggcggtgagcctccactccgaataaccttcgggttgggtcccgtcgacccacccacacggccggctgcaccgtcatacgcaggcactgccggggagccactggacacggccgtcggagaacatggtggtggtggacgaccagtcatgttaccggaaaacgtcggcgacggcggtggtggtggtggacgaccggtcatgttaccggaaaccgtcggcgacggtggttcatctgggctcttgtgcctgccaccggaagctctcggcgtgtcctcctccggcggcgcctgcgttccaccgccggaaactcttggcgtggaaggtggtggcacacgtacactggcgtatgcgtccggcggtgtgtgcttgccaccggaaactctcggtggtgtgtcctgtggtggcggcggcgaacggacactcgtgtttgcgtccgggggcgtgtgcgtgccaccggagatctttggtgtgcgtggcggcggcgatcttacacttgtgtatgcgtccggcggcggcgtgttcgtgccactggaagaagctgtcggatgttccggtggagggagtcgcacgcttgtttcaaccactggcgccggcggcggtggtgttcgacggggaaaggtctttggtgaaccaagggaaaatctgggagcaggcggtggaggagagcgcacgctcgtttcagacatcggtgtctgcggtggaggtgttcgacggggaaaggtcttcggtggaacggacggtggaggagagagctcgctcgtttcagccactggcgccggcggcggaggtgttcgacggggaacggtcttcggtggaccaagggagaatctaggaacgggcggtggaggagagagctcgctcgtttcagccactgctgccggcggcggaggtgttcgacggggaaaggtcttcggtggaccaagggagaatctgggaacgggcggtggaggagggtgctcgctcgtttcagccattggtgccggcggcggaggtgttatacggggaaaagtctttggtggaccaagggagaatctcggagcagacggtggaggagagcgcacgctcgtttcagccactggcgccagcggcggaggtgttcgacggggaaaggtcttcggtggaccaagggagaatctaggaacgggcggtggaggagagagctcgctcgtttcagccactgatgctggcggtggtggtgttggaccaggaaaggtctttggtggactaagggagaatctaggagcgggcggtggagaagagcggatgctcgtttcagccgttggtgttggcggcggcggtgttggactgggaaaggtcttcggtggaccaagggagaatctaggagcgggcggaggaggagattgcacactcgtttcagccattggcgacggtggtggtggtgttggactgggaaaagtcttcggtggaccaagcgagaatctcggagcgggcggtggaggagatcgcacactcatttcagccgttggcgccgacggcggtggtgttggactgggaaatgtctttggtggaccaagggagaatctgggatcggacggtggaggagagcgcacgctcgtttcagctgttggtgcctgcggcggtggtgttggactgggaaccgatggcgcgcacgcgccaccgctgctggtgggaggcctcgggctggcttgagcaccagcggggactgacgacgaccgtggtggcgccctggaggtcgccgcgacgccggcgcaatgccgcagcaggccatgcgggaggagcgaggcgacgaaggtgcgggtgaagggcccgcagtgctcgtcggcctcgcacgccgcgaggcggcacgcgcgcggaatggggcaccccgtgaagaaggcggcgagcaggtcgtgcttgcagcggcccagcgtcagcagagactcccagcagatgcccgagtcggtgtgcgggccgcccgggaagatgctgtcgaacgtgagcgaccgccgcgccggggtcgactgatcggcgccgccgccgtgcgcgacgcacgcggccacgagcgccgcgagcagcaaggccgtcctcatggttggcctcgcaaaaccgcagctctctttggctgcacctgttgtgttttgtgcttcactttggagcaccaaggccgtagtagcgggaaactgtatttatagagtgttgccaagctgttaattgtcccgatcgttttgcttgcacgttgggaggttgcacgtttagattgattaatgctagcgtgttaattgtgcatgtgtaacccaccccgaagatttgttgaatgttcatcgatggtttctcatctatgttctgagttctgacgttttctctagccaatgctgtgaattgccattactcgtagttgttgaccagtaatgtttaattcatgagtaaatagaatgcgagtatgtgaccatgtctgaacggttatccagatggaaaagtagaaatacaagtaaggaattttggacttgaaatgcaaatcagatgagctgaaagtctaaacctgtatgtttgtggagtaatatatttcatattaatctatgttgtcggtttttttcatatttttttttgactatttagatgacatgcaaataacgagaggatgtcctcgagagggatgaaaatccacatctcctataccagattcaacctgtttggcagctgagttttccaatttgtcttcctcgttttccgtgcaaaagcttttaaaactgttaaacgatgtgtttttaataaaaagccttttttatgatagttgtttttaaaaaatcatattaatctattttttttaaaaaatataactaatatttaataaatttcgtgataataagttactccggtttttttttgtatgcgggagattagttcccaactggaaggaacaaaacgcagcccggcctgatgatgaattttttaataatccctaaacatagagtacctattaactttcatattgtcaagttgcaccatttttttttaaaaaaaaaactgaagcgcctgatctcgatgcctacctacatatgaggatatatgacgcgtgtttttttttttctctttgatcattcgacagaatccctccttgtccgataatgaatagaacacacgcactcgaatcggattcaacagagcccccgacttttgttataataagttagcgtatctctcgcgcactaacttcaggcctcatcgatcattcatggcagtcgaggcatgcagcatatgtcgtcgaagaggggcaagagagcacgccggtcgtccgccggccagccgctgccggacgaaatgatgacagaaatcgttctgcgcctgccggcctattccatcgtccgtttccgcgctgtctcccgctcatgggccgctatgctctcttctcctggattccaggacggctacgcggccatggcagatgcccgtcgcatgagcatgagcaagttcgtcttctttgcggcgtcgccggcgtcgcccagaggcgccacggctgtctactcctgcgacgtcggcccagtccggcgcatcacgacgacgacgaccgacttgctcttcaatatcgaccgcctgcgcccgggcttcctcgtcgtctcaagcaggccgtgccacggcctgacgctcctggctgacactcgatccttcgcctactgggtgtgcaattccagcaccggcgtgttcaggccattgccgcggcggcgctgccacgatctgtccagcgccggcctagccttcgacgatcggaccaaggagcacaaggtggtgcatctcttctgccatgtgagccgtggcggcgagagtgagtccatgaccatggttgcgaggtctacacgctctgcaccccaagccgcccgtggaggccagcctccggaggcataccggggcgtctcggtggcgtggtgatctgcgccctcctctacgagggcgcggcaaccaaggtgcccccggtatacgccaatgggttcttgcactggcagctctaccctgacaaatacttgatcaagacctcttccctgacacgacggtatttgagaaccgaaacagcagcgttccagtgctatgcttctctgttgccgacgaggccttcagcctggtcgctgggccggcggtcgacggcatagcggattactgcgctttggacagccactccccggctgttccactccacctggtggagctccatggctctttgtgcatggtccgcgatctccgccatcttccgcatggtgaaagctgcctggagatatgggcgctgagagattacagcgccagcgtatggtcactcgacttccgtgtcgccatgacgccgcaggtggcacgcgacatgcacgatccccggttcatcaccgtccttggatgtctcggcggcgcgcgcggagacgacgtcgggagtgtggagcggatcaagaaaatcctgatcgctacctcgcagcacaaggtgcacgcctacgacccagctacggggagcatcgaaacggtggtcaccgtcccagaggatttcgccggcggccgggaggaggcggtggccggtattcggattggtctgtacgaggacagccttgcccgtgtaggcggcgagagttgtcgacagagggaagccacggcggcgatgactgagatcctactacggttgccgcccaaatcaatcgccatgtgcatgctcgtttgcagacagtggcgcacactgatcgagagcgagcgctttcttacgtcacacatgcttgctaacatggaacggaagaaggtcatggtagtcacgaatggccgtcgacgggagaatttctttaatttcatgccggtggagacctggattgggcctgccgccaaagctcgttcggacgttcttgtcaaccgcaggatcctctgctctaagccatgccatggacttaacctgataagcaccagcagcgacgactacctgtgcaacccttgcactggttctatccggtgtcttggaatccgtggaaagtttcgtgagattgatccaactgtcagtattgatgacgatcgccgccatgtcacgagagttggcaggaacatcgggctaggattcgaccggttgtcacaagagcatgtagtggttgagatgagccgcttcaaaggcgacctgcagctgtgcatgatcaagacgagctgcgtggattactggagctgcgctggcaagccgccgaggccggtgaccgacatgccaccggcacatgttgacgggacgctctactggatcagcgagccacagccgacggcccgagaccgtgtcattgtggcatttgacatctcctcccgggagttctccgtcttgccatgccagccatgctgcagcgagagggacggcggtgattatccgttgctcgtcgagctggaaggatcgctgtcgctcgtcgtcgcaaacgcggaggagaacaatctgcagatatggacgatgcaggaggctgacggcacatggcacaaaagttacagcatcttactggacgagaggtacccggacttctcactaaaaacgggcgtggtggtagtgccactggacgccgtcgccgatagcaatggcggcggcaggatcttgctcgacacagggcgagcattgggctactacgatctcgagacgagaagcatcgacaccttgtactcgctcgaccagctaaagcttccccagtgccagatggcattccccatgctgtacggggatagcttggtgcccatccaggacgacgaaccgcccgactacgtcgcgccgactcttcgcgacgacgacggcgggcggcgctgctactaccagccgcaacacgtggagatcagcggcggcgagcagcctgcggctgcctcctgcgtattccggccatgcgaggcggccggcggcggctgcaggggcatgggctgcgtgtacgcgggtagctgctgcaggagggtgctgtgccgggagtgcagcctcccgtgcgtcgagcacaccgacggcttccacaccgcgatactgcccttcctgccgcggcgctccgcgacggcgaccgagatggccgaggatttgctgctgggtttgcctctcgagcacccgtgcgtgccggggcccgagtactgctactactactcggagggggacgaggtggaggaaggcgtggggcggcacgtgttcgtgtcgctcagggatctcgcgcgcaccaggcagccgcgccgtctcatcgagtgtgggtacaggatggatatgatttacattttggtccttttaaaaaacttatttcgcaaatagacccctggaaaaacttatcccaaaaatggtcctttttggggcgccagagtggctggcgccgtcgtccaactgcagcctctctggcgccgtccccctgccgacgtggcggggcaatgctgaggtggctagggggagcgcgccagagtggctggcgccccccccccccaaaaaatttttttttaatttttttttatttttttgatatttttttcacgcttagggacatagaagaaccaaccatagaaaaaatgaactcaaatggacgtaatatgtgacatgtagaatttttcctctcctctcctctctctccgaactagtgcagaggagagagatgtgcaactttttttatttttatttttatttttttgatatttttttcacgcttaggaactcacaagaaccaaaaatataaaaaataaactcaaacggacgaaacatgtggcctgtggaattttccaaagctctaccgaaaaacttctctcatcgaaaacacaatcttgcaagcggaatttggaggttttaatatcgccgaacacaatcttgcaagcggaatttggaattttgaattagattaagtaatttcataaagtggtagagtgcattatgtttaacatgctgatcaaagggtagatcaaagtggtagattagtgaaggtgcaaagtagactaagtggtagttcaagtttaattttttttttggttggttgtatcgtgatcctgagagtgaaaaaacatccgagaaataaaacaaaaatgacactgttgcaactccatacagagaagcaggaatggaggcgagggtttgggagggggggggggc

SEQ ID NO: 16498 - DNA, 29314 bp, Oryza sativa
gcgccctcctcatgccccgttggttcgcgtgccccacggtggcaggaggacggcgccagagaggcaggcgccgtcccgttggatgacggcgccagccactctggcgcctcaaaaaggaccatttctgggataagtttttttaggggtctatttgcaaaataagtttttcaaaaggaccaaaatgtgaaaaatctagacaggatggacgggaaggttattagggagacgtgggtgcgcagataccgcgctgtgtcttttaatagagaaattttacggtactttaaagaaagtatctaaattttacactgaaaattttgatatatgaaaatatcaaattttacattataaaatatggtactatgcacagagaactagagaagtcaagtactttcttaaggatggtaaaatttatctatttagatatgatgcaccatatgcacagagaactagagctttgcagaaatagctcgggacaatgcccgacagtttatatcaaagagttgatgaccgtcattgcgagcagtccggattccataacacgagcattgcgataaactaaaatggagtttttcacgaactaaactagtagtgttcaactctttgaactgtatatcatgaagtaattatgatttctctacacagatctgtcggactgtcaaccatacaacactgtctaggtgaagttcatttcctgtggatggtagcgaagtgaaagcccatgggttctcgaaattcaccggttccatggcaacggtggcagtaatctaacccgctaccaccacatatacggcacctggaaaatggaagtcatgccggagaagcatgtttctcagtaccagcagcataagtatggcagacagcttttgagtatgaggctatgagctcctcaccattgtggccattcgcccttcgggagcatgacaagatcggcatgattggttctccctgtaaatcccaggttccatggtcatgagagaactggtttgtaggatcatgatactagcaagagaagagaacatggagtacaagagatacctcgaccaaaacagttgcggcaatctattttgcctgtgcctctgcagatggtgcatggaggatcaggcctttttggtctctccctcctaatatttgactgcatcatacttgcagtgaagatatcaggattggtgtataaacatgtcaaaagttaacaaatgacaattcttaatgtacaatatggtctgagatggtcttgttccatctgtctggcaagttgaaggactcctaactcagtgacaaacagagagggtatcagttggcacagaaaggaaaatagcatgccctttctcaaccccattccccttttcccctgccatgtttccctcgcaatgaatctatgataaatctcatgtactatcacaatttttttcagataatggataacccgaccgctacatcaaaaaacacataaatctgcaaggccaaccttggtatgtttggagttaagaaatcactacaggctagagcaaacacacagtaagcattgctggctgtaaaaacgttggaacaagatctaagtcatgaagtgaatggcaagtaaattttgcttataaagtgttcagtggattgcatatttgcatggtgctaagcttcaggtattcaataaaaaagaagtggaatcaattgctacaaagttctgatacacatgacgaccttaacattctgtaagatggtttgaaatatattcaggtggggaacgcccccctccggcgacttggtcagaaaaaaacaattccgtaaatgtaatgccgaaacaatttctaccaaccatggcctaatttcctcatttttggtactcaattgccgattcctcatgattcttcccatcgcgctagcttctgctgcaggcagcacaatcttacccgctaccctaacccatccccacacctcctctccatgtcccgctgccgaggaaaaacctaccggtcgattcaactacgcttcctgtctacgaagtgttcgacgaatcgcaggcacgagaacaaaaggggagaggtgcagggaaggattgagctcacctcgctgcggacgatccatgaaggtctcgatatgagcacgctaggaggggcctcgtgaaatccggggagcgagctcgaaggagcctgccccgccggcgacgccacgccgttggggccggccgccggcgtcgaagccatcagcggctacaggttgcggtaggggcggtcgggcggatactggaaaggcacggtcgcacagagagaccgacctgttttcatcagttcaggctgcgttatccgcccacgattgggcctctttgggttctccttaactgggctaggctgggctgggctctattctaacgaaacaatgaataagttcactttaggtccctcagtttgctatcgagttcagagtccctagatcacaaaactggataaaacgcatccccaacttacaaaaccgtacaaacgaggtccctcggcagtatagcatctgattttaactgacgtggcatctacgtggcttatttgactaggtcttcgtcccacgtggcatttgatgtgccgtttacgtggcaattcgatccaaaaaaaataaagcctatagggcccacatgtcagttacacaccaattatttaaacatggtgagggccatgtaggccacatgtcagcctcattactccatttatctcactatcctctctctcctctgcatggggtcggagaggagcggccggcgcaaccctagccacagccgccgccgccaccgcgacggaggaagatggggcaaccacggggtcttccatggcgaaactggggaggtcacagcctcacggcatcagatcgaggggagctagggttttgggaggctaagaggaggagaaatgagctagagaggaaagaagccgctctaggttttctagttgggggaggagacgcgatggcatgggtgacgggtggggtggagcggctagccggccggtggagcagggcgggcgacggaacgaggcggcagcagagcagggggggtggagcggccgcggactgtgggcggagcaggccggcggagcgggcggcggaacagggtggcggcggagcagagggacgggcggagtggccgtggaccgcgagcagagcagaggggtggatgggcggagcagagggataggtggagcagcggcggagcagagggacgggcggagcggctgcggaccgcgggcagagcagagggatgggcgggcggagcggcgggacggagcagaggagataatggccgtgcctcctcctcctccggcggtgacgacggcggaggtggcgagctccacctcatcaagaagccgttcctttcccccctccgccaatgaggatgaagtgaggctgagacggagcctgctctaccgctatccccggaggaggcgctcgctcgcaccgttactgaagttcttccacctttctcccttctccccactggtcgcgtcgctgctgtgcacctctccatccgcccgtcgctgtcgagcccctacctgtggtgccctaccaacatcggcctccctgcctctggcctccccacccgtctcgctgacctccctgccttatccctctgcggctctgcacgctctcgccggtggagaagtggagaaaggagatagaggtagagaggattaggtggaggaggtgggacccactgacatgcatgtgaggcccactatttttattgactgacatataggtcccacatattttgttttaatttttaatgttgcttcgtttatttttttcaaatcaaactgccatgtcagcgccatggcaccgccacgcaggacgaggactaagttaaaccagccacgtaggcatcacatcagccaaaactgccatccaaactgccgagggacatcgtttgcaccggttttgtaagttggaggacgtattgtatctggtttttgagttgagggacgaaaatcgaatttggtgccaagttaagagaactctaatgaacttattccatgaattgatgattttttaaactatttataaaaaagttatataaaatattcaaaattttatatttctacaccactatatatggctgtgttcttaagttcaagttcccaaccttattctctcgtttaccgcgcgcatacttcccaaactgctaaacggtgtatgttttgcaaaaattttctatagaaaagttgctttaaaaaatcatattaatctatttttgaagttttttaggctaataattaattaatcacgtactaatccattgctccgttttccgtgtccaacccttacctaagaacagaaccttaatgtttttttatgacgtggcacacggccatgtggagggatgccagtcattttgcaggcaacccctgccaccctcctaaaagactataaaagggccgtcaatgtcattttacaaccggccccttagaggctacaactctctccagaggctacaactctctccagatgcttagaaatgtcctaggctgccattttataggtgagcccctttgcaggcgataaggtgactgcttgtaaaatggtgtcttcctccatgtgacattgtagatttgtgaagggcaacataggtgtagatttataaaactttaaaaagaatatgttttaaatattttaataaataaaattaaaaataaaaattcgaaaacaacaatacactctttagtggaattgaagggaattttaaaggaattgcaaggaactttggaatgtaggattttgaaaacataaagcatgaaaagcacaagattggaatatatcttgccttgcaaattcctaaagaattagatgcactcaaatgctccaaaataatcattcgggtggtacataggaataggaatgataaaataatagtggacacaataatagaacaccacgggataagaccttaattgtatttccacataaaattttaagcatcaaccctttgttctaaaggacttgataggaattttgccataagtattcaaatcctctaaaattcattcactttacttttttttccaaaagagcctaaaggttttgattcctaagaaaaatttcaccatgtaaccgtttagatcaaaggaaattaaaacaaatgaaagtttccctcaagttaaaaaaaaagaaataaaaagtttcctgttgtaaagaatcctgcatcctgatctgcaacatgtctatatttcttcttttttttttcagttctccgggtaaattgctcatgctatgcttagcacaaatcctatttctttcccaaacacaaaacattcctttttttgtccattcttctagaggcgctccgatcaaatcatccggattattttggggttgtttggttcggtctcaaactttgccaaaaattgacacacctcatgttagacacatttgaccaagttaactcatcgtttggtttatggtcacacttatggtaatattctctttcatttctcatggtcccacgtgtcatcaactaaaaaatgtgtgccacactctttttttctagctaaagtgtggcttacattttgttggccataactaagataaagtgtggcacacaagtatggtaaatgattgttgtatagcatgcaaacagcccctttattttgcaatatagtttgtttattttttttggtttgttaatattagctctttttctagagacatgtggggaccgatgtatatattgacatttgacacgtttctctagaggtgcatgatgtgttgtttgttcggttttttttttggaagccattggtttcatcggagaaacatgggtggaaggcgtgcgggtggtgcgaggagggcatagaaggaggatgatttcggttttacaatagtaggaatatagatagttcgatttttctggggcggttaatattggtatttttaagacgtgttgggatgcataccgtcattttaatgaaacgcagtatatattgatctatttttctcaggatgcaagatgtgctgtatgttttgcttttttggaagtcgctggctttttgggagaaacttgggggtgataggcgtgccgagtggtgggaggaggaattgcaagacaacaacttctttttatgttactaaagatattttccagttgtactcctttttttctactaagattttagtcttatattttgttttagtgtaccgcgatatatatttacactttttactgtgcatgatgtgtcgcgtgtttttttttaaagccgccgctttttcctaagaaacttgggtgttaggtgtggggcggtaggaggaggaatcgcaagatgataggtccgcttttatagtagcagacttgttttctagtcatactcctatattttttctcttttctactaattttttattcctatatgttgtttttcagcattcccagggtcctactgtacataaaacccctgcagcacaaggaagcctaggagagagagcagagagtagaggatgacattcccctcacaacatgagggaatgccaacatgagggaatgccatctcgaacccctgaagttgtagctggtcgagctagtagaggatgtcatcatgtcaatgtcctccctatgtcgggcaagatcatgctgccattgacagcagcgtccagtggcagtgtggcactaccatgcgatgcgccggtctttactgagaagttaggctgcctctcgtatagaaaaatgtcgtaagttttcaagcacatcgccattactgcaagtccagtaaaatgtaaaaaaaaagtctttagtacaattcaagggaatttcaaaggaattgcagggaactttggaatgtaggattttgaaaacatagaagcctgaaaagaatataattagaatatcttgccaagcaaattcctaaagaattagacacactcaaatgttccaaaataatagtttggatggtacataggaataggaaagataaaataatagtggacacaagaatagaacaccacgagaggaaaccttaattggatttccacataaacttttaagcatcaaccctttgttatgaatgacttgataggaattttactgtaagtattcaaatcctgtaaaaattcattcacttttcttttttttccccagaagtgcctagtggttatgattactaagaaaagcttcactatgtaaccgttttgatcaaaggaaattaaaacaaatgaaagtttccctcaagtcaaaaacgatattgaaagtttccctttccaaccatggcaaacgatcgttccctactttaaggattcatgcatcctgaacagcaagatgtctatatttcgtgttcttttcagttctcctggtaaattgctcatgctatgctcatatcaaattctattatttgccaaacacaaatcatccattttttggccagtttttctagaggagtactgatcaaatcgtctatattactttgccaaaagattgccacacctcatattaggcaagtttgaccaagttaactcattgtttggttcatggccacacttgtggtattccctttcatttctcatggtctcacacgtcattaactcaaaaatgtgtggcacactctttatttgctagctaaagtgtggcttacattttattggccataacttagctaaagtgtggcacaaaagtatgacaaatgattgttgtatagcatgcaaacaacccctttatttcgcaatatagattgcttaattttttgggtctgttaatgttggctcttcttctagagacgcatggggaccaatgtatatattgacacatttttctagaggtgcatgatgtgttgtgtgttcgattttttctagaagccattggtttctctggagaaatgtgggtggaaggcatgcgggtggtggaggatggcatagaaggaggatgattttacttttacagtagtagatatatagatatctcgatttttctaatattgatattttgtaagatgtgttgggatgcatacaatcattttaatgaaccatagtatatgttgacctgttttttccaagacgcaagatgtgttttttttttgagaaacttggggtgataggggtgtgccgcagtggggagaaggaattgctagatcttaaagatattttccagctgtactccaatatttttctgctaatatttttattcctatattttgtttcaatggaccatggtatatatttacacgtttttttttaaaaaaggtgcatgatgtgttgcgtgtttgggatttttttggaagccgtcattttttccggagaaacttgggtggtttcgcgatctttgtttccttgtgccgcgcgcgcggcgtgcccaggtggtccgcgttctttgaacctgatcaaggaggagttcgtgatgggcgaccacgcgcggctcatgtccttcttgtggttcgccatggagcttgccatgtcatcgccgcttttcgcgaagctctccgcgctcttctcctccgatgccgcgtgcctcgagggcctggagcgcgtccgtgggcgtggccacgagcggctccgtgtcgtggcgtataggctcggcggcttgcggtacagctgggcgccacggttccgcctcgccgtgctgctcctcctacgggacaagtttcccgagctggttggcgccatcgaggtggttgatcccaccgtggccccagtggagcgccgggccatggaggagctgggctgcattgtcaccacatctcctgcgctatgcctggtggtagaagaaccaactctgatctttatgccatacgcggaccgtgtcttctttgagaatttgctcatcttgaactggagcccggacaagctcgggaagatcgtcgtgctcgggcacagtttcagcaccatggtgaagatgcttgagctcagcatttcaaagcaagagaagtgtggtgtcaatgagcagagggagaaggtgaagagggtactggcaattccgagctatgttcaggaattagagctttgtgcagagatatctggcttattcgataaccctctcttgggagatgagtatccttatgaattgaaccagtacgactacaataattcaccagagcagtgtacatgcatgcactgcgttgcgcgtatggaaagcggtgctttgatttgtgctcttcccagcaccttttcaattcatttctttcacctcgatgctgaaatcgatatggaatatttgataccaggttcttttgcagctcatttccttttttttcaaagcttaagagtgtgtgtgtgtgtgtgggtgggtgggtctgcgcgcgcgcgccaatatggattgtggcattatggtcttctgacttgttgcctctttcttcgatgcaggtaattgcgctacaagggtcgggagcaatgtcaatgtccaaatgggctatgatgctcagttagaagggtaaggctacatactgccaaacgaatcatttggattagttttccatgcttatttgtttgcctagttctatgaattttaagctaaatgaaagtataatttggtttcaaaaataaaagaaaggatgatgcaaacaagatatgtttgctaaaagaaagggtttcttgtgtaaaaggggttctctgtttgagtgagatttgctttgtactattgctgcagtgcaggttattgttttgcttcggcgattaactcaaatttgtcctgaacagagaaataaaaacaacatatttttgtaaaacatgtttgttgttttactgcagtcattaactttaacaattggtttgttgcgatatgtcacatgtgaagcacatgccttaatttttgtggtatatttttgttgttcactattgatgacttcaaaactaactagctgggtggcccgcgcaattgcgcggctagcacccaaacaaaatcatatattttttatgatattacttaaaatttataaaatagatatctcattgtcttaagactttgaaagactaaaccttatcatcctcgtgtttctaattatatagttttttaaagtcacaccagttgctaccccttatgtcatcttcttctttatttgcttgctcgatctaccactatttctattcattcttcttggaacctttaaaaattggattttatagtttttagagtttattgtcacgttgtgtttcatttttataatttctagatgtcccgtcaaacgttgccattatactcctctacggcccgtccactgtctcttttctttattgtcattgagattttaaaaatcgaacataattatcttttgggttcatttttactttctagaagtcccgccaaaccgtcagcggctttgtcattgtactcctcggcggctcacccactggctcccttctttattgtcattgagattttaaaatcgaacatgattatcattgttttttttactttctagaagttccgaacctttaaaaattagacttgtagtttcattttttataatttttagaagtcccatcaaacgatgccactatgcccctctatagcccgtccgccgccgactctttattgtcattgtgattctaaaaatcgaacataactattgttggaattcatttttttattttctagaagtcccgtcaaccgttggcggctctgcaactatactgttatacaccccgcctactgcttttattgtcattgagattttaaaaatcgaatatgattatcaatgaggtttgtttttttttactttatagaagtcccggcaaccgccttactcatttgcttcacagcctgcctgacgtccctccctttaatcgtcatttaggattctatttggtgttttattaacaatttttgtatggcgtattaataccgttttgtgttcttttaatgcttttattttttattttcaatttcagttgttttaaaattgtattcctactttaactctctttttatttttctattttagatattattttattttttattctaaattttaattaatctcgtattgggttcttatatggatttttctttcaatattgtttatttttaattccaaatttcagctaattttaaattgtattcctacttgaactcttcttttattttcttttgctaatttcggatttatttatttttttctgatgtttaattaatctcgtattgggttcttatatggactcttcttttaatattccttatttttaattccgaatttcagctattcttaaattgtattcctacttggactctcatttccttttctaattttggattttattttatttttatttcgaattttgattaatctcgtattgggtccttatatggaaatttctttcaatattgcttatttttaattccgaatttcagctatttttaaattgtatttctacctggactctctttttcttttctaattttgaattttattttatttttatttttatttttgattaatatcgtattgggttcttatatggaaacttctttcaatattgcttatttttaattccgaatttcagcattttttaaattgtactcctacttggactcttcttttcttttttttctttttctccgattaatgtgggaatttctagcccccacagcgaacgtggtgccttcttttcgagctgtcttaataatataatagattcctttccaaatgaatcaattcaccatgtggcatttaaatcctagtgatgcatacattgaggacagacacttatatgaagctgaaagcatagttaaagaaatgcgtgaaactatttctgatgttaggaattctacgctatcacaaagtttgttgatcacatgaagaaagatcagagcatttgttctcacatctcaagcatgttgggagctcatgaatgcattcaattggttgtttatggcattgggagctttgaatttgatgtgaagtcccaatatcagattgcttttgctctactactaaaggaagacaatatattcccaattagtgatatcgaaatctatgatccatcactacctcctgctgatgtgaaagcatgcttcgacttggatctacgggtgctcttggttaatgaacaatgccaaagaagtgttgacaagccgataattttctttgttccaggactggcatttgttggaaacctcattgagtcaaatttctctcctgagcaattaaacaatattattctaatttcctatggggtcaagaatatcggggatagaatttctgccgaacttgaaaattggaacaatggatttaccagtttgaagggttccccagaattggaaagagagaggtttatttgggcaagcataaattatattaatgaagtcattgtgatggaaaattttaatgcccacttctggggagtctctgatatgagatttgagttccttgatgttgctgctgatgtggacatgaactcaaatttgccaagtatgtgtttttgcttccgaacatcttcgatttataccaatttacctcatttttttttgttttcattacttttgtttgatggtggagctgactttgcaaggccgactcttaaggaaaagtttttacttaacttcaaattggagctggaatataattctttctttgcttttgagtacgccttcttgagacttatgggcaatatcttgttacttagtagcattcattgtctagtgttgttacatgctgaatcatgtactgttattgtctctgtattttcagccatgtgtcttattttcgtatgtgcttggaagaaagaatgtcgcgtccatttcaagacgatcaagacgattgcaaggatggtaaacctcaagactgggcacatgaattcctgcaccgaatcccagcaatgcatcggaagacttggtctcctcctcccaaaggttggatcaagttcaatttccacggcattggtggttccaaagatcgttctgctggcatgggtggtgtatttcacaatgaggatggtgtgctctccttctttattggttcattaggtaacgtggatcaaaccgtggctagtattggagcaattgaacttgggctaaaggtcatgcttgagtaccatgaaccagttaaaaagctgatcgttgagggggacgatctcacggtgatacgttggttcaacagagtctctcacccgcctgcaagagcgcatgattcattcctacgtagttacttgcacttgacttcgatgccattgccatgtgagggggctgccgtgcctgctgagatatccaaagaccctgaccatgagaatggtagttcttcacatgatgcatcacctactaagccaccgaatgacggtaacatcgagaatggtaaagatagagaatcatagttctttacaatattctttatctgctattaagctatctgaagtctgtaacagtaggaatggttctttgcagatgcttcacctgctaagcaatttgaaagggagtacatagcttggcgggtcgatgaagaggctaatcaggtcgcaattggattggcacgtctaggcagtatgctacctgaccatcagaatcgggtaaaggtacacagctcaacccagtgtgactgtgaaatccaaagagaaatgaggaatggcaggctaccagacatcacagttggtgagaacctctccattttgccgatccattatgtagccacaagtccacaagtgctatttttgtgcattattaacgatcaccatatgctacaggtttgcctgttgaggagccaagctaataaggagtggagggccttgtcgtgtggaaccagcactctgatgctaaaacagttttgcctgtgtctggcattccaaatattctcaaatctgaatgtatgtttgaatggtccgatgaaaaatttaaattatgtgttctttggggaaatttttatgtgccttttgatagttcatttgcagattcaattgtagtttttggtatatcttttttttttaaaaaaaatctttctaccaggccagctgaagaattggctgaccaaattgtattaagagttgaagaatttacagtatgggaacattacaatatcgaaatgaaaatgtgaagacccagcgttcaggcgaaaaacctgaactccggaggagaaaatcagcccgtacggttatctcaaaacaactcggcctccttccaaacaacaatctcaaaatagcttcgaaaagttgcactaccgttcgtgatcattgatcgaaaatcgagcattgtgttcctttcacaccaaccagcctttatacaaagataatttgttctacgtatgcctctagctcgtccgaaaacacagtcttgtgctcagtcaccaacctgctagcttttaggctccagttcgctctcgcctggcagcagaaagcacacaattgtccatccttcgagcatcctccacactcgattggacggacacgctacaaacaggtgatggcactcttcctgcattgctcggcattcctgaaattagtgcgaaaaatgtaaacatatatagcggtcggaaacacatcgtttataaaaaatgattatcggtcgatctggaatttccatattttattagtttaactatttagtggcaaatgcagtatggtgctagaagaaattaaaaatagctaaatataatatgtggttaaaagtgaaaatgattagaaactatactatttttacataaacgatactcggtgagtcaagaatttcgctagcgtttttatccccaagtaggcgaaatgctgcagctgaagttgtaccatgtgccaacagtcagcatcatattatatccaagttaatgagggggtgtttgggaactagggtccctcttacaaaagtataagtccctatgatagggacttatgtttttgtgagagggactaaagtttagccccactttagtccctccaaccaaacaccacctgaatatctccaaaaataaaactcccataagaaaatcattactctcgctccaaccaaaaatatttaaatatttggtgcttggaacaaagttcgatccaacttttaaaattttgattatcaattttttttatagatatttagtttaaaaacaaaataaataatatacttggatttgcctaaaaaaatactaccataataccataaacttaatattaaaatgtactttttacggtaaagagatagctttattgataactgaacgaagggattagattcctgattcaaccaattcaaaatccgtgcaagcacacataatctcccctcctagcaagatcttgaattcgtcgtcgtttgattaagagtatgtactaccctcttagcttcttttcctattttgtgcacttgcactctttgaaagcattgcatcgcacctttcgtttcatggaccgtcgttgccccagccgatctcgagggattcttgttctcgagggattcttgttcgattaggacgcaacaacttcagcattgtcagttttcaagattagcggcgtatcatatgaatccatcccattgccacccgaagtcaaaatttacaaacacattctaatataaaattgatttttggaactataaaagcatgagcaaatctttatctaaacatcaaatatttaaaagggagcactacatttaagtatttaacggcaccctatctgtaacttggtgatggactaataagcacaaccataataataagggtatcaatcagatcataattttctttttcgttttatcttcaactaccgctcatctcatttaatgataaacaccaaagttatttccccccaactttattctctgctacacaaataaaaatgagatgagcgtggatcaaaggcagtactcgcttgccataatcgcgtgattcgagacatgctttcagcgttcagcctccaagcaaatcaaatctgtgtgattcatacacaaatcctttttcccttttcctttttgccgcaaggaagcaacaaaatatctctgacacactctgaaactgtgacagacttgacagtcaatggaactgaaaacgcaacccccgtgccaagaccattttcttcccacagtccactgcgcgagacgggagagacggccgcgacacaaaggaagcccaggagagacgcagacgcccgcccacaaagcccactttgcccatggcaacttccgcttcactgcctcctcctcctcctcctcgcagtagtagtaaccgcctcatcgcctcctcctcctcttcgctgcatactgcatactactgatcagctcttccgttctcgcggctccagatctctgcagggtgacgggggagatggcggagacggaagaacctggccaagatcgacgagtactccctcctgctccacatggtgagggttttaccttctcctctccaacttttttgatttgctgcggcttctttctcttcacgcggcggtcccgtggccaggcctgatcatggaggagttcgtgatgggcgaccacgcgcggctcttgtccttcctgcggctcgccacggagctcgccgtgacgtcgccgctcttcgcgaagctctccgcgtgcctctcctccgacgccgcgtgcctcgacggcctggcgcgcgtccgcggccgcggccgcggacgcgagcggctccgcgtcgtggcgtacaggctcggcggcatgcggtacagctgggcgccgcggttccgcctcgccttgctgctcctcctgcgggacaagttccccgagctggtcggcgccgtcgaggtggtggatcccaccgtggccccggtggagcgccgggccatggaggagctgggctgcgttgtcaccgcgtcgcctgcgctctgccttgtggtcgaacagccaactctgatcttcatgccctacgcggatcgcgtcttctttgagaatttgctcaccttgaactggaccccagatcagctcggcaagatcgtcgttctcgggcacagtttcagtgccatggtgaagatgcttgagctcagcatttcgaagcaagagaagtgtggtgtcactgagcagagggagaaggtgaggagggtactggcaattcagagctatgttcaggaattagagctttgtgctgagatatctggtttgttcgataaccctctcttgggagatgagtatcctgatgaattgaaccggtctgtctacaatcattcatcagagaagtgtatatgcatgcactgcattgcgcatattgagagggctgccatgatttatgctcttcccagcatcttttcagttcatttctttcagtttgatcctgaagttgatattgaacacttgataccaggttcttttgcagcccatttccctttttgtaaaagcttaacgtggtgcctacatggactatgttgtctgatgacttgttgctgctttgtttgatgcagataattgtgctacaaaggtctggagttatgtcaatgtccaaatgaattgtgatgctcagttagaagggtaagactgcatactgacaaaacaattaatttggaccagtttcccatgattatttgcttgctgaattctgtgaattttaagtaaacaaaatgatgctttggtttaaagaaatatttaatgaaggataactcaagcaaagatgattacaccattttaggcagctttcttgcgtgtaccctaaaaaaagggtttcttatgtaaaatgggctattttaccgtttaagtgagatttgcattaattatagtattgctacaatgcatgttcttcttttacttcagtgattatagtattggcagattgctgcagcctgcagcacctgtttgttgttttatcaatcatcgactatgtttctaggccatctgttttatgatttttcacgtgcgctaataattttgtgggatgtattttgtcgttcgctattgttgacttcacaaattaattccttttctaaatgaattaatcgaccaggtggcatttaaatcctagtgatgcatacattgaggacaagcacttacaggaagctaaaagcatagttaaagaaatgcatgaaactatttctgatgttaggagttctgcactgtacacaaagtttattgatcatgtgaagaaagatgagagcgtttcttctcacatttcaagcatgttgggagctcatgaatgcatccaattggttatttatggccttgggagctttgaatttgatgtgaagtctcaatatcagcttgccttcgctcttcttctaaaggcagataatatattcccaattggtgacattgaaatatatgatccagcactctctcctgctgatgtcaaagcatgcttcgacttgggtctatgagtgcttttggtgaatgagcaatgccaaagaagtgttaacaagcctacacttttctttgttccaggattgaaattcgttggaaatctcattgagtcaaatttcactgctaagcaattaaataagatcattctagtttcctatgggttcaagaatagtgggaaaagtatttctgctgcacttgaaaacaggagctgtggatttactggtatcaagggttccttagctttggaaagagacaggtttctttgggcaagtattaattatattgatgaagtaattgttttggaaaactttgatgaggaattctggggagtctctgaactgagggttgagtttcttgatgttgccgctgatgtggacatgaactcaaatgtgccaagtatgtgtgtttttcttctgaactcattttttttttcggtactcttgtttgatggtggagctaactttgcagggttgtctcttaaggaaaagtttttccttaactttgaattggaactggaatataattccttctttgcttttgagtaagacctcttgagacttaagggcaatatcttgctacttaacattcttcatttgattagtgtttgtacatgctgaatcaaaatttaggtcaataagactaattatgtaatgttcttgtgtttgtgttttcagtcgtgtcttatttccatatgcacctgaaagaaagaatgttgcgtccatttaaacaagatcaaggcgactgcaaggatgatgaacctcaattctggggacaggagttccagcaccgaatcccagcaatccatcggaatacttggtcccctccacccaagggttggatcaagctcaacttccatggcactggctgctccaaaaatcgttctgctggcatgggtggtgtattccacaatgatgaaggtgcactctcctacttcatcggttccttaggtaacgtggatcagactgtggctagtattcaagcacttgaacatgggctagaaatcatgcttgagcatcatgaaccagttaaaaagctgatcgttgagggggacgatctcacggtgatacgttggtgcaacaaaatctcttgcccacctgcaagagctcatgattcattcttacatagctactggtacatggatttgatgccgtgtgagggggctggtgtgcttgctgggtcatccaaagagactaacaatgagagtgatagttcttcacaagacgcatcacctgttaagccactcaatgactgtagcagtgagaatgataaagatgagtatgacggttctttgcaggatgcatcacctagtgaaccaccgaatgacagtaactgcgagagtggtaaatatgagaacagtgactctctacaagatgcttcacccgctgagctatctgaagtctgttacaatggaaatggttctttacaggatgcttcgcctgctgagctatctgaagtcagtaacaatggaaatggttctttacaagatgcttcgtcttctgagctatctgaagtctgtaacaatggaaatggtcaggatgaggacggatgttcttcatcttctgagtttgtgatccctcctggatgggctcaaagggagtacatagcttggcgggtcgaagaggaggcaaatcagaccgcaattggtttggcgcgtctaggcactgcgctacctgaccatgggataatggtacacctctcaaccaagtgtgactgtgaacatggaagagaaatgaagaaaggcagaccagacatcacatggtgagaagctcttcatatagttgattcattctgtagccacaattgcttttcttttctgcagtattaacgatcaccatatgttacaggtttgatcattagagagggccgttgtttgaggagcaaagcttgggctaacagagagtggagagcctttctcatgtggaacctgtcgctgatgctgttagaatttcaatggttactctcattgagaagaggatggcactcgagatggggcaattttctggttttcttcatttactaaacacaaaagccatgtcctcccaaagaggattggatacatatttatagctgcttgtagcagccatgcagccatgcaagtctaagagggtgctgtcctagagcatcccaacaaactgtcctagagcagagcatcccaacaaactgtcctagagcagagcaacccaacaaactgtcctagagcatctcaacaaactgctgtcctaactgtcctagagcatccaaactgaaagtagagatgctgtcctagaaagttgaaaagcaggaaaaggcaccacaagaccaagaccaaccagccaagacttattcctacattctccccctaagtcttgtgcgccgtcttgtgggaaagttgagccatcccgatccgggagcaaagctcaaggaacttgatcctcccaaggggtttggtgagcaaatccgcaagctggtccttggtgttgatgtagctcgccttgatgctcccttcctccaggtagcttcggatgaaatggtacctcacccggatgtgcttgctccgttcgtgaaaaacggggttctttgccagggccagagcggacttgctatccaccctgagctccaccgctccagtatctctgccaaggagatcactaagcagtcgagcaagccagagcgcctgggtcgaagcggcggatgccgccatgtactcggcctcgcagcgggacagggccaccacctgctgcttgattgactgccagctaacgaggcactcgccgaggaagaagagaatcccgctcgtgctcttgctggtgtcaatgtcgccggcgtggtcgctgtcgctgtacccgacgaagtgtgccttgtcaggacacctcgggtagtagagaccgtggtcgagagtccccgcaacgtagcggatgatcctcttcacagcctgctggtgctccgtcgtcggtcgctgcatgaaccgactgacgtagctgacggagaaggccaagtccggccgtgtgtgggtgaggtagcgaaggctccccacaagacgccggtactgtgtagcatccacttcctccgccgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccgggaatcacaaatcccggcggctggtgcacgtagacctcctccttcaagtcgccgtttaggaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaaccccaccgggctgcgctcaacacgagctggcgtcggagtagacgtgcccggaggagtggctgttgatgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctcccttgaagtggacgtactcgatggtgaagtcgtcgtacgtcggagtcgaaccatcatccaccgccttgtcccatacccaccctcgcccttcgtcgaacacaacatcgcgcgcaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcggcgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgcagcagcctgcgcatgcctgatggcgtccgcagcctctcccttgatgccgaggaccatcacccacatgtagcgggagaggtcgtcgacgagcagcaggaagtaacgtcgtcctcctggtgtggccggtgtcactgggccacacaagtccccgtgcacgagctgagccgctccttggctcggaagctcgtctgctggggaaaggggagccgccgctgcttcgtcaccacgcagacgtcgcagagctgctccatgtggtcgaggcacggcatgcctcgcaccatctccttggcactgagctgcctcagggcctcgaagtggaggtgcccgaagcgctcgtgccactgccacgcctcgtcgtcccgacgagcggcgaggcaaactggttgtgcgacctgcgcgctgaggatgtagagtcgattagtgcctctggttaccttggcaagaaggcgacggcggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggagcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggttcatcaaggtggaggaaagccgctgcggccggtgccgctggaggtagctcgatgcttgcgtgagctaggagcagagccggctcttcctcctccacccatgcgacgtgggcctggccgcgtcgtggctgtcgacagtctttggcctaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtaagatggagcttcccgccgatggtgatgggccccgagagaggctgtggctcatcaccatcaacgaccttgaggcgacctaacgcctcctcgatcgacatcgtggagaggtccagcagagattcgatcgagcgagcgatctgtctgtacttctcagggacgcagcggaagaacttctcgacagctctctcctcgtcgtaggtgtcgtcgccgtactgcaccatcttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcgggactgcagcgatgagggcatccagtgcccgccgatcctcgtcgtagtcgacgtcgccgtatcggactgcctcccacatgtgccgcacctggagcctcaccctcatcaccgcggcccactcgatgtagttggttttggtgagggtaggccacccaccgccgggaccaaagtccctgaccaccgtctggacgccgtggtgaccatggcgccggtcaggggagagagagccgtgccgcctgcgagggccgcgtgcgggctccgggctgccgccggcacgcccgcgcccgtctgggttcccgtcggcgggcgcgcggtcccttgggccgccgccgccgccgccgtggaggtgggctgctgcccaccgctctgctcgctcccgtgcccttcctcttgccagctcctcaagctccctgtcggcggtgatgtcaccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagtggtctgagccgttgctcgcctgcgctcttctgctgcggcgagctcggcgtcctgctgacgccgagtgctcaaggcgaccgaacgccgagaccgagcgtcggacatggcgcacctccggggggctgctgtgtggagagggggaagggaaaggggaaggaggagcaaccggtgctgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggagcaattttctggttttcttcatttactaaacacaaaagccatgtcctcccaaagaggattggatacatatttatagctgcttgtagcagccatgcagccatgcaagtctaagagggtgctgtcgtagagcatccaaactgaaagtagagatgctgtcctagaaaattgaaaagcaggaaaaggcaccacaagaccaagaccaaccagccaagacttattcctacagatgcaagaagtggtggcgcaatccttttgtaatattttgcagattatagtatgtctatgttagcatgttacctgccatggattcataacgatgagaaagaaccaatgatgctaatacaacagatccaggattgacatctgtttttttttagtcacctgtgcgtgagtatctccttgtgtatttgcagcttgtgtgacttgttaatataaacatgctacaacatcttggtttttttatttcagatgaacagtgggtttaaactttttactcctttgctagtagaaagtggctttgattctgcgcggactagctgcagcctgcaggttataaccctgacgtcacgctatgttgagctcccaatgggcctaacataacggcatagtgggccgttaacgggcctcgtacctgtacggccgaaacggatcggagtagcaaaccaaaggaaaaagtacacccagggtctctcaacttgtcattgggttacaaaatcatccttgagctgcaaaacccgatatacgatatacgacgtcctttaacttacaaaaccgttcactttagtgcatagacggttttgatcccgggctgagtcaacgtggaacccacgcgggccccatatgtcagtataccacgtcatcgccctctctccttcccctcctctccatttctctctcttctctgtcttctcgcaggccggccggcaggtacggaggaagccggtggggcgaagcgggagaggaagagagcgacggcggccggcgacgacgcgggagagtccacagccgccgtacagcgagggggcggggcggcgggagaaggcgaggtgggggcgaccgcgacgcagagaacgaggcgagctcggaggtgcggaaggaacgccagtagacggctcgggcaccggcgatgctcgcgaccagttgaatgggatggtgccgcagccagctgtgggcgccgcggtcgacggcggtgcgcactgctctccgtcagggtcgacggcgcagcgcggcattgggggcgccgtggccaacggcggtagcgcgcggctctccgtcggggccgatggcgcggagcggcatgggggccgccctcaggaatgacgccgccccggatccagcagtcggcggcggcaaatgtggcgagggacagcagcaagaagatggatgagatggggaagaaaagatggatgagatgggaaagagaaagagggacgacgccgccctggatccagccttctccgctcgccgccgcctcgctggcttcgcgcgccgccgctccgcctcatcgtcgccccacttcgcccgccgccgccgccgccgccccgctccatcccaccagctccgtgcgccggcgctccgctgctcggcttctcccatgggaagatgaagagggacggcgccgccctggatccagccttcttcgcccgccgccacctcgccggctgcgtgcgccgccgctccgcctcgccgtcgccccgctccatctcgccagctcagtgcgttgccgctccacttgctcagctgctcccatgggagagagccgatagacacacagaagagaaggaagggggaagaagaggctaacacgtggggcccacgtgggtcccaagctatgtcaggtgccaagtcagataaaaccagagtgaaaaccaccggggatgtgttgtatctggttttgtgtggttcaaggacgattttgtaactggatgccaagttgagggaccttcggtgtactttttccgaaaccaaaaccaaacctccaaattttctcaaaaaaaaaaaaagaaaaggaaaaagacaaacaacctccggggcttctgctctcgcccctcgccatgccaaacacggcggccctcgctggcgtgcgcggaacacgaacctgaggccctgagctctagcgcggcgccacgcgcgtctgcgtggtgtttcgcactcccatctccgaaatccgcagctgcgcacggccttgcgcgcggttgcaggccaccgcccgccgctaccaccctgcttgaccagatgcaagctccatcttcccagtgttcaaatccgtaagcactgctcaccaaatctcagtatcaagtctcaagcattcgttaaaatcagtgtgcattcgtagacccagaagtctgggattaccagtctgtgctggtcaggggacgcgaaacagctgttcgacggaatgcctcaaccagcaggatgttttcttatctgggaatcacaagctaaggtagtgccatttttctgtaaattaatcatttacgctgttttgctattcataggttttacatgcaacatttagaaaattttacttggactacgaagcaattccctgccccttgctgagttgctgtggcgcggatacttcaggtgtgtcgtggggaatatagccatgtagaatgtagtatgtcttcaggaaaattagtagctacccatcctgtgcattgccgttgaagacttgaagtgctgcgattgttgtgagtactctttggttagcttagagaatgtagagtcctctctctggagcagtttggtgggggtgtcgtattctaaaatactacctgcatagagatatcagatttaaagagtgacgtagctgtgcaacatgatattctgaggttgttttagtattgtagtggtatacctaccttcaccaagaacaagaataaggtcactatcaataacagtgttcatcctatgggcaattgcaagcactgtgcaatctttgaattcttgacgaattatctcttgaataatccggtctgtagcagagtcaactgaagcagttgcctcatcaaggactagtatcttgctcttcctcaggagaattctgcctaaacaaaatagttgtcgctgtcccatgctccagttgtccccattttcaattactgcgaatgaaatataaattcatagtagcataagtatttcagaaaaactacatattaacatgttcttttcctaaaggactcattgcagtttttttgtcttccttcaaaagtttaatgctgagcagtacctatttcatccagctttttctcagtcgagcgcaccacattgccaagctgacacttgtctactacctgacatgggtagttcattacttcagaatgaaaactactgttgatctaccctaaaattacttctagtttgtatgcttgcttttgaggtcttattcatttactggtggataggggtcgcaatctgtaccatcttcacttcatattgttgtcgtctattcacgcttacccattttttttgctttatatgatttgtgctatttatggaaccattgtctatacaaatagaaaagctttgtcatatattctagttaggatgtaacatgtaagttttctgcacttacctcccatatcctactatctgggtactcgttcatgggatcaagatttcctctgattgtaccatcgaacatcaccggatcctgtgggagaatacatattctcgatctcagatcatgaagtccaattttgcagatgtcgatgctgtcaatcttgatggtccttctcttggctcaacaatccgaaaaagtacttgtactaaggttgacttccccccacctgtgggtccaacaataccta

SEQ ID NO: 16499 - DNA, 1457 bp, Oryza sativa
cccgccgcgtccagccccctccagccgccgcgcgtcccgccgccgccgcgcgtccgtccgctcgctgtcgcccccctcgagctcgccgcgtccagccccctccagccgccatgcgtcccgccgctgccgtgcgtccgtccgctcgccgtcgtccccctcgagcccgccgcgtccagccccctccagccgccacgcgtcccgccgccaccgccgccgtccagcccgccgccgccgtcacgcgtccaggcgcccgccgccgtccccctcgagccagccgccacgccgctgctgtgctctcccgacgttttttctctctcatgaaacagtaaaggacataaataccctcccacccataataccacttcaatgaggaggtgcagtaccatgaggtacggatgatttctaaccgttggatgatgccagatcaatggtcaggatttggtactgcacaacctcaaggacagtaaaaaacctcttatttcttacattattatgccatcaatgctgtcataagagtgatattcatggaggtatcccaaatcaataacatgctctcagttagattttgtaaatttttattttatccgtgccttacgttgcactgttattgatcaaataaaaatagaacaatttatcacactcatgtaaccggatgatatgggctcctaattgctggtgatccttctctgcatagatgaaagacaaagcgtaagaatgttttcatgacatggccgtgttgaacccattgaatttttcttgcaggagttgatggagaaattaaagatgccgtcagatgctgacttaatgaagattgcaattgctgacttaaataattcttccatttcactggaggatcggcagcgtgcactgcaggaactattaattctcgttgagcccattgacaatgctaatggtaaacatgctctagtccatctgaatactatccactcagactcagtgctctgcacatcaagaaaaatatattcttataactttataagtacctcagattgaaaaatctaacttttggccttgtagatgtaggtgtcagtaatattatagtttttcttgtcatagcgattgttttagactaaggccgagtttagtttcaaactttttttttcaaacttccaacttttccatcatatcaaaactttcctacacacacaaacttccaacttttccatcacatcgttccaatttcaaccaaacttccaattttcgcgttaactaaacacaccctaatagtgatttaccgaggtactccaagcccaagcgtcacatatgtgtgactgaatgactgtgtatagttactagttttcaccaaaaaaaaaatccatgcttttttaatacaatgctcaaatccaatcttgaagttgcttgcttgtatttctgataagccagcagcattttcttttttttttaacaatgcaacttcgacttgcgaatatattttt

SEQ ID NO: 16500 - DNA, 1861 bp, Oryza sativa
  unsure (1)..(1861): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatgaaaaccgatgtaaattctatatcttaaataagaaaagtgacagtactatggccccgttcgaatccatttaaaagtgtggattaaattttggattatagtggtatgcttttcaaactgttaaacggtgcgtttcgtgcgaaaactttctatatgaaagttgttctaaaatatcagattaatctatttttcaagtttgtaataattaaaactcaattagtcacacgttattaccacttcgttttgcgtgaaacacttaatctttatcttcatcttcagaagattcaaacaccacctatctatgcctagttgcctactggtgtattaaattaaggtattatttgtgtcactgttgggtggggcccattcaggttcgtttatttgcccggctcaatggaagatgggcatgggaaaaccttttcaaccaaaatttggcgcacactaaaaattagatgctaagcaaatccatttctcgaaaaaaaaagttttgttttttgtatcaagaagttggcacatactcgctccgtaaaaaaacattacctaacccctcctagtataacgaatctccgtccaaaaaaactaacctagatttgttgtactagtagatgggtcacatgaccatttataggttagtttttttttgacagagggagtaggatattagttccttttcacgtatcaattttgaaaataagttttgtgatagtttatttttaaaatttataaaattaataagtttaaaaagttaaaaaaaatctgcgtgggagccgtacgagcatcgaggtggcagagtttagtacagacaatataaaatcaaaccctagcatttcaatgcaaaattagtggagagtgaaaacgactaaaatgtctctcattattgaaaaaaatagtaattgtgataggtagataaatgatattgaaggaataatacttctcattttacgtgttgagggtaggtagaatggtaaaagttaatttcctgtagaataaaatttaaactttagaagtcgattttttttatagagggagtacaatgtttggtcaaacgattggcccttgccgtgcagtaggagtccgatgccggttgtggtttctgaatttagaaactgtaataggttttggaaatagaaagattgagttctgatgggattagaagttgacttctagtactaaatctatgtcggagattttttatataaaaaatagacgaagagggttagatgaacaataaaagttattaatatttgcctagggtttaatatattcatagatgagagaggagtgatttgtaaacaaacacacaccccctccaacaccaacggcctgaatttcgccgtccccttggcggcgcctcctctccttgcgagttcgcccaccgcctgcctgcgccgatcgatctccataggcgccgtcttcctgcggcttccgcccgggtgagcatcctgtccagttacgcaaacccaccccacttttgtctcggatttttgcttgcgttaaccctagctttttttgattagacctgtggaagaagctcttattaatattaacaag

SEQ ID NO: 16501 - DNA, 501 bp, Oryza sativa
agtgtcctgaccagcccatctctccccgtcaaaaatttaaatacacggccattgtacttttcatctttgtgactgccagccaagttctattgtatgggatccaacaccaacctcgaaccattgagcctgatccattacattggctgcatctgattctggcgtcaagccgtagtactctcttgtcgcacgggatcgtcgctattctagtacctgaggttctggtgaagatctgggtgtacctaaagatcataactctcgataccagtgcacctgaaactggtgttcttatgtaagtgctgattctgctcacctccaattaatctaacggcaatattgcatatggagagatggaatggtgacagtcgatctgctatgctttgatcggtttcataaagaaatgaatattcttttgggtggtgaaattttgtaaacaacaaattgcaatttttgtttgctaattggggcctttatttatgaaattcaggaatagagcacaaaggt

SEQ ID NO: 16502 - DNA, 1647 bp, Oryza sativa
cacactgtacatagtaaaacattttcagttacagcacaagtgtcaagtgtgtgctgcagatagaagcctactactaccttgaggtagtagcagccaacgaggagacctccttgttggtggaggctggctcatcgtctccggcgccggcaactcgcgtcgcggcctcctcgtccgtcgcgccggcgacctgcgccgtctcctccgccaccttggagcccctgcttgcaagagttttctcagtgatgagtagcgatatcgtcacagctgattgctactccctccatcccaaaataaatcgatgtcttatgtgtaggtttgtggccagaaaataatttattttaggatgaatgaagtacgtatcttgaggaattttacttcctttggaaaagtatcttgagatacctaaattttatactacattttttatacttttagatatttagtacttattagagataccaaattttaactaaaaaatatcgtatctctaggtaccttcttaaggatggtaaaaaatttttgacgtaagttaaggatggtaaaattacacatgtatcttatgtgcatgttcagaaggaatggcagatgaagaatgaaggcttacttgtatgagtagatgacaaggccagctgccgtgccagcaaaagcaacgaaatacatccaatcaacctgcaaatgctcaaaatttgattaaacaagatcaatttgaattttaagatttagtattggcatgactgtatggggggaggaattgttgttcagagaccttctcatggtaagcgaagatacggattagaacagcccacatgtccgaggtcaaaagggagagattgagcatagttgcaccacatatctgaaattattggagtaaatttagtaacatgcaatattcagaaatgctgtgaattttcccacaatcatggcctgtaccttcaatataatcggtactgttgagtagaacaagaacattgctaccgcaaatccaatgaaaggtagaatctgaagaaaaaaaaagggtccatgaatacgaagcatggttaattgattatgtagtagaacatattcttcattcttattagattgtacacacaagaattaaaataatctagaactgaaacactaatttatcaattaaaatatttggaccatataaattgcctcgagtaccatgtatgaaagggaggagatcgacttaccgcaccagcattccattcggttgaccgaagttcttgtcgttcaagtatgcttctgtagcagtgttaaggaaatgggatatagaagcatattttcttgctatgccaaatataaatcaggtaatacaaagtacaaaatagttacagatgggttggtagaaacatgtcccagtttcactggttcattgttttggtctcgttgctattcaagtaatttcccttgttttaacttctagtaacatggagaggcattcttataatattcttagtttaatcaaactacagtggaaacaagtcatcacttaactaatccaaaggatacatttgtataccacttataactgctccaaaaacgcccagcattgccatcacctcaattctgctgcttttcttgacaaagtactcctgaaatgttgtaggcaaaacatgcaaggttcttcatgtgctacctaat

SEQ ID NO: 16503 - DNA, 31343 bp, Oryza sativa
  unsure (1)..(31343): unsure at all n locations
acagtagttcatcacaagaagtagtaccatttaatctgcagaaacaaaatgcagaaaacatttcaagctccatgctgataaaaatattcagattgctgcattgcaatataataccgtggtgacaacgaaacagcctcagaaacttttttttttagagaagggtattttttacccggcctctacaaccaatcggatatatgcagcctttttaaattaggaacttagcctatcaaacagcctcagcaacttgcgaagaacataatcagaataagcataaatatgtttggtaacaaagtgacttgtcattggtcctggcttggggataagatacgctaaatacgcaacgtacatgcatcaatcatacgaaaaaaagaggaacagcacaactcaaaataatggtcctagggaataataatctgaaggtcaggccagggcacaggacatgtgttgttaaacaccataatagcttattgacctttggtttcaccatttccagtctccagatatcaaaatcataaccgaattttgatctaaaaaatagccaaaattgcatccaaacatttcttttcagggcaaaacgcagcaggcagacataccgtcaggtgttgccttctgtagatcagtatcccaccataaacaagcgcaagaaggacgtaattcagcagagactgcgaagttggcgcgttgacgcctgaaaacaatgcgcaggattcaatctcataatcagaacttcgtaacccaccattcacaactctctatatctgaacatggcatggtttgtaacaacataataattttcaaagattatgaaattcgaaacatggtcattcatctaccaagaaaatgaaaaaaaaaagaaccaaaatgaccacgtataatacaagccaattgcacgaatacattctgaaccaaaagctcatcaaaactgaaactgcaactcatcaagaacccaactattttcagagttcagattgcatgaatacattctgaaccaaaagctcatcaaaactaaaactgcaactcatcaagaacccaactattttcagatttcagattgcatgaatacattctgaaccaaaagctcatcaaaactgaaactgcaactcatcaagaacccagctattttcagagttcagatttcagatagatcgataccatcataccaacatccagttgttagtttcaaacaaaagccctatcgagcgaatacgcgaacatcatgcggcggcggcggcaagccgtacctcggcgggcgagctcggaggaggagaagccggtggaggtgatgagcagcgagacgaactgccccagcgcgagccccacgaacacctcccgccgcagccacctcgccgccgccggcgccattgctccctctccctctcctcccctcggagacttctcctcgccgtggacagtggacaccaacgtcgccgtcgtcctctccactggactcacgccaagccaacaagctaatgactttccaaaacaaaaatgcttaactacttggcctatatatacggcgcttcgttgccgtcgttgcagtgtgggccccgccgccgctaagccggccggtgtaggctaattgctcattttaattactgttccttctatgacggcattaacttttttaattaccattcgtcttattaaaaaattatgtaataatatcatttattttattttaacttgatttatcatcaaatattctttaagcaatggtataaatatttttatatttaaaaaaaatttaaataacacaaatgatcaaacgttatagtaaaaaaaaaataacatcgtcgtacattttttttaaatggagggagtatctttttcgctgcccccttgcattgtgcagctgtgtaaactgtaaagcaagatatttttccatgcatttgatttgagccaaagacatactatatttattttttaatgtataacgttgttgattttttaatcaacatttgactatttatcttattcaaaatccttgtgcaaatataaaaatatttaaatcatgcttaaaaaatatttgataataaattaagtcacaataaaaataaataatagttactttcttttgaataaggcgaatgatcgaacgtatctcaaaaggtcaatgacgtcatacattaaaaaataaatgaagtatcaaatatgaaccgaatttgaagtgaattcaaactttttttcgcatttcagaaacaggctgatcatgtcatgccagcgctcaggtttaagctttgaacggggtggattgggttttggcagaagactctctagctctcaccatcaacctggattgggtttttttcttaattaaattgatatcaaattctcctttttatatcttacagtattttaaaactttcttatagcattgtcacaactcacaagatatagatttatatgctataatgggaagctattgctatctaaagtgagatcatggcatcatctacatgtttaattaggcccttaattaaggtgatattgttatgcacgtatgctcttgtgtaccgtgtgattatccaaggaggaaataatcttcagccacagaagatttttgagaaagaaaaattgtaagttagtatatctatttcaaggaaccaaatagttgactttgtgctagttgtgcattatttattacaacatttctatggacatttgcttgttcttgcaagtcaacaaattaaaaaggagcaaaaaagaaatggacattgcaatcagttcgttgtatcttggaataggactagtgcatgacggccactctcatgtgacatcacactcatgtatatatgtgttcagtcaacttgtgataatatcatttccgaaaagataagatgtgattataatttataacctctcttaagtctctagaacatagctgtaaacaagaacatccttttttctagtttgcactagttaaagtaattataaagtttgtccattcagagtttttaaatctctaggtcgtttattagaattttaaaacatttccccctatttttagggagaagagagaagtagtagatcccaattgcttagctcatttgaaaagaaaaaaaaacatgtagagaacaaatgacatctcaactagagtagttatttttacagtgaaattagtccatccaggttcgagtctccaactctacagttaattattttgtaatggtagtccttacccgtaaacaaaacgttgaagtgatttcgtcaatttcatgtattacctcggtaacaaaaaaaatataatagattacatgtatttatactttattttcttaaaaaaatccctgtaaaattacctaccgatttttatctattttatttacatgggcctaaattggacatggtccaacgcgtataacgtaaaggaataagttcatctgatgtctcttaacttgtcaatgaatccgattttcgtccatcaaccgaaaaccaaatgcaacgggtccctcatctatcaaaaccagtgcagatgaggtccctcagcggtttagatggcggttttagctgacgtggcgcttacgtggctaatttgactcggtcttcatctgacgtagcattgatgtgacgcttacgtggcaattcgatccgaaaaataataaatcttatgggacccacatgtcagtttgaatgaattaaaaaatgatgggtaacattctcacccctcctctctccccatctctcccctctcctctctctagcgccacggggtcacggggaggtctggcggcggcggccgacgacgcgggggaagggtggggcgtcagtggcgggagtgttgggggacgcgccgtagcctaccacggtgacgctgtggttgacgtcggcggacggcggtgcacggccccgtgtagacaccgctgccgtagagctagaacatgaagttgccggcgtcgacggtgacggacaccggctgcgccgccacagccctcgccaagtcgggctcgctgctggtgtcacgttctggtagcccgcgatgctgaccgcgctctggttcagtttcgccgcctggcacgcgccgttcgcggcgtggtacggctagctcgcctccgtggtgactagtgaggccgtggttgccgacgatgaactcgaacagctcatgtacccaccgccgcaccccacagcctcgtcgttgcagtctacgagctcctgctctgacagcgacaccagctcgccgttcttgttgatcccctctatcaccgccacggcggagaacgcccagcaagaacctgcatccacacaacacccagatttccatcgattaatctccaacatttttacaggtttgaatctttctttaccatgctattgctcacacaccacaatcttcttggtactccacttccaccactgctcctttcttcctccaatctacgctcttcggcagaatatcatcactgctctctccaggcattgctttgaggaattgcgacatgaggtctgaaccccagcatcttggctctgaactcctcgttcgtcaggtcggcgaacgtacttcttgtcagccagcttgtagccattgcacatggagttgaacttctcaaataactcaacgttgctcctgtacacctcgaacctcctctgcttctcttcggcagtcgtgcagctcccggcaccacgctcgcacgagctccagctcgtcggagacgggcggcgccgcggccccgatctcctccacgagcccacgcgcggggtccgcgccgacgccgtgagcgaagacctagcgctcccgccgccgacgccctgcccactacccttctcccgcgtcgccggctgccgccgccggacctccccgtggccccgtggcgcctggagggaggagaggggagagatggtgagagaggaggaagaagaggaggggtgacaatgatatgtggggccatgtgggccccaccattttttaattcattctttcggggaaactgacatgtgggtcccatgagttttattatttttcggatcgaattgtcacgtaagcgccacgtcaatgctacgtcagatgaagaccgagtcaaattagccacgtaagcgccacgtcaaccaaaaccgccatccaaaccgccgagggacctcatctgcactagttttgatagttgagggacccgttgtatctggtttttcggttgaaggacgaaaatagaattcgttgacaagttaagggaccttaaatgaacttattcctaacgtaaagtcctcttctttaatgcttatattaggcctggcccatattagcccattgagagcccagatgactcatgggctcgtggcccgtgcagcgcggtcgccgccgcaaggtttatctcctccgcgaggccgcgacctgacgccgccgccgccggcggccgccgcctcgtcgtcgatgagctcgccatggcgccctgccgaaccctatctacgccgccgcggtagcagggttcaggtttggcggcaggctacccccttctcactgtcgcacgacgacagacgactcctccctcctccccacctcgccgtcgtcgtcgtcgacgactttgctcttcctccgtctaaccaaatcccagattctgcagggccgcaggcgcggactaggcgaagaagggccgtcccccgttcatggcactgccgcgcgagcgtcccattccccactttctcgccggtcgcgatgagcagtaggccagagtctgaaatgtgttcgtctcagccggctcaatcgttcggcgggcgctgacggtatgctcttaccatgatcccctctcatttgttctagggatgcaagtgggtgatctcactacccgcataaaaattcactcgctagttcatttcttacatgatagtataaatttcggaaggaaaaatgaactagaagtgagataagcgggcaaaataatctcgcttgcccgccccacttgcatcactaatttgtttattgtggcctccgcgagactctgtggtgactgattgattggtgttgttattagtaatctagctgcattgtggctattatctgaaattaggggatctaacactgagcattacttttctcattgatatccccattgcattgcgtttatccatgtgtggatgcatccaattattgctatctgtaggaaactagaaatggttcttcatctctggggtttattcctttgattcaatgtatttggatatattagcctttcttccattcattatactttaaatcaggccctggcacctgtatctagaaatgttatgggtatatatggttttgtatgccatataaatgagtttcaacttggttttttgtgaccctttacaaaaaaagaatgagaaaaaaatgtccacaattagatgctgcgagtaaaaagaattcagatttgcatatatgtatgtgctaatttgtgttcatttcaaagtagagaacaccaactgttgcactattcctcataattactgatatgaacatcagcattaataggtgactatgaagatattggacttctaatttatttcatacaacacaagtcaattactagactacttgattgtcaactgctatatatatgctgttaactgcgttttgtgcattatgttttgtaatcttgaatgatgttgcatccagccttcaacttggtccctgaaacctattaacaaagaatagaaaaaaagaattagtaaatgatggcttttctcctaaaaacagcatgcctagtttgttattgttttggtgtctaggtcttggcttcttgcatatatgaataggggggataaacatgccatctttgtaatctaatgtattgtttgtttcttttgaaacaccggaagtgtatatagtgagtagaataattgttcagcattaaaaaggatgcgagaaggcttatttctgttgacaaaattgccatggtaattaaaactacatatgtgcacttatgtcatggaaagcttgctcattatcatgaacagggtaaagtaagcgcacccgtgtcctaaaaaggtactaagctaggaacttaagttgatattctactctgaattcactattctgggaagaaacgtgtattactaataaacctattttgtatcttccagatatatgcaatgagctttagcgatcctcagaatcttttctctagagcatctttggaaatcttatgcttgtgttagagtagatgccacgtctaagtctatgaattttcaatcaaaaatgtcatggttatgttttgagagggggtgtatgagtctatctggctcctgtgatttcatgactaccaatatatgaatatttattgttttagtctctctttaagtaaaatattaaatttgttcctaccttctgccaccaacaccactctccttctggcagttgaagtataatgcagcaacaggtggtccaagattgtaaaatgcagagaaatctctgacgttgaaattttgccgccatcctggagcataaactgtttgtcgtgcttcctgtttgaatagcacaaaaacaagccgatgaattccagccggtggccgtggagcttcgtacggaactatttcattgcctgaaacagtgtgtattctttattagatttgttttgttgtggttcatattatcaaggtgaatgttagctttcaccacatcactctacagactacatgttccttgatagtgtggtatagattgtcctatagttcagtcattcagtgacattactgcccacccttcagtcctgtgccacttgctgccaattaaagcaaataaacaataccctgtggtacatgttgtttcacgaaatatcattatggttagaagtattgcaaccaattgcacatcctgaatatctgtcatggcttccacatgaaaataaatattaaagttgaaatcccactagtgaaaatgcatatataaaaaaaagaggtgaaccatttttattatgtgaccattaagtgtgagtgtgtgactaataaaaaatagtaaatgcctgagttctagtatattatgtgacttacatttatttttttcaatattcataaaactagatttgatgtttaaataatcacttgcaatcttgataatttagcagaaaagagtgtgcctctctgatatccttgggatgagccagatgagaggatcaggcgtgcttcatgtatgcactaccgaaggtatgcttataagttataactccagcattgcagcttggctccaaagaagtctgtaatttgtaatgctactagtgttttttgtgggaaaacagtagtgctgtttttgaactattattattttcagttgctcacatgattattcctagttggcagcttctttagggagggacagagggcatgtgataactttacaccttggttttccttaaaactccagaaacgatagtattatgttttcacttggaaatgaaagatctcatgtttgaaaaatctgaagtatgtcacacagattaggtgtgtgtttctgtggggccccacacaacagaaccattggtcaaccataggcaggtaataccataatagccacatatactaatttcatcagtgggccccacagatgatctgaggtactcaacttgaggcgctgttgggcagataacaaccgtccaactgcttaacctgcatcaaaaataggtgcagtcatacattagagcggggcccatccccctctccctaagttgctttacatttgattcacaggtatgcatatttaagatgactgtatatagtttagtagtcaatagatcaatcgcagacttactttaaaattagggacctaatgtttttttcttaatttttgcaatgtcaccttaaatccaaaagaacaacaagtgtagggatatagaactagattttccaattaaagaaaaggaatctcggtatgtgatagtctgatagatgacctactaaatgcacctttaatgaaaatgccattgattttcagtgtatatgacatctaaaataattattgacttgatccttgtcttgttagcttagtacaggagataaattgattgtctcaagctccctatactttctttgcaaaatttgactgtgtaatcatggtcgatagtaacataaactatgaagaccaatgcattcttttgaatcattccttagcatttttatcatgtcttttacttttgcatatgtaacaccctcgtagatttctaccttgacaccccaaacaccagcctactatacaaataaaattcatcaagtttcatacagtaaacttgtttacttaaaatcttggaaatatatgcactaacataattttagcaaaacaattatttcatggaagtattaaggtatttggtattttggttggatcaaaccaacgatatttccaaacagttatattagttatagtagtatttccatagttactcctgtctctatcatcatttatttttccaacttgacatagattttactaaccacgtggttattccattgccaagggtacttgtgaaatgtttacaaccatatacaacaataaatatcatgatttctgtttgaaacaaatggcaaatattggaagtgattttgctgtttgtataataaaaatgtttgctgatctgtacatgcaattactcaacattggaggttatgtaggagtaagatgttacccaccaaaacgtgcatctattgcctctgggatgtctgtcaccaacctgtagaaaaataacaagaagaaagaaacaagaccctagctttagctctttgattaggctcagaagtaagaactgcttgtaaaggacacaaataataagatactatgataagttatatgttaattaaagaaacttcatgtatggtcaaattggaaatctttactcttatgaaaaacgcaaatctatgtaaggagatatgagttgcagaaacatggattagattagataatcaatatataatattttagatatattatggtaccacattgttagtagtacacagcaagcaagaatttgcccgatcaactgaaaaaaaaaattcagtgttgcaaatgaccatcatgttacatcagatcatcctttgaaagtttaattaagattagttactcataagtttgtttggtggtaaagggcacagttcttctatattaatatgccatagcaaggctcttaatacatcttctagattagttagcttctaattatattcaaaatcataaacttcccagttacaaattttgatattagctccagcacttgtttataaacataataagaatgatattacaattcttatttataatgatattagtattcaaaatccatgatactagtattcccagttacaaattatacaaaatccattagtcttgtttataaacataataagaaaaacataaatttcaatttaacacgcattaatgttatttacttattttagccatatgtgacattacctgtaagcattagctccagcacatgtttcttttttaaggtatctttaaattctagccattttttccctgtaaccgtataattgcatgcatgcatgctatctacatgaagtccttcatgctgatatcataaataatgccgtcaattaatgttttttcatagtttatcatcttatgttgatatgttaattgattgtagcacccaataatgatgtccttagagttactcaggatcatgactggtttctccttactttatctatgaagaaattaataggcaaacttccagagtaccttctccatgagaagttggtaaggtgccttcttaaatactagaaagtataaactattaagataatatgaaatagtttgaagtattggcaattttattttgaagctacataatagtgccaatttaagaactaatgattgatgataagaaatgacaatctgaacaaagagacttaggttgagggaattatggtgatgaaaagaattaagttatcacagaaattgtactttcttacccaatagcatatagaacaagagttcttcagctgttgatggttggataagaaacacccccctccttttcgagagggctgcattccaatcctgcaggttatctaggtaaggtgttcttgaactataaacataacaatagtgtggcaagtagcactcattggtttcttgcaaaatgtggctttgttgagtttttaggaaggcattatgcaactctttgcttgtataataaattcaataagctcaccaatgcaaatattccctgtattctggtttgcttggacttggcgcatcaggatccaccataaccttataaaaggaaaaccttttattttagcatttagacatagatatcaaggactagttgcatgccttatagaggacctagggcatagctcaataaagcaaacagaaaaaaagagagacaaaaaggtattctggagaccataaaaaataaaaaccatataagttttcaccctctccatgctaattatgtgaggttttgtgataaaattaaagttgtagagtgcctattagtggttagagcagcactgtgcagggaagtgggatcagcttagtatcttacagtcttacttttctacagtgagttcaggctggatattttagtgcgtgatatttcatggataatttgaaatgtgtggcagtgtctattgttgtggaaaggatgctgatatgagaaagtatgccaaattaccaactttaatacagcagagattcaatttctcactttaagtaaatcagacatgacagggccttatcctatccaatattcctgtaccacagtgtacaaacaagacaggggtgcacaagtatattctaaagtagattgtaccatatgtgtacttgatcattaccaaaaggttacaatatgattacttttttagcaaataccagctggcattatgatttagttttcctgccactacaatattctgtgaaacctaataagctatatccctcatatttctattatcgacagtacctatggatctgttgaataatctatacttgtgcaagttagatggccttttctggtgaagcactaattagatctgtgcattatttctttaaaacgtagggtgcctggagtaacaaacatgtttcattaattagtgtgcatatgcatgagtcactccataagaaattatctaatattctagaaaataaatattacctcttctgacacgagagaaatctttttaacttgaagctttgtttggatcaaaagtcattttcaccttacctaacagaatggttcaaaagacctgtacactactctgatcatgatcctacaaattatgacacttacaagtgtgtagagcttcgtttggtcacgaccttcaatctcaacatgtggtgcagtgaaaacagcagatgatcgtactccagttccatttgtaatctccttctcaccataattaatcctcattgcagctgactttatgaaaggatccaacacatcgccaattacctggctcaatgccaaaggatccctacctcgtgacataattttattgatccttggtgagaagggaattgggaaatattcaataaggtggaagggctagctaacaaattttctgtgggaaagaacagagcggttcgatgtaaatttatattaggagtgaagcatccactttatgttcacaacattccattgagcactatgagcaaatggaatcttgctttttatataatatttatttcccttatagttgcttctgtattgcatatggtctttgtgattgatatctatggtcagtttttcatgcatatattccccaaagatctggaggtatgtttaaagctccaagagttagcctcccctgcatggcgccttgcctgggctaggccaaaggtttacgatgagtcatttcgtgttcaatgatacttctctgagtggtgagcactcagctggagagagaatcttttgatcgacatcacaatgcaagagtatgaaacctggggaggtagaggcaggtcattagcaatcttctttcttcttttatttgcttttccttgactgtaacgggagtatctagtacttcatccttcatcctttggtgaaaaactgctatctggacctgttctacatgacccttgcatacttaactaaatataatgataaaggccctacaaaattttcaataaaattttagcaattgctcgtcaagtttctcatataaatgagataaatacgattcttacaagagtctctttcgacaaaattgtaacatttttcagtgcagaggaaaaagattaatgcatgtctgggaacaagttattcactgtggacacttctgttacaggtaagaattacacattagtttgccataattccatattttacccagtgctgataaattttctaccatagcaatgttattctgtggtatgtcttcctgtttctgttttatacattcataatgtattcatatgcaggcatgcaggtacaactttccttgtccactaaatacagctgtacaggatcattcggaccaaacaggaacaggaaaagcatctgccttgttcgagttgcagcatcattgtcttgatatcatgagaatgaggccacattccattttccttgcagcacttaaaatccagttgcacacagaagtttcacctttgatgctacaaacgggcattggacttttcgaaggacggaggatggataccatcacactatggggttgtgttcaagaacaccacatgtagctgcctttgctctccattcaaaaacatcacatgcgactgcctcggctctccacataaacatcaatgtcgagaatgccatgaagaatccatgcagattttaatatttttcagctgggaatacaggtaaggaccactggctcttcattttgcaccttttacttttgcataggcttcagaataagtactccgtactgtgccatacctttttttggcaccctttttttctggtcaacatgtaatggcctatttggaataaatgaatccacagaaaaatttacagagaacaatataaaactccgttattcttacccatttacatctcttcatccaaatgggccttaaggatcattcatgataacaaagcatcatcagttttagaataaaagtaacttcatgtaggacagattgtgttttgacatttggataactgtttggcacgtgtacttaaaggctgactgacgacatgctataatattgcaatacacagtgaggcaaggaatatactcgacatccaaaaatcttgttggaataaaggtacagtcttcagatcagatgagcatctccaccagggcactgcatggctgcaaccagaaaagctgaaagattaactttgaattgttgaaagctcttgcatgtcagtcacaaaaggggggaaaaggcaccaaggaatttccccgcactgcaaacaacctacacccagcttctgtggatgaactcgtgccatgccagtatgccaccgtccctgctgcctcaggcccctctagattgttcgtggaccagctggaaactgtgctaaagctgatctgatctccaggtgagagctgaatctattctgatggggagcaatcttatcattttgacagcatgcatctgaaggtgctagtggataagtggaagcttactgaatactcttttctgtaagttctttttttcttttttagcagcaaatgctatggcgtgctttcgatgagcttacagattttaacttttctattgattcacttgtttcactggtttctcaggcaaaattgaccagtgatgaatctcttataacaggtgatacatgacaagcttcgttgctgcagaagaatgcagggtcaggtgacctggaaagattgatgagaagaatttgagaatcttgtacagcaaattggatggagataaggtgaatggctgcggtccacttcaaaggtgaactgggaccagccgtgcatacagaaacaacgtctctcatttgtcccggtgcctgcataaacaatgtgagcgtgaacgtcaaagtgaagctcaacacagttcttctgatactctctcttgttggtccatattataaggtgttctgtttttcataagtcaaacttctccaacattgatcaagtttatgaaaaaaacacatcaatctacaacattagattagtttattaaatccaccttaaaaaggttttgatagtgtattggacgtatgtattatactacctatgttttagattataagacgttttaactttggtcaaagttaaattgttttaagtttgactaagtttgtagaaaaaaataataacatttttaacccaagataaatttattatgaaaatatattcacttattaatttaataaaactaatttggtattataaatattactatatttgtctataaacttagtcaaacttaaaatagtttgactttaaccaaagtctgaaacggagggagtagatattaatgtatttttttttgtataaacaccttacagtacaggatggatagaatacatttgttcttattgatggattgattattcgttccatggatgtgtgaattgggtccagttagtttgcagttctaattagatggcaaagatagaagcataaagtggcccaaacccaattttcagacagcaccatgggcggctcgactggcccaacgagtagagtaatctgggttaaaaaaaaaacaacttttaaaaccagtttataaattccaattgcatattgagagccttttttttttacacaatatactcttgagagcatgattggaaccttggataatccatttggtcttcgttccctaatctgtacgctaatcatgcaattaagagagagactcaaagcgaatgtgctatcattcggagacatggccactaactaaaggccgtttgccgttactaaactactactaatgcaagtacatatccagatatccttctggtacaccagcacacgcatcatctgaacataataatttgataatgaccatcttatatatattttaaaataaggcaatggtgataggtacacccaaaccgtaccagctccctcgcaaaatccacctgcctgcactgcaccaatatgcctaagctggaaagccacatgaacaaacggaacaaacaatgacccattcctgctgtgccgccgcggcgaagcaagctagaaaagccggcgaaacggccaagcaaaactagtgccgcgtctggtgcactcacgccgtgtttagtctaaaataattcttcaaacttccaacttttccaacacatcaaaactttcttatacacacaaacttttaactttttcgtcacatcgttccaatttcaaccaaatttttaattttggtgtgaactaaacatagcctcagttatcaaaacaactacgttcctgtaggtccctgtcactcggatggacattaatttagagtattaaatatagaccacttacaaaactaattacataaatgagagctaattcgtgtgacatttttttaaacctaattaatccataattagcacatgtttactgtagcatcacgtagactaatcatggattaattatgctcaatagattatcccgcgaattagtccagggctatggaatgggttttgtcaatagtctacgtttaatacttctaattagtgtccaaatatctaatgtgacagggactaaaaatttttaagtcccatccaaacagcccctaagtgcacagtctattttacatggtaaaaatttatgacggtccattacaattttgtagtagcttgaatagtaaatgtgttagtttggtttgatgccaaatttggtaatacctatattcaaaatggtacaattctaaaactttgttcaccataatataaattttagctctcaaacttatccactttcaaaactactctaccataacattggattttaccactatcaatattttagtacgatactaaaccaaacaagttatttgcctcatgttcaagccattgtctatgttgcccgaggtctgagttcctcaggatgtgtaaaagaaaaacataaactaaaaagaagggagaggtagggagtgtttgagatatgagaaagggaaagattaagtagatacgtaaaacgagataagttatcagcgtataattattaagtactccctccgttccaaaatatagtaacctaggatcggatgagatgtattccagtaatacgaatctagatagggggcatgtccagatatgtagtactaggacacatcacatccggtactaggttgctatattctgagacggagagagtattaattattctaaatttaaattgtggttaagatgatttttttaaaacatactccctccgtccaaaaaaagacaaaccctgggtttccgtgtccaacgtttgactgtccgtcttatatgaaatttttttataatcaatatttttattgttgttagatgataaaacataattaatactttatgcgtgacttgtttttttaatttttttttatattttttttaaataagacggttaaacatttaacatgaaatcggtcgtagcagttaagagcaaccaacaaaacacaagaggagaccaaatcaagcgcgacagctaggcgtgtacagccccccgtacaggcgtgcagccagcgcgacgcccccctgtggtgcgctggtagttcagccttcgcgcgcgggcggcaaaacacggcacgccacgccaatacgtgcgcgcgtcccgcgccgtcacgccgtgccgtgacgccgcccgctgtcgctcgcgccgcgtccgcgtggtgtgtctttcccctctcgcgaagcgaagcgaaatacaaagacacccaaacccccaccaccacgacgtctcgttccctcgtactagctcgtctcgtctcttctctaccccaatcccgttctctccctttccccccaccccacccccaaccccgtgccgcggcctcgccgatcgatcgatcgtgcgctccacctcctcgagctccctccctcgccgccgccgccgccgcgcgccgccggttcgacgccttcttcgcgctctcaggtgaaatcatcttctctctcaggttcaggaatgaatgcgtgggggatgggggttgatcggtttcggctagggggtgctggattggtgggtggggggtggcgcaatgctgctgcggcggggtggcgtttttgccgggtcgaggcgggcggaattgtggggaattttttttttttgcgtgcgcaattttggcgtggctcgggatgatggctgggtggcgtacggcggcgtgagctagggggaactcgcagcggcgccgggggtgggtttcggtggtggtttgtgtgagtcatttgtctcatcgagctccaagtttggaggtggtgttatgctgttttagcactggaggttttgtagtacggacttgcttggatgtggaggatatggtcatgtttttgttgattcccggaggccacctcttgtttctgatttccttttggtttgtgtcattggttcatcaggtagcggtagacactgaacatgatgattcaattggtgtgacggatgagtctggttggccatgcatagaattagacaggcggatgcgtaggttagtaaaatatccatgtgaatgaagctgagcgacaactgaaacaaaaataaatgcaggaccaaacttgatgttgattgggacataggcatgtgaaatttgcccatgttcacaggatgaacggcagaaacccagaaaagaacataaaaatggaacatgaaaatgatagttcacttgcttgggtggttggcaatcggcagaagaggatgcaatccctctcccttaatcgcactgcctatccatgattaatgtccatgtgcttcagtactagattttttttttaatttggaccacttcagttctgattatgagttttgtcattgaagtattaatgttcttagctgtatcggtgctaatgtgctgtcttttcctccttttctgaacttaaggcatagaaaagaggaagaaacaaaggatacatcattatgttgcgacgctggttctgctgcactcagtttcacgcaccatatcgtgaacacgaaaatgaatttcctgacatcccagaggagaaagaaggtatctttcttattgagcgcccctccttattctttttccttttttgagcagctatcttcaagtttatggtattgtatggtctcaactcccaagtagtcaagttgaggaaaaaattgctgaggtgttcacatcatcattgttcattctatatgaactaaactttagtctgtccaaggttgctatactagatgtcagtgcattttcagcatagttgtcagaaccattctttttcccccatggccttatcagttgaactgcacaattccttgcatggtagtagtatttttatcttgattttctttaatgctaaaaacaaggtcttgtattatatatccgcgaatgcttcatatcctgttgtatttttgcctttgagacctaaacctatttgtcaacatttggctagcaggaaatggttttgctcccaaaagtgatgatcccacaaaagcacctcctcccattgaagtaccagaattatcatttgatgaactgaaagagaaaactgataattttggttcaaaggctttagttggtgaaggatcatatggaagagtgtattatgctactctagacaacggaaagcaagttgctgttaaaaagcttgatgcttcaacagaacctgaggttgataatgattttttgacacaggtatggttaatgattatataatcatatgcagctcttgccaattatatgcattctgctattcgatgtttggaataaggttttactctaaaccttacttttcatttctattggcataggtgtccattgtgtcaagattaagacatgaaaattttgtggaaatgcttggttactgtgtggaaggaaatcagcgcctagtggcctacgaatttgctacgatgggttctctgcatgatattttgcatggtatgagaaatatgcctttacggtaaaaaaatgccatcgtatctcactaaacacatacaagccttttaatataattgtgtatataatatagatacttcaaggtttaagttggttgcctgtttcttttgtaataactcaaaataattcatatatagcagtgctctgatattgtttttgtttttcacatccttgtcatacataaggaagaaagggtgtccctggtgcacaacctggcccagcacttgactggatgcagcgagtgagaattgctattgatgctgctaaagggctagaatatcttcatgagaaggtccaaccttctatagtccatcgggacatacgctctagcaatgttcttctatttgaggactacaaagcaaaaattgcagatttcaatccttcaaatcagtctcctgatatggctgctcgtttgcactcaactcgtgtccttggaaccttcggctatcatgctcccgagtaattgctctactcaagtacttgaatagtttatgcatttcttttttttcccaagcaaaatatttaatcaccttttttgctataatagattactctgtaatatatattgctagaagatgatagtgttctgccttcaatattttgtactgttgattgcgtggctgtagcatccaggcaattcttaaatatagctaaacaagaccaatagttctatgaataactgaagttcccattatttgttaccatgcttgttaatcattcactcagtcatgtatcctttgttctcactccatgcaggtatgccatgactggccagttgactcagaaaagtgatgtatatagttttggagttgttcttctagagcttctaacaggaaggaaaccagtagatcacacaatgcctaggggtcagcagagtctggttacatgggtaagcattttatttgtaaatttactacaatatttaacatgagagctgtttgcctcagctattggtaaaaggagaattactttgttgataagatcactctagaataaaacgaagaaaaatgtggtcttaataacaaattactaggcatccagctcagatggactgaagttaaggttttgaatggtacttcaaagaatctctcagactagactttgcacgttaatgattcttcattcaacaaggctttcaaaccaaacagaattttattgtcctttgagaaactatactatttttactgtcactgtgcatagatgctattctatcgtgttatgtaacacaccattctaagttgtgtacaagctgctctgcatatttctgattagctcttgttactacttattttgtacgcaggcaacacctcgtttgacagaggacactgtgaaacaatgcgttgacccgagactgaagggcgagtatcccccaaaaggggttgccaaggtctgcctccctcctcccttccctttaaatgcacaagcactctcttgtatggtcactgtgtggagccaagcaacatcgtaaccaaaatttgagcccaatggtttccatctgtttattgcagctcgcagcggtggcggcactctgtgtgcaatacgagtctgagtttagaccaagcatgagcattgtggtcaaggcactctcccctcttctccagcataaaccgccaccgccaccagccgttgctcctgagacctgagctccagattcaactgcttcttatgcttttacttccgagtttcaacatggatgtaaagagggatggaatttcttcatcggtccctgtcgttactgtttcatgcttgccaattggttaccatgccgtttaagtactggtcctgtgagctttacaatagatttttggtgtttacactcggagctttccttgtcattcctttcatgtgtgcttatgctgagtgctgtgctgccttcgttggtcggcaaagttgtgtttttagctgcccagcggtggtgatcaccgaataatcttgttctgagttgaactgtgacatgggaaggttctaaatctaactgttcatggcttgacatgctttcggtgtgtgcctacgtgagaggatgatggttcttcactttgttaacatgtgagttatgaatggatgcttttggcttgctacaaatgtgagttgaggctaaatgctcgtcacaaattgaggttgaccagctaaaacatgcaagttttgataattgataacctgtacgccatgcggatacagcgacttgaagttgcccatcaacgaaaccggaatcaatgatttgccactataaagatttgtcatttttattgcatgtcatagtgataattgttgggctgaactaaatccacaatgtgcaaatgtaaatttatcagccggtaaatataggacacaactacatatcgacctgttgttgatttggttaaagcaacgaccacttcatcccatgcataataaatccttctttagcttaaaaaaaatgcaatggtaggtgctatctttttaaaaaacttcttcgatgacttctatcttaggatctatttttagcattatactccaatcaaaatatgtgacaaaacaagatcaatgttgaatgtatttaaacattttatttaataatttgaatatattcaatattagtcttatattttgtcacatattttaaatagagtatgatggttcaaatggatcttacaaataatatacgatctaaaaaatattcctatatcataaaagactaaaaaaaactaatataacggtatgttagcctcagtagcatgcacgtgaatcgacatgacaactaacaactagccgatagtgtgtggttctctttttctagcaagtggtctcgtttatctatttgtccgtacaacatctacgtgtttgtatctcagccatcattaactgattgaatggtttataaaagggtctctagatacaaccaaatagagaacgcatctcacaagggtgaggtaatcttcactactccctctgttttacaatggaagtcattttaacgttttccgcatttatatttagattgattaacatcaatataaatgtgggaaatggtagaattacttatattgtgaaacggaggaagtatattgattaatagacaaatcaacgattcatatagactaaactcttacgagtaaatcgcaatgagtcaagtacaaagctccacgtgaagagaatttaagtagaccaacaacaataatgacacacatgagtacgcagtactctatggcaaacacttcggtccgatccggtccggtccgcgccgcaaacacgtcgatggttcgaccgcaaccgggtgacccctgctccgaccaggccacccccgttctcctccccgccgccgccaccggcgcctcccgctcgtccccggccggcgagtcgcgtaggagggaagcgccaccggcggcggccgcggcgagatgagcggcggcagcggcggcggcgccgcgagcgcggtgttctacgcggagaagtaccacccgatccaggcgggcagcatcgacggcaccgacgtcgccccccacgacaacgccgtcctccgcgccctcctctgctccaccgccggcctctgtgcgtgctctcctccccctcctcctccttttgctccacgcggagaagagcgcgaacgccgccgcagctccctcactgactcggttggggttcggtttccgattttcgttttcagatgatccgttcggggaccccaaggccaccggcgacccctactgcacggtgttcgtcgggagactctcccgctacaccgacgacgagacactccggaaggtgcgcggattccctttggtgtgtgttgtactattagctttgctcgttttctcatggctggagttgttgtttctcgttgtgtatgtgagagagcaggagatgagcagatatgggagggtgaagagcatgcggctggtgcgggatattggtgagtttaaccaatgtgattcatgaaaacgttgcttttactttttgaagcatggttcatttgtaattgtaatggttattgaacatagcatccatacaatttatattatgccaatgcaaattgacgttgtattctgcgcggtattgataacacattggagcattgatatataagaaaatgggaagtgctgtcctgaattttggaactgtacctttagcggctattgagttgtcggtaggcagcaaatagcagtgcttcactggagcaacatgccagcatctcatcctttttcgcttttgcaaattcagtttttactaaccgaattacttgattttcagttactggtgcttctcgtggctacgcatttgttgagtatgaaactgacagggagatgcgccgtgcctatgaggttatatgatgttcttatttctactgcctgtttgtttccttcttaattcttagtacacttgaaatataaaagaatacatgttacttttgggtctataggatgcacaccattccattattgatggcagtgaagtgcttgtagattactacaggcaacaacttatgcctggatggataccgaggagatcaggtgtggttctctgccgaagttttatgcagagctaaaaatacttgagatggttttcatactacttttatttatcattttataggaggagggcttggagggaagaaagaatctggccagcttcgatttggaggtcgagagaggccatttcgtgctcccttgtatgaacccaaactcttgttgcagtccaatatttctcatgtaaagaatcatagaagaagttgctttggagtttctagacataaagtaacagcatgttgtacttctgtaaaacacaggaggccaattccgtatgatgaactgaaaaggcttgggatcccaccaccacctgaagggcgatacatgacacgttatcaggtagttcatcacttctagagggacaggctatttgactttttttttatttacatgaagtattattgcaaccgtcatttatggtttcaaaatttcatcatttaacaaaaacttgttgcattcacctctgtcatggtaagaaacaaagaaatgtgttattcacgagtgagcataaggaaatgatatgaggttgaaacttggagcgattggctagtgagaatagcagactgttgccctgaagataagggcataggaagtaccatgttcttatgtgaatcacagtcacatcacttttgcacaaactgtttagctcaacccacatgggggtgatgggagcattagtagcttatttgatgcagtagtatctgttcacagcctcgcaggcacaactgaactttctagtcactttgctatccaatgaagttggaagtgtttcattatgcttgcttactgccatgaagtgacactgtactcccactatcacaggttcccccaccaccaagacgaaaaagcagtgatatctacagggaagagtcacctcccaagagaagatccaaagacagggttgatagcagtcactacagaagatattgtagcccaacccaagacgacgacagcacggtcagcacccataggcggaaaggtagccatgaccggcgagaagaaaccgagaggaggacaagagcatatatcagcagagaggccggcagctacagtaagcggagcccaaccgaagacgatggtgatcgtcgtaagaggagaagaagccgagagcctggagaattatctccatacaaggaggatgatgataacagcaaaagaggaagaagttcagtggagccaggcttcagcccttatcagtctcatcaccacaggcatcacagggagcgtcatgacagcagcagccattctcgccacggtgaacgtcggcatcaagacgaccgtggaaaccactccaggaacaggagatcagagagccgggactacagccactagaggtgtcgagtccatggtgggttcctagtgttttaacctgaatccctggctgcctgttcgctgcttcaactcatgtatatgatctagttttctcaggcgtccttgccttgggttgcctgtgtagtgagggctactaaacctgaagtttcgactttggaatacatgaattaatagaattcatgatttagttcaaacctacctataaaattctttcattaaagccttattcagttaatcccttgtccaaggaggttgagagggactggaattaatactcccttatccactccaatcacttggtcattgggactaaacaaacaagcctagagtaagcctaagcgattgtggaaaatccaaataactccatataagttgctggtcttttcattctctccctacaacttaatttcatacaagatattcttcataagttctttttcttttcaatttcccccatttgtcttgtttctagtgattctcgtcatgctcatcgatttctcacatcctatgcacctcccgcatggtgagtgaattcctcctttgttctttattgttgggaattagatttaatacaccttatatgtaatacgtgatcgctgtcgtgttttatcgccgtacctaagaaaaaattgaagtatgcaaaagcaaaaggagaggtatctttggtgacagaggcaacttatttacctcaccataatgctcataaggcacaagaaattgccgaaaactgaatagtggtgggaagttggaagagaaaatgaacttacgagaatacaaggagagtgtgtttggataatggaaaatagagggtgggattgggattgggaaatgaatgaagggttaggattaaatgaaatagggagaatgaatgtttaggatttaaagatgtcttttggtgggtgggaaatcacttccatttcccattagccaaacattgccggagtgttttgcacgaaattaccttataggggagatttaggatgtgttcggttggagggattttctaagtttgtttgggtcgagtccattttcatagatgtttggttgtgagattaggtatgataggataattccaaaagagaatatattccactaaaaaatgggttgagttaatctagaaaaatgtgacggaccactcatatctgtgtatagcaatccgtatgagcatgaaactctacacaagagctcttcgcatcattttcttttttgactttgttcgtaaaaacaatgctcctgttttttatatccttttaagcataaaacgtgtaccactggaataaaaaatgtttgaaaataagtgtacatttttccaagaaaaaaaatctttcacgcgccacgatacaaataactcgaaaatcacagccaagaaaaaaaaaagcagctcacacgcacgcgtgaatcacatcgccccgtttccattttccaacactagtccacttaaccaccgcttccttcgccttccaaaacaaaaggaaccccaccaccgctcttccgcgcttcgcttctctcgccgtctcgcggctgcgcggcgcggcgctctcatccatcccctcctcccgcttcccccacccgccgcccgatctcgacggcggatcgccccgggatgggctccgacgaagacgagctgctcgacgacgaggagtactactactactgcagcgacggggagtgtagcggcggcgggagcgggagcgacgaggatgaggagttcgggggccgcgggagcgacgagggctgtgaggccgacgaggtcgtctccacgcgcgagcaggtgctgtctgtgaattgcgatcaatgcccttgcgtgtttcgttccgtcgttcaaatgagagaggcccccccttttcggatttctggatagcgagtggcgctgctgttgtggtgatggtgatttgtggctttgatgctgattcggttttgggtgcgagaatcctgcgtgttctgtggtaattcgacgttctgagcgacaggtgcaatgcgatgtacgagtggtttatgcttgtatggtgatggtgattagtgtctttgatgatgatcggttttgggatcagaaaccctcgcgtattctgtggtcatttgatagaatttctgggaaacaggtgcaatgcgatggtggtgtgcttagagtcgcagcgaaatttgttcatggcttctctgctttacagatagcaaaacgtttcatccttcggggaaaaaaatagcaaaacatttaccaagatctcaatagattatagatatgatgttttctcttcataaattgtttcgatagcttggatggttgtttactctacagattgagagtttgagactgctattttccttctctgcattgtatgtcattaacgtaattgtgttttggtccttttgttcatgctgccctgcctttctgtttctctattcttaattcttgtatacttggtgtcagaactaactcaaaatctcaaatgggcctcttctgtgttcattttcttatgaacagagatatgttgtgttgaccgaagatgatatacgcgagcgacaagaggaaatgataagccgtgtgtctgcaatattttcagttccaagggaatcagcatgcgtcctccttcgtcactacaaatggtcagtgccgccgctccagcagctcgtcctttctgaacacactctactgttttatttccgttgtagtgaatttgagaagcccatctcatgtatctcttgtttacaagatgtactgcaaatgctttgtgtagttatatgtatatgtaatagcattttcttactgctggcctgccacaaaggtaggatgcttttgagctaaactagaagatccttttctatgttaacaatgtatcttcattttgttgttcaggagtattagcaagctaagtgatgactggttcgcagatgaagaaaatgtccgccgttctgttggcttgccatcaaatgttgttcatgttcctgactgtcctgaggtagaattacattcctaaaagatatggagcttcattgggtttttttttatcatattgtatcatatctggtttgaattggtgactaatgtagttaactgcatgttgtaatttctatttgtttctttggttgcagctaacttgtggaatatgttttgaaggatgtgctgcaaatgcaatgagctgtgctggttgttcccatttctattgtcatgaatgttgggaaggtctatctgtctctctctctctctctccatcactcatttttacattataagttctttgtgacttcaagattttgttattttacttgtaacattacgaattgattgctattgtaactataacaaattgatagatgactttgttgttctcactttcagtagtttgtagcattcttgttcttaaaagaattctgaaatttatggtgctaaaatgaggtaaattttcagggtatattagtgctgcagtaaatgatggtccagggtgtttggtgttgcagtgccctgaaccatcttgtgatgcaatcgttcttgaagatatgattaatagtctgacgaaagatgaggataaagtaaagtatgcacgatttgtattatggtcatatattggagttaacaacaaggtaattctttaaagtactcagcgctcataatggttcacattatcgttctcccaattatgtttattaaaccttactgtattgcccatcagatagtagtactatttactatttactatatagttggtatatacttgcttatatttatgccaagtgtcaccccaaatggttttcaaaaaaacatatttctgaagtaataaaaattaattcctgcagataaaatggtgtccagctcctgattgtacctgtgcagttgagtttcttggtgatggtaactatgatgtctcatgcaaatgcaaattcagtttttgctggaatgtcggtatttctttatttatttatttacttgtatacctttcagattgattgtttgatattaccagttaaatctttggtaaatgcagtgtgcagaggaagctcatcggccagttagctgtgacacagtctcaaagtggatactaaagaacagcgcagaatctgaaaacatgaattggtttgtcgcacacataatttccttttcattcttgtatttgatagtatgtcttgtactttattctttccatcttgaatatttcttgtgtaaaatactttttttctttttaatttcctaagttcataaggaaaaactggaagctgtttctcaagtgttgttttctcccccaggatattagcttattctaagccctgtccgaaatgcaaacgacctatagagaagaatcagggatgcatgcatatgacatgcactcctccttgtaaatttgagttttgctggtaagcttccctctcggcatatttgttttgatggtgattgtgtacattttgcattgaaattgtttatctttggtctgattttccatggttgcaggttatgcctaggtgcatggtcagatcatggagatgggactggtggcttttatgcttgcaatcgttatcaatcagcaaagatgggaggcatggtatatttcatcttggatactgtattgtgcaagaagaatcgtgatttttaccttgctagaataagcttttctattgctacctattcatgtgtttgctctagtcttttatactactttgctgtgtatttaatttatttgttttccttcatgccaataatctcttgtaatgttttcctcatgtttcagtatgatgaggctgaagcaaggagagagagagctaaaaattcgcttgagagatacatgcattattatgagcgctgggcgtccaatcaaacagtatgtctaggatccagtcactttacatagtctttatctgattttttatggtattcatgcttctacatgcccttttgattttcatatggaccatgtaatgtgtatagtaagctcattaggttggagacttttagttttgctgactggaaggatctaatttcatgttgctgctgcaaagtacagcgtctggcactaatgtccttggcaaatcagttgtctacttacttttcattttatatttaccatccaatattatgagtggtaaacacatacacagtgctttattttatatttatctttctcatactttcataacaattttccacaatgctgtatatttccattcaattttcgcatacataatgtgaagggtctgccataaatttacattttagctgtacttttatgtatgatacattttctgttttcttttccctgttggcagtcaaggcagaaagcacaagcagatctgcaaaaagttgaaaatgaagatgtaagttttacattggaccatgtgtacagcatttgtgggtcatagcagaagtttgattttattaatacttgtagcaaaactcactgttttggcagtccttttatcagttgtaaatacttttagtttggacttctgtgatgtttcagttttgcgtttgactattttctcatgtgtatagcttacaaagttaagtgatgttgttggtataccagagacccaactaaagttcatacctgnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16504 - DNA, 2353 bp, Oryza sativa
tgtttcgctatattcatcttctcttcaagtgaagagcccaaaaaataatggctgccttgaagaaattgtgatggttttgttttgagcaccttgacttgattagtactttcattatgatggtgcaaagtctgtcactttggacttggacaaccgacgccgccgtgtgctttcttccttcacgccgagccatttcttcagaagctcaaacacattctcgtcgcaaagcagccctcggtggtcggcctcgatgccaactctttccttggctgcaaatccatcagcctgccgacaacaaaaaaaacaatgacatattgtgtcccagattgttttcatgaggcaacatggcagatgctatagtttaaggcgaaggaaaagtatgtatggtgtatcctaaactgtaaatggcaaagcttaacattgaacgagttgcccttgaattcaaaacactcgaggatcaagcagtactgaagaaatcccaaagagatgccactaaattgccggttattatggcatgcctttggttttcaaaaaattgttgatatgccattgaaaatgatcttgtgatcgtatgtttgctaggctttacaaaattaaagccacttatttagtcataaccaactaggtttaacatccaaagtttatgaaaggcattatgtaatgttctgcttccctactaaatcattaagcaacaagtgagtaatttctcgatgcataatgaagagtaatactgtgaactgggttttgttgaataacattacagaaaggaaactagacagctgaaatctattatatgacagaaaagagcgactaccatagttgactcaataggaactgtgccatctccatccacataagtgtacactggctgaaaataagatggaccagcataatattttagtaaaagcaatatcacacaactaaaaaaacgatattttttaattgattaagttcagcaccattgtgtggcacacttctgacagatctccaattggggagctttcagagccgtaactgcaaatcagaaagaacataattacagcaaagccaaagctagataagtcaaatcggaataaatctgttattagattaataacttatcaactattcaacaagaatcttgaagtatgcacacaattggacattggaacaagaaaagagaactctatcaaccaaaggctgtaacggatcctgctttccatgcactcctattcaattatattggctaagcagataattagctcaagtaatggatactgttagaactatttatatcttggtttgtaggttgagagtcgcaaaccgataaaaatgggaatctagattggttgcctactaagaatagcatgaaggacaacatgatgttagaattagcagtcttcaaaaatactcaccaaacatcatatggagtatcgtaagatgtcccatatatattataaaagctcacagtatctggtaattcagcatcctcaagaattcggcgggtctcagtggcccacttgaagactgacatattgaatggcagtgcaattgtcttcccattatacttgagctaggatagaaaagataaatagaataaacaagtttcactcaaatacaattaacagaacacagcactatcaccaaataaaaggatataccatggctatgttagtatccaaacttgatgcaatgatgagacaagctctaaatatttttattacattttttaggtcaaacaatacatggtatttgtaaggcaacgagttatcgactaatggttttatgggcaggacaaaagttctcccagatgtgggtacacacagaatgttaatacataggcagttccgcataaaaaaaggttcacatgcagtaaacattatctccaattgttcgaagtgagccaccaatctataaaccattttaacattgtcaaatcaatggagtagacagcattactatgtttttcatgagtaataccaactgccaacgtgcttttgccttctgcatactatctgggtatttccctctcaactaaaggatggtgtgatgatttagttccagttagtgcgcaaagtagttctcatctgtatgtaaaagatttttcaacttttgatagtaacgcttagtgcggtgctaatttcttatgctttaaaagtatttacaaattagaagcagagagtgactacctcattgttccttaaagcttcttgaaacagagataaacaatcggtagcttcatacagaactaactccgctattccatccttttcaggtttctttctccaaacctgaacaactggtgctttcttccacttgaaatgtggatttggcagcatttcgtagatggatgggcattcaacaagctgcacacgtg

SEQ ID NO: 16505 - DNA, 16194 bp, Oryza sativa
ccaaacaaataacttaacccacacaataaaaaaaatccttgcaggcttgctgaggaccatcattgtgtagcccttcattagcagtttagttattctagagctccattcctcatcctttgaatatatgtgaatatacatgcattttttttgttaaaatatatttccaatagggacccccctactgtaggtaggagatgaaaagcacacggtggttgtttttatatagaatgtaataacaagatttacagtagtaagcatacacaaactcagctagcagaatatgaaatagtcaagaatttaccagttgatgcatcacccatctagaaacaaaaaagaagctttcaaacccataaacaaattgtagcccagttagcagagaatcattgatgcatcctggggcacctgccaagatgtaaaaccaaaaaacatagaacacagattttatcaaaggtcatcaacgcaagaatagagcaactataagtgcagaatgtcaaaatatatattaccttgaaatggacatgcaatacaaatccatttgttcacatatttcgcaaatatctagaaaaatggagaaaagagaaaacatattgaatacagaatacgattgttagtaagcaacagactgttctaatcatgaaaactcacatcacggttcatagacatgaagcagctcactagcagtccacccatagaatgcgatattatattaacctttttcccaccagaagccttataagctgtctcaagttttgctcgcaaaccaaccatcactttgtctatcctgccagataaacccataattacagcaccttgtgtttgctcagcagtaaaatgttcaaactaatttattttttgatgctattgagtcaagactcgagactatgcaaataagcccacatagatcgtacctgttactttggcgaaaatcataaccatatccaaaaagtgtggttcctttcttgtatccacagtcaacaagcatatcaatcatatcatgaaagtgatacaccatagacagatggagaatctccacaaactgagtttacagaagatagaggaaaaatcaaatcagaaacattatggtctttgagtgtgactagttgaagaaggaaggtgatttaacacatcagtattgttgcactacacagacaaatatctgctttttagattctatctatcccatgaaatctgagaagcaaatatcaatggctttttcttaaaagcacacgctcctccacttcaatgtcaacataagaaatgagtacaaaaagaaatcacgaagcagcagcatcaaatcaccaattgctagtgctcatgaatatacccataggcatgatacgggggcatgctaccacttactaaatattttcgcacggtctagctgttagtacttactacggcttcacttaacctatatgtacttttgatacggcaccagtgacaccaattatcagtattacacaccaaatgtggcgtggttaacaatttaaaaaaaaaacgaatgaccgtcgctcaagtaaaggcggaagaactaataccctcgcaaatataccattcttacaaagcaagaaaagacaaaccctctttctagtgttcttcactgaactaacacccagaagctagctcacccaggaaggatcgagaatgtcgatggcgaacaggccgtggtcgtcctccggcaccacgatctccacatcgtcgtccaacggctccacgtaccctgcgcacaacagcaaaccgaatcactctcgttcaaacaaaccgcgcaccccaactcacacacaaacgtttcgtcgaacactacgagcgcgcgcgcgcgacccaccggtgtcggggttgtagagcgaccagaggtacttcctgaagtcggcgtcggcgcggaggatgcgcacccagacgcggaggtcgaacctggggttcgaccgccgccgcgcgtgcagcaccgacccgcccatcccggacaccagcaccaccgcctccctccctccttcctcctcatcctccaccccaccacctccccgccgccgccgcgtgcgcctgcgcccgcggaggcggaggtggcggccgagcacgcggagccgcagcctgacggcggcgcccactcccagcacggccatggcgacggtggcctcgccctcgcagcgtggcgcgcatggagcacgagggcgaggcgcgcgcgcggcgtgggtgggggggtattaatggtgaggaggaggaggaggaggcgagacgcttctcgaagtgagccgccggtcgccgccgccgccgacgtggctggcggcctcaccaccgtcaccgcacggtcaaatcgctcgcggcgggtggaggcagctgacggcggcaccctggccgtcggattctcatcggacggcggctgtcgcctcgccgttttgccccccgcggccatcgacggcttcggcacgtggctagtaaaacattctttgtgtcgatgacatgtgggccacagggatgggggcccagtgtcagtgacactgagaccgtgcgcgaactagtaggtatggtagggaatccgtggggtatattcgtctttaagaggggaagatgctgacgtgtggtttaatccctgaggtgggacccacctgccagtgagtgagatgaagcgttcgaagcattcaaggcctagctcggcagctgcggcgtccacgtacgcatgaaagtgtttcttttacttgtcgttctcctgctccctaaaacttgtacggctctccccggccaatctcagtcaacaattcaacatatggataagctcgttttgagcaacagttgcatccgcccaaaatggcaacatggaagaaaatagaagtggatagaagaactccaatccgacgacgaaagcccatgatcgtttgtaattaagatatactccattttatctcagtttttaattagcatggtttcaaactctaaattacacatttcgtgtaaattcttcctatatagaattactttaaaatatcagataaatctattttctaaatttgtaacagttagtaatattcaattaatcatgcaatattagttttttttccatttttcgtgtagcttcgtctagggtaaaaacaaacaccaccgaagcgctcgcttcccgcactctccagatcaccatgttttgtcacctacccgaggtcgcattgcccacttgatcgcgtgcattgatcggcctctcaccgttcaaacacggcaccagcgacggtgagacacatgtacaccggggcagtgcatctcttatctatataaactaccaatctgacacgaaaacgctgagaaaaacaggagcaacgtctgcaacaccagactcagcaacataggaatacaaaggatgaaacggagtgatgcagtgtaacggggaagtgaaacagattacaaatcggagcaccaaacatagcaacgattcaacgaatgtaccaccaccacaccaaaaccaaagctaaaagagtcgatgatgatttgggtatgcagtaaaaatctgaactgtaaagcgacgagccggtgatgatgagcgtgagatttggcattggtttctttataggaaagcgtccatctcgagcaccttgaggacctcatcctggttgttcagcttggccacctcgatgggggtcttcccgtccagattctggggcgtgctggggtcatcaattttcatcaagttaggcacaaactagcagggcatcaaatcgactcggttttagatgaaatagctggtttaaacttacacagcagcgccatgcttcagcagaagatccacacattctttccgaccatatccagcagcgtaatgcagtggggtgttcttgttcttatccagtgcgtttacagcagcacctgcctccagaaggatctctgcgcatttcaactgaaaacagacaagttcacccaattggttattgctacaaacatccgtatttaatctgtgttacgtgattcatttctattctaaaccattcagcagttccacatacctcaccgtaaccacacgcaaaatgtaaggcccttcttccctcagcgtcttcttcatccatgtctgctccatcctctaaagctttcttcagaccctgttgagtcattatgttgtataaagaagtacttgcagcaaatgagtagtacaatgatttaatatatttcctcaggctcaaacataaataagagattgacatcaagagcgaccatatctagtgcaaagatcaggaacattaagaacgaaaaagggcagccaaatgagaaacctgccctgatttaaaccccgcgtatatcagattcaacaaacagaagtcatttttctacgtagcatttgtgtagaattggcaccaaataaaggcaaacggtgtatggataataaacacaataagcaggtggtccacaaagctttaagaacaagaagccaggttatgttatagaactatctaggaaaagcatggtttagtcatatgcttagttggagaagcaagctttgttgtatagtgataggtcgggtaaacaacctgctacattgatgggcagcatagctacacatagtcgtgaagactaatacggatagataccagcacaagtttcagatcaactcagagcaaagtaaaaacagaagtcacgtcctatagttattatcgaacttcattacctccgcatcgccaacactggcagtatgatggacaatggactcatcatcatctccaccatcctcttcagtttcttcaggtccagacaatgtagtggaagtagcagcatctcctggaaaattaattgacatagcctgaccaatcttttgaagaacttcagggtcattccagtacctgaaataagtgaggcaaaccatctcagcaaatttaaaagccacagttatatctaaatactagcatacaacacctacttcaccatagcagatggaccaccactctctatctcatcaagaatccccttcaaagagggatcttctttaatacgggacatccgctcttcaagcagctccttatgagaaggactagtcaaactctcgagcatactggacattccaggatcctgtcatgcgtagcagaaaacttgaagcgaagaaacattctgaaaattttttctggtgatgactctggaaacataacatgatacctgcataagagtattcccaagacgttctgccattgacatgaattgagggttttgcatgacttgtgtcattgtttccatgtactgctgaggatccaatgcagggccaccctgttccccggtcacatgagcactcttctgcagctgctctgccatctgggtgaacacagggtcgcttgcaatctgctctgccatctcctttatagatggatcctgcacatcacattacagttgtgtacgtaagaatagtacagttaaacataagtgatgcacaaaaagagagcacatatcatgcttttagctgcgcgaaaaaaaaaagaacttacattgagcaagttgctaaactgagaaaaatcaaaaggattgggaaggcctgcatcaggtgccgggggagctcccctttgcgagccagaagacccctctggttttgcatttttcttctggtctgaaaaaggtaattgggcagacaaagaggagcttatcagaggctatagaataatttattcattgcttgatgcaaactactcgcataagccagatcacaagcactactcaagagttaagaatctttaccagtgaaggacttcgaattgattgatatgaaaaaaaataaaaagctaataattcttataaagcagcaatacccaaagctagatcttataatatcagcaggtgaagttgaattcccttcacctagacctgtccacacgcaagttaaatctcacgacagcagcaagggagattcaatttcctttcacctcgacctgtcactctaaatactgtacaccataaactgcaagatcgaaatctcaatctagataatcactgggaggcggacctaacgatgcggctacgtgggattggggagggtgttcactaaaccccaaatcaaacccccaacccccgaacggatctccgatctactcacgaaagcgacgcgccggagaaggacgacgaggagggagatcaccgagacgagaacaaatcatcatcataccttccatccgatccgaacctggggtgctcgtcggccacgcacgcgcgtgtggtggggactggggagaagcccctacctaagggcgagaggggatcgggagaggagaggaggtcgcccacgccgtggctcgccggcggtgggcgggtggggggtgaaggctcgccgcagcctccgccggcggcgacacgaggggatggatgcgatgcgagagagagagaggaaaaccctcgatgagaacttgggaagaagaaggaagcaggggtggctgactaggatcaaatacgggggtgggggtggagtacttttttattatacgatccaaccctgttttaaattactaattgcaaattaagtccctgattctgaatacgaattctttacggggaaggatgaaatttgaaacgttaaggattctaagagtgctttttatttagtttcttttattcttgagaaaatagatactaattccgtttcatattataagtcgctttgactttttctcgagttaaatttctttggatttatagaaaccttagtaacatctacaacactaaataagttttattagaagtaacattgaatatattttaatagtatgcttgttttgtgttgaaaatattactatattttatataaacttgatcaaattttaaaaattgattagaagaaaagttaaaacggcctatagtataatactatagtataacgaatagagtaatacttagttggtgattggcgcatatttttttctaacaaaattatagtaggatcttgtgtggtttatatgcgaattctttacagggaaaatatggcatttgaaaacttaaggattctagtgtcctttttattctttttgtgccttgacttgataaaatagataagaatcagttggtgattggcatggttttttaaatgaagtcgtagaatcttgtgtggtttttgtttgaaatctccacggagaaagggtgaaacttaaaaactttagattctagtgcccttttgtttttttattccttgaaaattgataagaattagttggtgattaggatagtgtttttttaaccaaattttatagattcttgcgaagtttacagaattattcataccttcgtctatttgagtctgtttcaaactgttgagggatgcatttgccgattccaagttacatatggagtgcaatgcatgggtggtcgatagttaagggatgcattcgccacgtttaatcgaaaaagaaattaatactccctccgtttcgaaatgtttgacaccgttgactttttagtacgtgtttgaccattcgtcttattcaaaaaaaatttaagtaattattattcttttgatatcatttgattcattgttaaatatactttcatgtacacatatggttttacatatttcacaattttgtttgaataagacgaacggtcaaatatgtgctaaaaagtcaacggtgtcaaacattttgaaacggagggagtagattggaaagtaggggtgcctatacaattctccttcttgatctatatgcatctatcaatctatcttgttgagtgggactccaaacaaccagctgctgaactgcccacaagagcaagttgcattgcgacgcgttatagaaaaccgggtccatcctttgctgcatcatcgatcgatcactcgtgatgcatctgaaaaaaactttcctctgttcatatggcagcaaaccgctcaagctagcaaaaccaaaactgaaactagttgtgacagcaaacacagagatggaactgacttattgacaatatcaaaattgctaaaaatatcctgtgtaggactagcgcgatcgatctcgtatagcggcggccgacttggtgctagtgcttctcctgggatatgtaaggagtcgctatcacgtggtagtgtgtctttcttttcccaggttatagctttcggacggtaatcttgtaattttttccgctatgttaatatgaaacctcgcactacctcatgcgggttgtttttttttaaaaaaactaaaacagctgaggtttcgtcttgcactctgaatgtccttttcatagagagctgttcttttcctcattctgccaaaaaaaaaaagaaaagctttcagccaatcatgagctgtatccgtcatacatagagatactctcaagtcggcttttcttgcagacaaaattgtctgataaagaaaaagaaaaaggaaaaaagaagatgcctcttttttcttgcagacaaaattgtctgatactgttgttttgtctcgagaggttgtcaactgaactgaagtggtgctgtgtttttctcctgctactcagtatttgctccatggatgattggtgctgttgcgagcagaagagctgtctccttcatacagcctctcaactaccagcttcattcattcatgatcatctataagaacctcattacatgaagtcatggagcaggcagaactgaaggtaagatggttccattgtaagtagtagatgcattcattcatctaccactacacatgtgaaaaacctggttatggtacaaagaaacttcttgtaattatatgatggttctgagcttctgaagctgaatgatgcaaatgctacccgcttcagcgaactgaatgtgaaagtaagatagtcaatgagacaatgacacactaacaccgagatcacttgtcaagttcacaacattccttagaaacggtcagtgtttttttcccttgaaaagaaaagaagaaataggcatctaaattcgtctcgacaaggacttgatggtctggatgctgctgcttgcggctgtctgttttcctttgtaccagtcatattgctgctatccgtgcagcctgacaatgtgcaagcaagcaaatggatggaaggaatcagaatgccaaaagaaacttcagtatcgccatgtgttcaggaacttgtcaagaagatagattaccatcaaaggcctggtgtttatcatttgctcttgttgttttcagaaattccagtgtcagccccacgtttgcagctttaagctgcaagcctgacattttccatgttgagtctctggcagctggtggcaatccacttttggtagcacataatgccacaagtggaccaatgtgaattgaattaatcacgtatacattatttgtggtgtttatcaatcaaagttgtcatggaaccttgtctgtatatatttacagacgacattttccttgcttttattgaaagcaaaatttagaggagtacacaacagtcctgttgacgaaatcgatataactataagaacccagattattacatattcagatcctgaagacctgctgatttggattcctgaatgcctgtaactctgcttaaaaaacacattttatacagacagtgagatcttccctaagaatttttcacatgccatgctgccacatcccccaaagcaaaagctaacagaacaaggttagcttggttatttattgcaccttgacagaagccattgctcttcagagtcttgcaaggaacatgaaagtcaggaaggaaaaaaaagcaagtaattcagaaacacccaacctaacttaccaacattactcatctgttttcagtctcccctgtgaccaaagaaaaaagaatccctaacacaagcaataatcgtattgtttctgtgatttacaagctggcacgagcaatgataattccatacaccatgggatcaaataaaccattttttgcaccaagtccagaggactacggaatatgtacaccattattgagatatgcaactgaatatggcataaaagatatacaataggtttctgggcaacatgaagctttcatttcacacccacgtaatagcatgatacgcgactagaggccgaaatccatatgttcataggctcgaacatatgggttctttgcaatcaggtaagaacactagtacgcattgtcagcccgtccgtggtagtttctcctcctcagctgtgactctggcgcaggctgctgaaggaaaatctttgtaggatcgttcggatcaacatacctgtagatagtagatcatgtgagttttctagcagggcaaaagctaaacagatggcacaccaggaaactagataggttgagcactcacgcatgacgcatcatatcatcaacaggagtctgaacagcttgtagcgggtccacacgtggcgccatacttgcggcagactgggcctcaaactgattgtagcgtcgcacagatgcaaccaggtttaggaagagaggaacaaaggtaccacagccaccctccttgaacaagatcttgaaagtgtgggtcgagtacagggccctgttctggttctctggtacaacctgcattataacctccaaggtcagtgccgcaccaaatatgtcaaattatatatccatgtgttcccgtgatgctcaagtacttaccggctcaacgaaacccgatatgttgttgcagtgaaatattggctgattgaatttctcaccatgcacatacaactgcaaagagtttgccatgcaacaccatttagaatttactatcatgcaaaatgaaaccatcaaacaaatcataccgacaaaatttgaccaattgctcctatcagtttcaggctgccattactcaccaggggcatatcaaaagcaaagaagttcccaacaggcttgctggcgacaaagaccatccttatgtttgacaggtaaattgtgccctttgttttcgcatgaccaccaggagctctgaggacaagcatagcagccacaagagaagactaattagcccaagccccaaagcagtgattaatttacaacgaagatgaacttttcaagacggaacataaacgtaacacttgaatgtaatgaaaaaaaatgcattcctcgtggtaatgagatggtgaataatgctcattattgtgacactaaatccctaactgtttccatagttgctgtacttcagtaaggagataacattttgtaattttccaaccaaagcaagattaagcgtcccggtttgtaacctatcaacccgtacagatcaacaaagtaaccgccaattagactcgatgcgaagctcaatttcagcgttgagttccacccggacaaaaatcatacagcccaatgctcaatttcggcgcgccaatatcacacccgctgtgcctaacctaatcccctaattccccccatctaagacaccacgatccctcgcccgatcgccatcgaagccccagcatctcaattcaattcgcctcgccgcggcagaaaccggaaaggacacgcggaggaggaggaggagggaggggacgtacgaggggatcttgtcgacgtggaactcgacgccgtcgcgggcgaggacgaacatctcgccgtagaagggcaccagcatcccgttcccgaacagctgcgggttctccgccatctccggccgctcccgcgcgcctctcctcgccgccggtggatcgcctcgccgagcgcggtggtggatggagaagacgaaggcgaagacgacgacgaactccgcggatggtcacgcggtctctctcgatcgattcgatgcttcttcgacgagaaggtattcgcggttgggtcggatcggatcggatccggttcgatgcggctacgtgcctatgtatggccggttttgggtgggttcgagcgcgggcgcattcgggctcgtgggttttatagaagtctacgtggcgagttggtttgcgtggacggttggttgatggttcggttcgggttgtccagtgtgttccagatgggccgaacagaagctagaagggtgagttcttgagcaggtacaatagttctacttagcaggcttaaaaaaaatttatatcattaaattcatgagagagaatcaaagagagagaatgagagcagggataataatatagcacactttctactattatgcccatcttaaagcccaaacatatatatagtgatagattagctataagtgtgctacaatttttttctcctcactctatctctcacttatacatttaatgtatttgtcttggaatttgtgataaataactcttgcatgagagccaaaattcctaatttttcactacctctctcctccacctaactttatagtaagcctatagctcactgaaacgggcgacttctatcgcccgccgatacacacgattccgcgataaaaaattgggccacaccgaaccccatcgatcccgtgtgacttttttccctacatcagctctcacctctcctgctctagatcactttttccgtccgcacaaatcgcctactcctactccacatgagccccaccgccgttcatcagagattcggagtcaatttccaccgccgttggaaaccacgtacgccgcgaagctccgccactgttgccaaatcaaagcccacgcacctcatatatcatgttcctctcatgctgaaccatcagatcgatggttgctgcgcgctagatcgatgttgtccttatgaagaagaagaagccgttgttgccatgccatatctcatgccgccttgtggctgttctgttgattgagcaaacaagcagctagaagaagtggttctgagttctgttgtgtcagtggatttggggatctttttttctgtttctttttacatcttctctcgatatatacctgttgtttatttacacaaagtagatgatttttttaggagcgatgcaattgtgataagatttggatctttccatcaacacttcactagcagtaattatctaaagactaatcatttttttacgaattcttgttgatatcacaagttcacatcatacagatggctacacagatatagtttagttttgatcatacacatttatcttggcacacataattaattatttgatcactgaggtgcagtctatatataagagctaatctattgtactagttggctttagtattagctataaaatataaaggtaagtgaagctagctgctggctatattattgaccttgctcttatcaggctagtctattccctcgcgagcattttctcaaactacttgatgacgtgttttgaaataaaattatataatttaaattagtttattttcgtgttaaatatagttaataatcaattgagccatgtattgattcgaacaaagcctctttactgctattctgggcgtgtttatggtcaatttttaattttactaaattttagtagcacaattaaagtttgatagggtaaaacaccattaccaacacaacttctggagctttccactctcaaatctctaccaaattttgataagattctaacccaaatagcaaatgatttagtcacagagcttgataatcgtttaatcagccatacggaaaaacaattaataaagcttttgtgtcaccaaaattcgaggatcaagtttgtgcgaagagatacaagaaacagcgagtcgtagtcaattgtcgaagcaacttcattatcatgacaacaaaaatatccatccgtggactcaaatacaaaaaacgggtataaacacagcaactatgcaacggcacgattttaatgtttcttttcctatctgacaaactatgctggacgacatggactcaatacatttaacaactgaggcagcaacaaattaaagcttttcttgtgtaaatatgcatcagcaaaagctcgccttgtgctaccagcaaggtgcgaaaattcatcgcggttttcctacaaactttgtgaccaccagatcctctgcagaaatgagcctcaaagccatcctcatctctatgggatctcgtcctggtggtataggtagaggccgaaaccaaaccgtgcgcaggctttgcagaacgctgcttcctccgcagccgcaacagcatcgtcgttacggccctcgtgcactggtgccgtgccagtagcctctctgtatgcctacactcacacacatacaggggttatgctgacctgacataagggcagctacaaaaacaagatagtacgagtaggttgttcttttcatgtatgttgtgttatgatcaactatgtcatagtatgtagaatactgcagtgtaaaaagatgaaatacctctccgtctgttcctctcagaatcactcgataaaccacggttacagttccattgtcagaataaataacattgcgaacttctccacaccaacctgaaaaaagaatagtttcgtcacatttctttgcatctccagtgcattctgcagtggatgttccaatttatgtaccacctaaatacctaatgtggtagttcctagcttctgtttagctatctaacgaatctttatgcagggctacaatcataatagctctatccaacaaaatacaccttataatgttttatcagataaaacatacagctgttaccaagtaccataccatcaaactgtaaccagccatctttcaaggttcgtttgtagcaggtctgcaggaactggtcgatttacatgacattgcttagtgtgagatttgtgaaggctgtgaactaacaaaaacacatccactttggaactaaagtgtcatacagaaatatctgggagcgccaaactatagtacaaccaaccagcaaccagcagaaaagaatgttctaatcaaaggaaagaaagcacaaagtagtttgtaatcttaaagagacttcacctggtgcataaaagctcagcattctattggcatggtacctgcagagtcaaatattaacaatgattacattacacaaaaggaagcaatgaaacacgcaaacgctttcatgtcaaacctgaaaaataggaaagtagtcattgcagaagtcttagttatgtcagtacaatttagcatcatcgattattcttgtgtgttagtgacgaaaatatctttgaatttatactgttccattgctagtttaatccagcatatgtagcaacaacatttcttatcaaaagaacagaagaagtattagttattccataattcctttacacatagttttaaggagatctgcagacagctagagcctaggggcaccactctctcccaacaccagggtaggtctcacaagtaattcatcctttagtgacactctagtttccgcttttttttaaaaaaaaaaaaatagctcgaaggtaactactccctccgtttcacaatgtaagtcattctagcatttttcatattcatattgatgttaatgaatctagacatatatatctatctagattcattaacatcaatatgaatgtaggaaatgttaaaatgacttacattgtgaaacggaggaaatactaactatttatgcataaagcataaagttctatcccacaaagatatggcatttttataccaacgaaacaaatgccttagcttcattgaaccgacataagtgcatcgtttaaaaaaagacggcatgatactaagaagttctaataattcccatattccaaagtaacagaccatttcctctttgtagactagaagaaccgtctccatttgaccttgtattaaatgagtaactaaacaaatccacacaccaaacatttgaccattgacttttcataatatattctaaacaaagatcgaaacaggataacaccacgttactcaagcaactctcccatcaaatggatgttccaaacctataaacgagccagcaagagcataaactgctggctgtagaacaccaactatctgaatattaaagcctagttgtttcgaaaaaaatgataaagcctagttgtttcagaaagaatcataaagcctagccaattaatcgcatagcctactaccttaaagcccatttttatttgtaacagacaaagtcagccattctggtaggtgcaaactgcagaacaggtgaatctcacaatcatcctaatatccagtggacccatactcatcaatagttgatgaaacgtgccccctgtttggcccttggatggtagaggtagaacattttgtaattaacacaaggcaaaaccgatcgaattgttcgcgccggtggaaaattcattagctattgaaagcaaagctaaatcttccatccaatgcgatacgtgaaaaaatggcaccacctttactcccaaattcctgaattgcgacaattgctccagcaaaatccccaaaatgattcatgtcgcgcattcattca

SEQ ID NO: 16506 - DNA, 4118 bp, Oryza sativa
ggtggtcggcacccccttcccgcctccgcccccctccattttcgccaccacggacgacgacgacctcgacgccccccgcttacgcgcgccccacgcggccgccaccctcgccgcggggacgaagggcggcgccgccgggcccgacagccggagcgcctccatgcgaaatgcgctcggtgatcggtgacgaggtgagaggtggtggtggtgggtggggagcgggtggaggaagaggaggaggaggaggagaggagcgggatttgaggatggcgagggggagaggagaggggatgcgtgcagcgtgcgggggaggggacgaggtagccaaccatctacccctcgagcatcccagctataatagccagctataaacatatatttaaaaaagataaaaaagatgaaagagataatcagcagtctatccatagttagctgtaacacggactataaaacgtaatatatgtataaggtcattcctaacccaataagtaggatgatgtccatagcattaaataagttgccatctaggataaaaagtgatgtgacaagtaaataaatgaggaaagagaaggaaaccatgtattgcatgagacatggtttctacacaacatccaaaacatcatgtgagataagtagcattaaatttaagtagaatagtggtgtttgcattggaagagtagtgtctagtactagtttcttgatgatgtggagtttatgaaaactatgtctagtgtgttgggttgggaatggcctaacaggtgagaccatgtattaatagtatattaagcagctattatatgaattgtctattaaattggctataaatgatttggagatgatagttggctatactattaaacttgctctaatgtccctacattacaatattacaatgtgcttattgtatcattatagtaattgatgtatggaataatataaaggtggaacccacatgtaatggtgttgtcatcatgatagaggatatgaaccctgtgagatggagccgacgaaagcgagaggctgcagtgcacatgcggcacatgggtggaacggaacggaggatagcgggacggttaccttggtaaccagggcttaacatttttatattaatgatttaaaattttaaaactattttttgaaattaaagttatccggttttctttgttagaaacacatgacaaaacctagatactcacaacgcatgtaaactcacccctatgaatgtgtacactatcctctgtgagcactttcgaaagactgagttttatatgttgagattgatgaaaccaccacccttatgagcacttggtatatcttgagattagcgaagtcattatccttataaacacttaaatattttgagattgaccaagtaatcacggacgtcttgctgtcgatgggacaagtgatatgttgcctatcactaaaagtataattaaccataaatttgaacaccgtgttaagtttagaatttaaactcgagtaaactagtttcacgaaaaaaaataaaccagttgatattcgtttactttgtgagagagagtatcattgatatacgtttactttgtaagagatagttggtggatggattagtttcattagtggtgaagactgaagacacgataacttcgaatgtataggatctcaatccgtcctcggcggtggcacggtgacggtgagcgccgctctccgatcataacggccaagctgcaaaattccaggacgccaagtttgcttcttggctagtgcgaatgcaatggataatcatgacgaaaactgtgaccatttcacgtgcaaatacgtaggcgttcaacgttcgctcttccaacttcgtggcttcatttcaagggcgaaaagtagacgttcacgtgctcaggttcccaatatgaaaaaggaaaaattgaaaccataccattataattttgtaaaatttaagatatgcaatcatgacccacatgttattgactcatgtggattctacgtattattgagatatcgatggtatatctcaaaatttgtaaaattataatagcatggttccaaattaccctatgaaaaatggtctgaaatttcgtcgctgttaaaacaaataaatgcgacaagcatgcgttatatttgtccctatgcgtgtgcttatgccaaaaaatgttccatgagcaatcaaaacaagtggagtaagcaagagtatagcaggtttaaatttaatctgtctgtcagctctatgatctggaaagagtgaacagttaactcgagcagagtgcaaaacgaggaaggattctcaagccagaaaacagatgatcgacatcaacttccagtacacgtggatacattctcaagaggaagacacagccacacaggtgacttaaggggaaaatttgcttcattgcagtggttaaaatatagtgcagggaatgatgaattaaccataggtagcttcaggaaaagaagccatacagttaataatcctaacctacgattacatcaaatcctacagacactatgtcaccacctggccgaagatccacagataaatattccatgactccatttgatcctctgaggattctgatcactgcaagaatggccccaaacatcaactatactcctgaaaaatttaatgcctccattgcatactacatccgtcgttaattcgtcctaatatcatcacaatgcagtctttgtgccctgcaggttataacagaagagaagctacgttagctcaggtaatcgcaccacctcaattacagtagcaactgcgcgaggtgatttgtttacctctttgagcttgtcttggaacagaatttggacttctctccggaggtcatccacctccccagcatactctttttgctcttctgatggcaactcctccaactgcacgcccaatctgtacagtacactgctgaggtcacaggactcgaaatctgtggcttcagtggatgaaagcttcagtaggctcttgatagccaacaaaacctacatgacacgcaaaaacagagcaagatcaatcgttatgttgtaacaggcaaactttacagcccattgtaattttttgtcaattggagtaaacattactcccatccttggacacaagcaaacatttctagacctttttgtgcagaacatcagattgagtatataatagtaaaagctatgaaggaaatggctggtaaaatccaagcaaataagtaactcatggaaactgaaagaacagattccagacagaaagttgtgttgctcatatgcatctcttgacatatgacagaagtccttatatgaggaacagcacacattccagtacgggcatatcaaataaaccaagaaatcagcaaattattgcacataagcagcaacaactctgatgacgagtgaagaattttgctgctaagcagtgctaaccacaaggaagtacagaactggaagcagtacagaaccacagataataccttttcttgaaggtcgaggtcaaatcttgacagcatatcaaccaatgacttaagaaaaatacggtcacttaagaaaggaagtcctgaatttccagaatttagctgaaaatctgctagatctgtcactagaaacactgccttcttctgaagccgaacgtcaacactattactcgccaatatgtgctgcaaaaagggaaatgtcacaactaaaacaaaaatgctaatattatcaagaccaggttttaactacctgcaacattgcacttccattttctgaatgaaatgcctcctgaccatttatattgtctctaaccaaagcggatatagcatacagcgcctttgtagcttcttctgcagaagttgcatagcccatcttcactaatcttgccaaagctccataacctaggatctggccaaggatgaaacatcgagtttgataacaatgatcaaaagtgtgttcaagtttcaacaaagaggaatcactactccctgagcttaaccacacaagagaagtgactattaaaaggtatatccactaaggacactgcataaagtttataaacaacaatgatgcagattcgacgaacaaacaagaagatacctgattttggacaagggcattattctgactggctttacccaggacccatgcagaagtggtccttatttctt

SEQ ID NO: 16507 - DNA, 8198 bp, Oryza sativa
cggcggcggcctcaattggcgacgacgacggcgggctggatgggcaacggcggcggccggctggatgcacgacggcgacgatgacgacgggacggtgggctggatgggcacgacgatgaagagagtacacatgtttttttagtccgatcatacccctgctaaatcaacggttagattagattgggatttcatgatacctcgtacctcatggtacctcatagtacctcctcaaggatgggaaaaatgctcaagaaataaagtttgctcagttggcatcagaacaatatgtgttggtaatccaaaccacagcaagaacagaagcatgttccaatctgctgctataagctaggggtatggccagtattataataagttacaaagagcagaaagcgtcataagataatgcattgacaaaccaacggcaacacaaaatcagaggatggatcctgaagcagtatttttcaccttgatctccattcgccgcttgagcagctcatctgcagacaatttctgcacaccctctgcctgttctttcaacttatccggatcagaatttcctgcaccaacaaggtagaactcagcaaaatgcagtcatgtctccaaaattaaccaaacttcatacttcagtaacaataacagcctactagttccaacagcttaagattaagactacaggtggtcaaagtgagcatcacacaaacaaaactataataaattatcaatgtgcagaatactactccagtaactaccactcattcactctacttccaattaacccgaatcaaaccaatttgtacacagctagttgcaatcatattactgggctgaaaattcgccagcgccactgaaatccgctgctttcgcacttcaaaatctcaaaatcccaaagcgaatctaaagatttaatcgcagaatttgggattcgggctgcacgtaccgatcgcccactgcagcatgctgtcgagggagccgaacccacccgcgaactcgtcctccaccaccgacccacctcccctcgactcctccccggagaccagctccccctcgtccttccccgtcgcccactgcctcgccgccgaccggttctccaccccgtccccctccgccaccgccgccaccaccgccgccgccgcggaggccaccggaaggagcagaatagcggcgaggacaaccacggcgaggaggcgatgggagttgggttgcctcgagcagcgcgcccttgctgccatcgccatggccacgagaggagagaggagcgaggtggagagggagaaggtcttcgaaattcaaattttcgagactccagggtggcatctgcatatataggtttctggccttctggagtgatccctaattacaattaaacccttacataatgagatatttggatttaggacctctattagtaccacggcgtgaacattatgtaagggttcacagagtataagggtgtttttgcataagtgccacggcgtggggcccgctgattcggtgtttgggcgtctcccattggacgagtgacatcacatcacatcgacacgcttcctcgtgtgatccgggcgcgtcagccaaagagatctgtaccgtccgttcggcaatggacggatttagatgaattgctttgcgttgcgagagcaatagcaggcccagacccgactgggcgggccctaaatggctttgctttgcgttaggcagcacgctgtaactgggcgggccctaagtgggcccttttatagggcccaaccgtcagcaaaacacaaacaagaaaacgtccctccagatatttcttttaaaagaaattatgtacgtgttaggagctgaacacgagatttagggttgaaccacacatcccttgccactatactgtcaaatgcatctcgtaaaacacaaacaccaaacgtaagcgcaacttggtcttcggtcaagtggcgggcacagatctcgaggcagtagtagtcctaggccgtgtttaggttcaaaattttttcgtcaaactttcaacttttctgttacatcaaatgtttggataaatgcatggagcattaaatgtggaggaaaaaaaccaattacacagtttgcatgtaaattgcgagacgaatcttttaagcccaattacgccatgatttgacaatgtaatatgatgctacagtaaatatttgctaatgacggattaattaggtttaataaattcatctcgtagtttacagacggaacctgcaatttgttttgttattagtctacgtttaataacttcaaatgtgtgtccgtatacttaaaaaaattttggcacacaaactaaacacagcctagaatggttgcgctattctagaatgaacatgtccattgatgcttacatgctactatctcaattctattagtgaaaatggagggcctttgccctttgcttaaaaaaaatgggtggatggtttggtgttgtttttcttttccatttttttctttgaggaaaacaatacttgacatgtgggatcagaaaaaaaaccataggattgatttctccaattcctgatttggcgtggaagaattcagcgcccaaacttgtttttagctctggctggttaagctttgcagaaattgctccttactgcttcctctgatttatattataattaatcgctttgattcttttttttttaaaaaaattacgatatttatagaaaaacacaataatattttcaaaaaaacatattaccaaaatttatttaatattacgaaactaatttgatgttatagataattgctaactttttaaaaacttgccaaagctaaagaagtttaacttaaaaaaaaagtcaaaacgacttataataggatacagtaaaggtgggaagggttcacattattgacgaaacatggaccgaatttttcaaaaatcgagtttatcggtgggtaccgaaaaaaaaacagtatcggtcgaatatttcagccttttttgaatttgcatgcgtgacactatgatctttgactgtctatatgattctttgcacctatcctggtcatttgcggattatatatgttacttttttttataccaaatgctctagatacaatctacttgatttcatgcacaaattgaggcaaaatctaacaaagtttgtccaaaatttttttatcttcaataaaattccgagatttccgataatcatgtttatcggtgcccccaatattttttcatatcgataattcaaacccaaaccttataatttctgtactagcttaattttatcagcacgtagaggagtaatttgtgaatatcaagacaacctattgctaatatgtactataactttttgtttcgaagaattaattgctaaataaaatggagcatggatcattgatcataatcgaaaacctccccaagaagaggaagaagtaatgattatactcctgcaaaagactgacttgtaaagttgtaatgcagtatagtatactccagtacttcctccgtttcacaatgtaagtcattctaacatttcacatatgtatattgatgttaatgaatctaaatagatatatatgtctagattcattaatataaatatgaatatgggaaatgctaaaataacttacattatgaaacatggagtaatgactaaaacgaaccctactcggctactcctctttctgaaaggcgtcgatgagattgtagacgacggtggcggcgaggaggattccagtgccggagccaatggcgccggtcatgtcggcgaggatggtgagagctccgacgcagaggccgccgagcgcggcggctgtcgagatgtagcggctgaggtgcgagcggagagcagcgtcgcgctcgcgcgccccgtgcaaggcgaggcgctgcaccgagagctgcctcgcgacgtcctgagccgacgacctggacacctccacccaagccccggagaagagcgtgcaggacgcgaggagcgacgcggcgtaggcggcggcgtgggatagccccgccggcggcgtgacgtagtaggcgacgccgccgaccgggacggggatggcggcgtaaccggtcttcttccaggtgccgagcaggctgccggcgaaccggctgtagtggagaagctgcgacaccgtgtagaggctggagacggcggcggagtgcagcacaactggcatggtggaggtgtagagcagcttgatcgggagggcgagctgccgtccccgcgcgtccctggaccgcagcggcagcatcacgcggaagccctcgaggaagacggtggcgaggaggacgacgcaggtggccagcaggcccatcacgttcgggaggtggcggcgaacatggccggtcggaggacggcgtggtggatggcggcgatcccctcgaactccgggcccgcccgcccggtgtcgacggtcagggggctgaacacctgccacaccaccttctcgcaggtgttggtggcggcgagcagggagatggcggacgccccgtgcaggccgtagcccttgtcgaggaggtcgtccaggatgttagagtatatggtagttagagtcatattaagataggattgatttgtgtagactctttccataactgtaatccttctttatctcctctccatgtactcctatatataccagtctcctgaggctcaatacaatgtgtctaatatttgcagtatcctctctctctatactatccaacacaggaagatgacggcgacgctggccccgactgggcgacgatgagcacactattgagcgcgccgtaaacgccgagcatgacgtgcgcggcggcgcccccgagcgcgagcgccacgccaagcgccttgcgcgccgcgtccgccagttcgcggtcctcgcggacgctggcgtcgacggcgagcaagcaacccggagccggtaacttttctgtacccggccggctcgtcaagtcgtcatcctttgagctctctcgctttgtctgccgttttgatcaacttgttttgttttctttccctcccgtctttgaatatctgctcatcttatctttgacgctgcttcgttttacgtgctaggaagtgagggttcccgaacacagcattagaagttcgaggaagcacaaatttttaatttgcggtatcaaacttcattcaagaaacaatttgtttgatcttgtcctttagcatctctctccaattgatgtcatctgcaactggtggctcaatatttatgatcggaagcacacaagttttgatctacacacaaaattaccgatatttttcctttataaaccctggtttcatgaattatcgctttagcaattacaactgatatctgtcactaactattatctctctcatgttcactgaatatccagtattaactcctccctttaggccgtgtttagttgcaaattttttcttcaaccttccaacttttccatcacatcaaaactttcctacacacataaactgttgaaaatatggtcataaatcggcatattttaatccaaaatgttaagacaataatcatggcataaacagtgtagggtgatctagtgacaacatgtaacataaccagtagcatactaaatgcatcatgcgcatcatgaatatcaggaacaagaacatagcagtaacgcagtagcatactaaagacatcatgaatatcaggaacaagaacatagtagtaacgcagtagcatgctaaaggcatcatgaatatcaggaacaagaacatagcagtaacgcagtagcatgctaaaggcatcatgaataacaggaacaggaacatagcagtaaagcgctaacaacagaaacaggagaaagatataccccgagaatggccctccgctagattgtgaggcagaattgcctccgttgatgttgttgttcgcggcactgactccagctcctggcgcaccacctccggcggctccagctccaggcgcgccatctcctccagcagcagcagcagcgccggctctaggcgcagacatggtgggcgaggacgagcagtcgtgtgggaagcactccctaaaaacctgatcacccgcctactcggtgcagatctcaggcgaaggtgtggttccggaggccctgctccttccaatctctcgtgcatgcaagcgatcagaagcgaggaggcgagaacagcacaggcgcggaggaggaggaactaacacccgggaaagaagcaagcggatcgttctgatcggactcgcagcctccttatctatcaggagagaggcagtcgtgggaacgtgggatcgtggacacgctgttgcggaggcagtcctgggaacgtgggttcgtggttgcaaaagagtagcgacgtgacgcatgcacgcccgtgtgggatcgtggacacgctgttgcggaggcagtcctgggaacgtgggttcgtggttgcaaaagagtagcgacgtgacgcatgcacgcccgcccgctacgcctcgcctcgcccacgcccacggcctcggcccggcctggcgcgcgcgcgcgcgcgtggggccttccgaccccctacctcaaccagtcaacagggagcctccaataactccctatttaggttgagatattcctcgcttaaatcctgatgtggtattattatccttaacacttattatgggcctttgagatttaataggataaattgggcctagcccaattattctaacaatccccactaaatttcaaggctcataagaaatgttctcaaggttgtgcctgttcgatataccagggttttggtgaagactgttaagttgaacttccacctaggaaatgagctacatcagaccaaaactgaacaatggactatgccttgaattgtctgttttgtgtgatcaggtttcactcagacccttgactggtactgggctgccgttcgcatcccctttgtttggagcatataagtcaaactccaggcctttcatgagtatctagagatcgcccaaacctcatagactgtgactagcagtcgaactcatataggtgtgttccttccgagatgttctgtaggtcaacatctctgcttggaaaagccactcggatcacattaaggcatgagccatcctaccatgcaggaaagaagagaagtacatcatgaaaataagcccttttcaagggtctcttctctcagtcacacaatagtttgtttcgccatccaaattcacgggatctccaatcacaatggacaggtttccactattgtgcaacctttggtgggtatcaagcccatttccctcgatgcactgtctatcacattacgtggtagccccttggtaaactgatttgccagatttctagccgtttggacatagtccaatgctatcactctggagtttttttgctttctgacagatttcagtcttctcttgatatgcctagatgacttcatgttgtcctttgaactgttcactttaataatcactgtttgattatcacagttcattaagatagctggcactggtttttcaactaccggcaaatccatcaggagttcacgaagccactcggcctcaactgtcgcagtatctagtgctgtaagttctgcttccattgttgacctcgttaagatggtctgcttgcaagacttccagaaaacagcgccacctccaagtgtgaacacatatccacttgtggcttttatctcatcagcatcagatatccagtttgagtcactatacccttctagtacttttggatatccggtatagtgaattccatagctcatagtgccctttagatagcgcattactctttccagagcctgccaatgatcatctcccggatttgagacaaaccggctcagcttgcttacagcaaatgagatgtcaggcctcgttgcactagccaagtacatcaatgaaccaatgatttgagagtatctcagttgatcccttgctattcttcggtttttccttaatagcacgctgggatcataaggagtaggagctagcttgcagtcactatatccaaagcgactcaaaaccttgtccacatagtgggattgcacaagtgtaatcccaccctcatcttctctttgtagtttgatgttaagaataacatcagcctctcccaaatccttcatttcaaaactcttggacagatagtccttgacctcctcaatcacattgaggctggtcccaaagatcaatatgtcatcgacatataagcacaagatcactccttctcccccaccatagcgatagtacacacatttgtcagcttcgttcacgacaaagcctgcagatgt

SEQ ID NO: 16508 - DNA, 6147 bp, Oryza sativa
gtcaggagatgaatatgcctcttctatggttcttggagtgtcatccacgaggtatacaatgtagtcatctccaaaggattttgcaaccctttgtctcttactcttacgagtatctacaatgttgtcctcctcaggattttcctcaggcatttgatcattgtgttctatcggtgcaaagtgctcatggggcatgacagtttcttgactagaggtgctaggtgtatgtttcatgggaaattcattctcaaagaatgtagcatctctggactcaataattgtaccaacatgcatgtcgggtactccagagtttactattaagaatctataacccacactgtgaatagcataaccaaggaacacacaatcaacagtatttggtccaaatttccgctttttggctataggtacatttaccttggccaaacagccccatgttcgtaggtatgagagatttaatttcttcctttcccattcctcgaacggtgttacttccttatgcttcattggaattttattcaggacatgacacgcagtcaaaactgcctcaccccaccattccttggaaagccccgcagtgtctaacatggcattcaccatctcagttagagtacggttctttctttcagccaccctatttgattggggtgaatagggaggcgtcctctcatgaataattccaaactcttcgcaaaaggatgcaaactcattggaaaaatactccccacctctatcagacctcaaccgtttgattttcctttcaagttggtttctacctcagctttataggtcttaaagtaatgcaatgcttcatcctttgttttcaatagatacacataacaaaatctagtgcaatcatctatcagtgtcatgaaatatttctttccccctttagtcaacacgccgttcatttcgcacaaatcggaatgaacaagttctagaggtgccaaattcctcgcctcagatgccttatgaggcttgcgaggttgtttcgattgaacacaagtatggcacttggaacctttgaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatatgacacatttattggactcaaacacaagtctaaaaccttctctacacaatagagagccgctaacaagattcttctttattgaagggacatgctgcacgttcttcagctgcacggtttttcccgaagtaaacttcagatcgaccgtaccaacaccatgaacagccacaagcgacccgtttcccatcaacaaggaggaacctctcccgacctgataagaagaaaacagagaaatgtcagcacatacatgaatattagcaccagtatccacccaccaatcaggtggtggaaaatagagagaactgtaggtaatattttaccgtaccccgatgttcctccgccctcgctaatgaccatgttggcagacttcctgtctttgcgctcaggacagtccttggcccaatgcccagacttgccacacacaaagtagtctccctttgcctttcccttgcctttcttcttaaagttggttgcagccttgggtttgacattaggcttgactttcttgttgttgtgggatgcatgagggttcttcttctgtaccatattggcactagaacctccctcaacctttttgccccggacatcctttgccatcgccttctcctcaacacccatagagccaatgagatcagaaacactgaactcttgtctcttgtgctttacagaagtggcaaagtccgaccaagaaggtggcaatttggcaataatgccactcgccacaaacttgtccggcaactcacagttgttgttctcaagttcgttagccagcatctgaatctcatgagcttgttctactacagaacgatcatcgactatcttgtagtcatagaactgctccatgacatacagctcactgccggcgtcagaaactccgaacttggcctcaagtgcatcccacatgtccttcccggaaggcatgtgcatgtacacgtccactatgttgtcagcgagtacactgatcaatgctcaacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagttagaaccatcaaaagcatgtggttttagtgcagcagcaaagccaactaccgaaaatgacctatcaggtttttggattgtcggaaatatggtaataaatcggcatattttaatccaaaatgttaagacaataatcatggcataaacagtgtagggtgatctagtgacaacatgtaacataaccagtagcatactaaatgcatcatgtgcatcatgaatatcaggaacaagaacatagtagtaacgcagtagcatgctaaaggcatcatgaatatcaggaacaggaacatagcagtaaagcgctaacaacaggaacaggagaaggatataccccgagaatggccctccgctggattgtgaggcagaattgcctccgttgatgttgttgttcacggcaccggctccagctcctggcgcaccacctccggcggctccagctccaggcagaatggccctccgctggattgtgaggcagaattgcctccgttgatgttgttgttcgcggcaccggctccagctcctggcgcaccacctccggcggctccagctccaggcgcgccatctcctccagcagaagcagcagcgccggctccaggcgcagacatggtgggcgaggacgagcagtcgtgcatctctcgtgcgcgcaagcgatcagaagcgaggaggcgagaacagcacaggcgcggaggaggaggaactaacacccgggaaagaagcaagcggatcgttctgatcggactcgcgacctccttatctatcaggcctccttatctatcaggagagaggcagtcgtgcatctctcgtgcgcgcaagcgattagaagcgaggaggcgagaacaacacagggcagtgcatctctcgtgcgcgcaagcgattagaagcgaggagacgagaacagcacagggcagtcatgggaacgtaggatcgtggacgcgctgttgcggaggcagtcgtgggaacgtaggatcgtggacgcgctgttgcggaggcagtcgtgggaacgtgggttcgtggttgcaaaagagtagcgacgtgacgtacgcccgccacgcctcgccctggcccggcgcgcgcacgcgcgtggggccttccgacccccacctcaactagtcaacagggagcctccaataactccctatttaggttgagatattcctcgcttaaatcctgaggtggtattattatccttaacacttattatgggcctttgagatttaataggataaattgggcctagcccaattattctaacataaacttccaacttttccgtcacatcgttccaatttcaaccaaacttttaattttggtgtgaactataaacacaccctaacagtcgatatgtagtgctaattttagtcgcaacaggtcctacagctttctcattgaacactagccaggggaatggaatcttggcttcttttccattgacttgaacacttggaaacaactattttccacttttagatttagtatttaactatttatcatccatatctcaatgacatgtgggtccacatgtatctatggcatgtgagtccagtggtaaatagttaattgccacatctagaagtggcgaatagttaaatataccaggacgaaagaatgaggtaaaaactaacaaccagggatgagaaagcatattatcccaatagtatagttgagccaactgcagaattaaactagtggccaaccattaaccaatagatcacagattgctatttttgataatgccacactgtgttggattccctattgacaacggtaagcagtagttctggcatggaaaaataattggcactacatcggtacaagtagatagaggtcggcatggatgtctgactccgatcagtcaatcgaatccaacaaaagcacacggactcgtgcaaacgcccaaattatcatgggtctcacagcaccaaacgttgtaataaatttgtccgagagttaaaccgcagatgcagcatttgtaaatctacatattgaattctagacaaaagttacaccttcaacggtggttagtcctctactctcaccgctcattccctatttccactgcctcatgttcagcaccgtccacccctcactcaagtcatatcgatatataggtcatccatgtaatccactaagttggggaaaaggaatgagtcatccagttccatgtcatgatctgcagtatgcttctgatcaaagcgtccctctgcagtagatcctgtcatgaagcatttctcgcacagatctaaacctggtgcctcacactccttgcatgagtatcttctcccttggattgggaagacctgcaaaacaaacaaacaaacagatctatccattcaaacaggctgcttttagatataatttagatggtaagctttattgagacaaggatcatgaacatctgcctcctcaataaatgcatttaacagctggtgcatatctagccaaaccataataactaagtttggaataagaacgtaccccgcaaccatcacagcccaccccaacgtgggtatgcaatatctctgaaggtttccctttgcgagtgccttccttcctgcttggaacacctgaacttttctcttgccttgagttatacagttcttcgaagcgatgtttcagaaagttcttcagatttgagcatactgtaggttcagcgggatgtggagctccacaaaattggcattcaagttcctctccacccacagatgttaaacatggcatgcagtaaactgttcataaaacaatgtcaattttccaacagaaaagaagtaataacatagttctgcaatattttatcctaaattcgagcttaccatggccacaattcaggaccgatgggtcaaacaaaagttcctggcaaatgagacaagccacatcttccgatctgatcccgtcaactacaaaaaacagtgagaatgaaggagatggtcaggcaagaaacaacgagaactagaggataccccacacagtaaataaggaaggggaagtggacactgaaatagcaggcctctaaaggaaacttttgcacttggcagccggcaaagttcttaacccaaaatagttcgtgttcagcagatcacatgggaattaaagcaatagaggacacaagttggaagcaatagcatatagtacaaaaatggggaaatagtagggtacgtgcgggagacgagcgcccctggtgctcaacgggtcaatgcaaatattgcgagagaagaacgtgctaaggcacaaggtagggggaaagagtaattgtacagtatgcacatgatggtataattactctttacccctggttcttgttcagctggatgaacttatacaatgcatcatgtaagctagttgctgtccagctagatgaaattgtaatgcatcatgtcagctagttgctaaggcgtagaatgtcctaataattcataaatgtagacgactttaaaggttgaatactcaccttcatctgcatttcccttaccagggtgcaggattgaaatcacgcaaccaataagattgcaggtcctcgagacatgtaatgcgccaggcataaacggcagaatatatgcccacaagctgcagcagcacaaaacacatggtaactgagattgtgcaacaaaattgcagctagattagcagtttagaacctcatacacgtgaccacaggattggagataacgcccctgcataacaaaaggaatccaatttgagtgttcgaatccccccaacatgtatgatcgatgcagaatataacaaccaaacttacatgcatattacacagaaaaaccaatgttattcgtcgtcgtcgtcgtcgtcctcct

SEQ ID NO: 16509 - DNA, 6912 bp, Oryza sativa
caggaatgggacggtcacggggggcggggttctcctccctgctcgccatgacgccgccggcgacgatggcggcctccgctcgctcaggcgcgacggggtcttcctccctccctgccatgatcctcccgcagcagccggcgacgggctcacctccgcttctccggcgatgggggctttgcttggggtgggggaggaggcggcgcttggagttggaggcgtgaggactgaggaggagagacgggaggaggacatgtgggtccccattgcagaagccacttgggccggcccattccattctgcgcctgggccgaaccactagttttgttcgcgttggattgtcaagcccaagctccagtttgatgcacaggagtttccatcactttataaatatttgccactttttaaacttttataagatgtggcaattaaggatttgtcactcgtagtctataacatgtggactctcatttgtctatgacatgtggaccctcatttatctataatatgtgagtccaacaacaaattcttaagtgtcacttgtaagagtcgcagatagttaatttatcttgctgcgaagtgccttgtcctggtttgaagaagtgactcctaaaatggttgcattattattgttattactccctccgtttcaggttataagatgttaaactactctaagttgactaactctataaaaaaaatagtaatatttacaacaccaacatagtttcattaaatctataattgaataaattttcataatatattagtcttgggttaaaaatattactacttttttctacaaaattagtcaaacttagagtagtttgactttgaccaaagtcaaaacatataacctgaaacaaagggagtattatttttgaaacagaagagcattaatggaccatgggcaaatcacacaacaaatagtgtcatccctccattatgtgtgatctccacaccagcatacagcaattaccaaacagaaagaaggagacgagctagtacagtttttaactagacgaaaagaacaactaaaactacttgatcccatgatcttcccattctttgttcttccagccacaaaaacctgtctcttcctctgcttcagttcctccagtcgattccctgtttccttcctttgctgatttgtctcacacctccagccgtcttctatcaaagttccagccatacttggaattatataatctcttttgcaacctgctttagcaagtcgaagtgtcgaacccacattgtagacttctttggccttccaccgacctctgcaaaattgaccaggatgaaatccagtgacacatatagtatatcaattctattggatgtgagatcatcttatgctcaaaacatgctttatttctaacttcccatattgcccacagtgtggctgcaatccccactgcaactagttgtttcttctttttgtcaaattcatttaaccaagcttccaacaagtgttgaatgctattgatcttttcaagtccaaaagcacttgcaatcacattgcaagcaaatctagccagtggacaagacacaaacaagtgatctactgtttcatttgctgagcgaaactggcatacaataatacaaaaatggttgcattattgtatgctgattgctgaactagctgctgtacttctactcgagagatcagagatgtcccctaaggcaagaacaaacgaaaatactcatgcccacaccataccacttgtaatgttttactcaagcccactccataccacttgtacaatgcttcgatctctctatgatatttggctgttaccttgtccctccttattttcaaagtggatgttagcaaaccattatccacctgaatacaaaaaaaaaaaagtactgtcaaacttgatagcaagaaaagctatataattactaggtgaaaacttaccgtaaatgattcgttaacaattagaatagggctgatttggaaggagcaacccatcatcctggcatttatatattaacaaaacattcaacatggctctaattaaatcaacatatataaactacacacccttcctctccgactacgacatgccaccatacctaaaaccctgtattggtatgggagactgggagtacgagactcgtaactcgtaaggtttttaattcgcacatatcaacaacaaattacacagtcctactctgtccttcaatgtttaaaaaatcatgtctcaggtgatagatttaactccaatgtgattgtgagttgtgacccatcataaaatcagcaaaagttctctagactattaggctagagaaatcagagctcataagaaacaggagagaaatagttctcagctcattacatacaaagttccaaaacttatcctttggcttcccatcaagaataggctttcttttagccattgctagaacctcatcattgctacaactatgatgtttacaataagcaagtgttatctgtgacctgcagcattatgtctttaccaagatatataatctgatgtgcatttctacccaaaaatgtgttcaccttgacccaaacaactgtttacagctcaatttaatttatagttaaaacttggcatcagtaaactggaaaaaatgatccttgtaatatcccttcatcacttgaggtcctctgactttcacaaccccctttgaaccatctgcgagaacctcactattctctatgctcactaccttgatttccgtgtgctttactgggtaccaactgtgccaagaacctgcaatgtggcatgaactacatatcttagtattatcataagctatacatagaaaatagtataaatgatgagaagtaatgcaaatatgccaggaatacaatagggactcccttctttatgcattccacaggccatgtatgcttccagatacaagtctactagtgtagtaagatcaaatgtttgatgatgagtaaatctaccaaggagaggatgttaataatatcaatgttcattgttgaaggaaaatggcctctcagaagaatttgtttccatttatggtgagtaaatttgcaaggacagactatgaatgatatatgaattcattgtttaaggacgaaattgccactgagaagaatatgctttaaaatacataaaattgtgacctttttttcccgtttctatggaagcacaccatgtatcaaagaacaaaatactaatgaaggcatgaatatttaacaaagaactttattaaatgatatacatctaactcaaaaaattgtccacatgcattggaagacttccaccaccgctaataccagacagcaagttaccacagaacccagagtttatatttgtaatcaacattaaggaaactcccttcacactaagtacttacacaaggattatcaatgtcacacagaaacaggtgcatggggataagtaaaagtacctttggaatcccaattgcagaatggattttcttgaatactaacttctttgccagattatgcaaagaccacagaagtgcagcaacaattcttgccaatagccaattgaccatatgcacaataaatgatggtttgacgggattgctcaataggactattccctttccaatggaagagaaggagataattagaagaaagttggatcttagtggtaaagaatcatgctacacctacaagtagaattcatgggatagaaatttctggatcataaggtcatcatatatgagacagaggatatatgagacagattatgcaaacgtatcttgataagtgcaagagcagccaattttcgagcatttgaactggaagatatgtgtctctgaattgagacttacaaagtggagaagaaacatcagaaaatggataaaggagcaatcattaaacattaccagtttgcaagaaaatgccagcatcaaggacaaaaaagaatgttgcctacactgattgggtgcttcctataaaattagttagagcttatgccattgaacagaaacaatagatggataaaatatagattatgcatcttgcatggtgccacattgaggatactagtgaactgaagtaaatgttacatctctgatacaatttcatgtataatacaatatggaagcagttcatcgtaatagaagaactaacctgtagagagtctcatagaccagtggtactgatacagtgtattgaggttggtaccgttgcaaaacttcctatcaatagagtagaagtcaaaacacctgaacaacatcagcatcttcataagaaatagaaaatagtgaccagaaaggagaatactgtaaagggaaggaaccctatcatatcaagtatgacacttgggtttccctaaagtagattagaaggtctggacctgacgattgttacatttgcttataatatatcaaactcaactttgcagcgttcagtaagctgctaaagaatagtacagcattaggtcatgtaattggtcgcaataaatccttaatgacatcataagacccttgatggtactaactatgacgatgcctgaaatgttaccttcagatacttgacaatcatgtaaacatgttgaattccataagctaagatgaagtacttgataacacgttcatacacatgccatggtggaagcatgcttaggaaactatcaccaggtactgctaatactatcccagaaagttttcatctacaaacataactgcatagaacttaatttggatagaagaggaacaggggttctgatgttcacatgacaagaaatcacatcaagaaaagtacagtttatatttcaatattactttcaggtaaaagaagtgaatgttactgctctttcgaccagatgcaagagatttcagcagataagcatcactccttttggtgttccactggtatataatagtgtggcaactggcaacatcacctgagtaaatgtttcaaagacaacctgctgacctacagggaaaaaaaataaaacagattatgattatatagcacatagttatgacaagacaccatcaaaggaacaaataaaaggttcaagttgaatgtttgagtgttgaacatgcaacgtagccaaaattgcagttgcaaagcataatagcactatcacatgaaatgtcattatcattgtaaaagagaaaaaaatccacaagaattaaattattgagcaagagttttagtcccaagaaacaaattagaagcacaagcgctcatctttaaaaatagcagtcccaagagacagcgcttgggaggaggaggcaggtgcaattagctcagaccgcaagaaacataactaaacaatcaagcaaaccttcagacagaattttgcagaataaggattaaggagtatatttgcaatattgttatgctggcagatctattaactgttttgtagtactggatgtctatctcagtaaattaaaccaataagtttctgttattcaatgccagaaatgaagaaaattaccaacaagtaaaggagactgctgtctgctggtgagtaaaacccccaattcataacctatacactagtgcactagaagagtacaatgaaagatatgcagatgaaatgtggaaagtaactgctgcacttgtttaagagtggtattcaactgagtcataaatttagtgtggcaccccaccggcagtggcgaccaaagattcagtaagaactgatggaccaatgaaatccagaccaggatgtaatcaagtttccattttcagtttgtttgaaagaacggaactggaaagaaaaataaacatactgtgcagttgccttgtgcagtgaatacattaccttaatcccaaccatttgcacccaatcgacatcaatataagtcgctcaagacatgcaaagcaacaaaaggaaaaaacaatccactcctactacctgcagaagcggcttgcctaagtaaaaaaatttctttgcactcatatggtatcagacccttttcatcccttttcgcttggttttcacattcaagttttgaatgaccaatagtgccacaggagctaaaacgaacatgatggaaatatcaaacatccaagaattacacacaattacataaaagtgaacagcagagcacaccatgctggagccaagaagtgcagattgagcttttcgggtttacagtttgcggtcagcagacctccttgtagtgcttatcctggcatctgccagtcccagttacaaggaagccataatatcattggcaaaagtgcgtaaatagactaaccataggatggcggtttctaacacacaagattccagtgatgctagtatgctacttggtgactggcagagtccaaaatgagcagaaaggtagttaggcaaaggcattttacaaagtactccccaactccccaaggttaaacgggggtcattgaacaggatcaaggagaaagtcattgcaaaagagacaaatgactaatgctatgttatactaaaaggtattccatctgtgaaaatgcacttggcagtgatgtttctgtctgcatccttgaactacactctaaataagaggtgcatactctatctgaaaggattatttatttatatttttagccttaattgagtacagtaatataaagaagccaaacttactcgaaacgccacttctccggttctcctccatccaaccaaaacaggtaaaatcgaatcatagattcagtgcggcacccaagtcaccgtacttgcaaatgcaaaagccatggtgttctgaagtactcctagttaccaaaatctactctgcaaaatccactacaccagaatcccatacctctgcacccgaaatcctcgcgacggccaccacgccacgaccatctacaccgccgccgccgcctccgtctcgggtcgcggggcggtggaggtgcgccgtggcatgacggcggcggaaggcggcgagggaagacggcggcggcggcggcggcgaaggcgtgatggactactt

SEQ ID NO: 16510 - DNA, 743 bp, Oryza sativa
  unsure (1)..(743): unsure at all n locations
gcagtagtccatcattgtctcacccttatcagagatgattttctcagcatcatttgttggccctgcatgcccggacaagcccatatcactttgttcttttagcttcccaatgttatctccttcacagccctcttcatttcctggtgaatttctaggtgaagcagatgaagaaatcaactcagattagatatttctccagcaacactggcaagaagattcattgctgtatcatctccagcttgcaaggaatgactagcttcagagtacttgatttcaatcaaagcattcatagggttgaacgaatttctccccccattttcacttgagcaagccgccttttcattagcatctgagcaaacaactcgggaagcacatgcatctttgccagcttcttcagttgtcctactgcgatcatcggtcagcatagcataaggtgatttatcaccttccttnnnnnnnnnnnnnnnnnnncgaactcgaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16511 - DNA, 450 bp, Oryza sativa
gataatgccatcgaaccatcgctgagcggcggcggcgggcgagtgcagggtacacggatcgcgctcggccaggctgcatccggagctgtgtgtctcggcgcaggaaaagatcgcgtcccggaggcctacgtcgtcgtcgtccatggaagaagaaggggaagaaggcttcgggtaagggcaatgttgaagttgaacaatgggcgaaccgcggtctcgccgctgcggggctctggagccgtgggggcagaggcgtacctggaaggaatcgactcctcccgctgggcgacggcggtggcggcggcggcctcgatggggacggtctgaagaagtcagggaggaagagttaggtgatctttctttgtgttctttgacgatcttgattcttgatccggagggcgagccgcgaaggcgtatcgggaagaaatgaatcgagtcgtcggcgcggaggtg

SEQ ID NO: 16512 - DNA, 590 bp, Oryza sativa
aggaaagaacaatgcaggttgcagcagagaaggggaaatcataccaatgtcgcactccgtcccaatggcgaggaccgtggccaggtacttggtgtcggagccgcgcttcttaagcttgacctgggtgtagtgctccacggagtgggcgtttgtgaggacgcccggcctccgatgatgaagccgctgctgctggagctgtactgccgcttcctctgccacggcagggagaagttgggctccgtgtgcacgcagaacaccttcaccacggcgtccatggacggcaccaccctcgcgacctcgtcccagcccacgggtccccccgcctccaccaccgcgtcccctcctccattcgccacgggcttcgcctccccgcggcggggcggggacggcggccgcgacccgtccgcgtcggccggggcctcgtggcgccgcgacttgcggccccggcggcccgcggcggccggcgcggggttgtcggcggcggtggaggccacgggggacgcgggcgcgtggttttcggcggccgccttgtgcttgcggccgcgcttgcgcttgcccttggaggtggaggagggatcgtccatggaggc

SEQ ID NO: 16513 - DNA, 3345 bp, Oryza sativa
ttacacaaaagcgaaggtcagaatatttggaactaagatgtatgttgtaatacgttggatatcttatatatatgtctactgaaaacaaaaggaaatgggtcatattagctacagagggattgaaggaagtctctgtgtcatacggaagtgaaggtaaagaggagccgaggaaagcattccccatgggaggatatatgttagacaaggaacgagaaatgacttcacacacagataaaggttagaacatttgcatttggtatattgcattttcatatatgtcattgaaatatatagagaactaaataaattgtttctatatgggccttgaactagagacaatctcaaagaagtccgcgtatcatatggcccaaaaatgaaactaagcaatttgttccctactgggtatgaacacaacatgtagtatataatacatatacacgcaacagaagctgaggatatttggaactgtagggcactagtgtaatatatttcatgtatttcttatatacatgtatattgatttttttttaaaaaatggccttatgagttgcagatggtctaagggaagtttcggtgtcatatggaagtaaaggtgaagtggtgactcggaaagcatttcccatggaacgatacgtgctagacaaagaacctaaaaggaatctgcacagaaacaaaggtcagaatatttttaagtacagttgatgtattgcattttcatatatcatattgacatatgcagaaaactaaataatttttttctaaatgggcaaccaactttagatgaacttagagaagtctcgggttgtatggctcaaaagggaagctaaaaaatttgttccccactgggtatggacataagaaacataagcatgcaaatgaaggtgagaatatttgaaattagcggatattggtgtaatatatttggtctatatcttatatacacatgtttattgaaaatttcaaaaatgggatgaatgagctacagcagatctaaaggaggtctcagtgtcgtatggaagtaacgatgaagagaagccaaggaaagcattccttagaggagggctttttttaggcaatgaatatgaaaagtctgtacacatagacaaaggtgagaatatttggaagaacatttggcgtattgtattttcgtaaaagttgttgacatatatagataatataaaaatattttctgtattgcccgtaaattgtagaggacctcaaagaagtctcagtgtcatatggctcaaatgtgaaactaagcaatttgttcccaacagggtatgcacatcagaaatatatattaacaagcggaggtaacattagaactagtggatgctcatgttacgtatattgtgtgtatatgttatatacatgtatatttgaaattataaaatgggccatatgagttgcagctggactaaaggaagtctccgtgacatatggaagtgatggtgaagaggagccaaggaaaacattctctaaagtagggtatatgttagataaggaatgcaagaagtcttcagatgtagacgaaggtacaatattttggagtgcattatgtattttgtatttttctctaggttgttgacatattcggaaaaactaaataaattgtttctacatggaccatgaactgtagaggaactcagagaagtctcagtctcatatggcccaaaattgaaactaaacaattagttccccacagaacataagaaatatatatacacaaacgaagataagattatttcgaactaaaggatgttagtgtaatgtattgtatgtctcatataaatgtatattgtaaataaaataaattggccatatgggctgtagggggactaaaggaagtctcggtgtcatatggaagtaatggtgaagaggagaccagcaaaaccactcctatgggaggatacatggtagatatgaaaaacgaaaagtctctgcaagcagagaaaggtgagaacaggatgtgtgcacaattcatgaattaatatattgttgacataatatagaaaactaaatgaattgtttctacatggactgccaactgtagaggaactcaaagaagtttcagtgtcatacggttcagatgtaaaactaggcaatttgttccccatagaacacaagaaatatgtatacagaaatgaaagtgagattattttgaaactaaaggagatgttagtgcaatgtattgtatgtcttatataaatgtctattgaaaataaaaataaatgagccatacgagctgcagatggactaaaggaagtctcggtgtcatatggaagtaatggtgaagaggatacaagcaaaacctttgctatgggaggatacatggttgataacgaacgtgaaatgtctctacaaggacagaaaggtgagaatagaaagtatactcacaattcatgaattgtagttttgtatacattgttgacataatatagaaaaccaaataacctgtttctacatgcatgagctaccaactttagaggaactcaatgacatttcattgtcacatggtccagatgtaaaactaaacattttgttttccacataacacaagaaatatatatatgcaaacaaatgtgagattatctgggactaaaagatgttagtgtaatgtattctatgtaagacatagatgtctactgaaaataaaaataaatgggccatacaagttgcattgggactaaaagaagtctcggtgtcatatggaagtaatgatgaagaggagacaagaaaaatcattcctatgaaaggatacatggaagacagggaacacgaaaagtccctacaagcggagaaaggtgagaataggaagtatgcataaaattgaattgataagtatattgttgatataatacagaaaactaaataaattgtctctacatcggcgtcaactatagaggaactcaaagaagtttcagtgtcatatggccatgaagtaaaactaagcaatttgttccctacgagattcggacataagaattatcaacacacattcgaaggtgagaatatttggaaatagcaagtttgtctgttatactttcatataacttatgaatgcgtctagaaaagcaattagggtattcatactgtaagttgttttcctttgaaccttttgtgtttcccttaaaattgtctaagcacgtacattttgatagagcgatgctattacatatctcggttaccaagagacactaaattttatgttaaaaatatatttgtcacctctcaccatcatccaggactgtaaaatttctcattttgatgactttcttaatcttgtatagcctatcgatatatgcatcggcatatatatatatatatatatatatatatatatat

SEQ ID NO: 16514 - DNA, 10794 bp, Oryza sativa
atgcttgtaactcaaagatacaaagtggataattgtaataataataaaataaacatggttcaccaatctagaaatttcaaccattggcggatcttaatatatactctttccttgtcaaaatatatatctatctttgtatttcaaatttttacctcttaaccacttaagaaatgcatttccttaagatcttattcggtttagaggggattaaagaggattggaggggattgaggaggaataattccacaccacaatatgtgtggaataaatctcccccaatccgtccctcacagggattaaccaatcaaggcctaagggagctaccaaaatttatctcacaagttatactttcaattctttttcaaactctctgagacatatacatacatgtgtgaaacattaattttctttttttttctttcttttctatatggtatataaggatagaatgattattttattcataccgctgttcgctgcatgcgaggatgacttggcatgctcacgtagcaccttttgtgggtccaaggactatattaacccaaatgattaatttgaaagacttatttgaacgatttgaaacctcaaggactaaactgagctcgaagcgaaactatagggatcatattcaccctaaaataaacatggttcaccggtctagaaatttcaagcattggcagatcttaatacatactctttccatgttaaaatgtagctatctttgaatttcaaatttttacctcttaaccacttaagaaatgcatttccttaacggaactaccaaaatttatctcacaagttgtactgccagttctttctcaaactctttgaggcgatatacatacctctagctattctacgttgttggttcattcgcaggaatggatcatggacgccatgttcacgcacacggcaacaagatgcagcaactggccgacgtcttcttcttccgcgacgccctccggccgggctccgtcatcacgccgaccatcccgccgacgacctcgctgccggccttcctccctcgccacgtcgccgacgccatcccgttctccgccgaccgctttgccgacgtcctcgccatgttcgcgccggcgtccctcgccatggcgcgcgagatacggtgggcgctcgacacctgcggccagcgggcggcggcgctgctcccgggcgagaaggccggctgcgccacctccctcgagtcgctcgccgacctcgccgcgtcgctcctcgggacgcgcgacgtccgcgcgttctccgccgccgaccttcccaccgacgccgcgaccacgccggcgcggcgcgggaggtacaacgtgacgtccgtgcgggagctctcggcgatggctggttccggttcgtcgtcgtcgtcggagccggcgccggctgccgtcgtggcgtgccacgacctgacgtacccgtacgccgtgttctactgccacagtaccaagccgaccgccgcgtacgcggtgacgctggtggcggcgaccaccggggacggcgacggcgaaggcgaggcggcctcgccggcgaagatggaggcgctcgccgtgtgccacctggacacgtcgcggtggagggcggacaacccgttcttcgtggcgcacggcgtcaagccgggggaggtgtccgtgtgccacttcctcaccaagctcagcatcgtctgggtcccacgccacgagcaggggggcccacgcgcagcagcttaatcatcatcgatgatgtaaacaagctctacaacctaaagtgaacaatttggcgtggtttgtgcgtaatttgcagcaacggtcgatcgagctatctacttatatagtatgtaaaaagtgaataattcagtttgtcatcgtgtgaaccacatgtgtgctgcatatttgtgcgtgtgcatgttcataattaatatggatattgtgtcttcaatatgggtacatacacaagtgcttttatttaacagactatctaaaaaactgtagtaagtttttaataaaaaaatttcaaatctaactatggccctgtttagatctcaccctaaaattttttaccttgtcatatcgaacgtttgaacacctgcatgaagtattaaatataggcttaaaaaaataactaattgcacgtattaggactaatttgcgagacggatcttttaagcctaattactctatgatttgataatttggtgctacagtaaatatttgttaataacaaattaattaggcttaataaattcatctcgcggtttactgatggattctgtaattagtttttttttatagtgcccgaacactctatgcgacaccctatataatatttgatgtggcacgtcaaaactttacacccctagatctaaacaccccctataattgtaatataatccactataactaaaatataatttgtatataattattaaaataatatatgcaactttatacctaacttatatagaaattatactgtaattagttacagtgcagttacactgtagttatacttcattaaatcatatttaactaagttaaatatgatttattgcgcaataaacttgatttatgatgccagccaaggggggggggggaaaaccttacaccgacaggcgcgtccgacgcatcgttgtctaagagggacgggcacatgtggccgggcgggcgcaccacatggtgcgcacgtggcgccgacaggcgcgtcccacgcatcgctgtctaagagggacggacacacgtggccgggcgagcgcaccacatggtgcacatgtggcgccgacgcggaacccatgcagcaccgatgtgacggtgatcggacgaccacaacaaaggggcgagggctcactagccaaccggctggggagtggcagcgcacggtccggcggtgactgttcgatgcagcagcatgcacgacatgtgacagagggaaagaggaaaaggattctggtgctcatcaagcgtgggtgacgggagaggcggcggcggaagcttgcgatggcgacgagatggtggcggctgacatgggacgatggcgaggatggcgctccggcggccacgggcttcgtggaggaggtggtcggggtgcgttgcagcttggggaaggtggagaaggacagggttcaaaatttcgccgaaacagggtccagaatttctgaaaatcgggtttatcggtgggcacccaagaaaacagtattggccaaaaatttcggccccttttgaatttgccgcggcatttttccggcggaaaaagtacacccaaggtccctcaacttgtcatcgagatacaaaatcgtcccccaatcgcaaaaccagataccagacatccctcaactaataaaaccattcgctttaggtccctcggtggttttgaccccggttttgtccgatgtggcggctgagtcagcgtgggacccacgtagaccccacatgtcaggcaatccatgtcagcctcccccttcctcctctcttcctctcttctacacacagtcacacacccaggcggtagcgcgtcggcagcggcggcggtagcgcgtccatggcaccacggcgaggcggggttagcacgtccacggcgatggctggcagcggcggcagtggcgggggccgcgacggggaagaagggagggcgtcggcgtcggcggtgataagggaggggagggcgtcgccacgtgggcgaggtcgaggacggagaccccggcggcggcccggcggagctcctcggcggccaaagatgggcccggggaggcggtagcgaggcgggaacggtgcgggcgtgcaggtggcggcagcgcgcgcctcctgctgccttcgcgcgccatgccggcgcccgcgcggccacgccctctccgtcccgcttcggcgcgtccggccggcgcccagcggcctcccggctcacacactcactttgacctcccgctctgcagacgccaacatcgttggtcatcttccggtccttcccttgcttgggtgacgacatcaccctgcagcaattcctccttggagactgcacgcgcgtcggtttaagagcaacattaaaaaaatcaaggttttttgttgtacaaatcaattcagttttttaactacggtgtgtgtttgattacccttttccagaggtcagggtcgggcttcttgaggacgatgacgcggtcgagcagagtggcaaggtcagggatgcgccagccgcaattgacgggcgcgacgcggtggcgctcgtactcggtgacggtggtgttgcggcggcggtcgaggcgggactgccgcatgtagtacacctgcggcatttggcatggttggcacgccaggggccgcgtgttgaagacgtacgccgtgtagtcggcacagcggtaccaattgaggaacgtgcgcatgggcatctccatctccgcggcgacagcaccccgcgcgtcaccaccaccgcgaacccccacaacactgacaccgtccactgcttgtcgccgtcgtagcacaccgactgctgtgccacgcccgccgatacggcgccgtcatcctcgatctccccttcctctgctgcctctcccgaaccgcctcgatggcagccatcggtgacgccgtcgccgccgcattggccctcggccctcggcgcgttgcagttcatgacggcggtgggggagatcgcgcgcgggcgggcgatgccggcgctggcgccggcgttgggccgcgacgctatcccgtgcccgccatccaccgccgtcgacccgctccccgccccgacggagctccgcctccagtacctcaccatggacatctcgccgccgccgccgccgccttgctcccctgctcccgcgtcgtctccgtcatcactgccgccatatcgccggccgccggacctcctctcccacctcgcaccatcggtctcttccccacctgtcggccagcagcgccggcctgcccagagcccccagagagaagagtgagagagagaaggggaagggagagaagaggggaaagaaagagaggctgactggataggctgacatgtggggcccacgtgggtctaagcagacacgtagggcaaaacctgcatcaaaaccgccgagggccgccgagggatctattttgaccagttttgtataattaagggaccccatatatctggttttgcgattcgaggacgcttttgtatcccgatggcaagttgagggacctttggtgtactttttcttttcccggtccacagcctcccaaaattttggcccacgcgcggacgcgccctagcccagtcaaagtcctagagcccacttccaagttccaatcccgtgaccccatccactcccaaccccgtgcgccgcctcctcctgttcgagagtcgagaaagaggcgagacgagagctgccgccgacgtggccatacatcgatatgccgccggccggcgccgtcgccatgcatctatctgccgccgccgtcgccattcattgagccccagtgcgccgccttgtcctgttgttcgagagttgagaggcgagaactgccgccgccgtcgccatacatctggatggcgcggacgccacatggagctgcatcatccccctcgcgtgtccgcttcctccaaaacccgtgcggccgtgccttagcctcctcgagaagctcttggacagcggcacagcgcggcctctcctccctcccgtcgccatgcatgcttgatattgtgctcttcgattgcttatatgatgctttgcactcagagagtactggttatttacagactacatactccctcccctccgtcccaaaaaaaagacaaaccctatctttccgtaccaatgtttgaccattgctacgtggttctttgcacgcgtgagagaaacaacccgtgacgccgccgttcttcccttctgtccactccccgtctcctcttttcgttgtgccgccgttcctcacctcagccacgccgtcgctgccgtttctcgcctcgccgtgccgtagctaccgtttctcgcctcgccgcgccgcctccgccgcgccgcctccgccgctgtggttccttttctcgtcacgtcgccgtctagacaccgccactctctgcatgcatcgattcacggtgggtagagctgagcggcgcctcggcgtgggcaagtgcggctccccacccaattcgtgtcccccccatggtgtcgggcagccacgctaagagcccgggtcccctagtaccctggcccttgttgatatccctgccttcctactagcccctcttcaaatcttgtgctcaggtgaagtaaattaacgatttgtaatcagtcaatgtgaatatgtgatttgcgaatcagtgaatagtgaatgtgaatatcagaacgttctgctgatttgctatattgtagtttgtatattggatttgcaaaacatgaagtgcacacaaaagttcaagagaaatatatttttctttaaagacgcaccttgataatgtcattgtgaaggtttaatacgagaacaaaattagttctaaggctaggtttatacttagatgtaagatttctttgaaaacaaggattggcatttcgtgggcataatgaaagtgataaatctagcaaatagagggaatttccttcagcttttgaaatggcttgcacaaaataattagtaagttgatcaggtgattttaaaatggcttagtcacatatattgagcaatataggcgaggaagacataataaaaactttcatggctatgaataagcgtagattaaggtatcggcaagtaattttctttccatgtctaagatcttttttattttaaatatctatatgatagtattcgcacgttttgaacttgcttgttataaattagccaattattgatgttaaatgatattatttctatgtttgtatcgcctttttactaaatttttacatctatatatgatttacggtgttcaaaaatttttatatgtaatatgaacttctgaaatagtactaccagaaaaaaattcctggctacgccaacatatgttattttttataccaaatgatctagatacaatctacttgatttcatgcacaaattcagccaaattttaataaattttgtccaaaatttttctcgtatcgctgataaaattccgatatttccgataatcctgtttatcggtacctttgatattttttttatatcgatagttgaaaccctggagaaggatctgaccgatcggaaaagtggtcttttaccagtaagctgtggcatgcttacgtttgggtttggtaaactacgataaaaatacaaaacttactttatatttgtgctattgtttgcctcttacctctgtaaagtcgaaagaagctcaaaggtaagcttaggcttagcaaaaggagacttctaattcatcttcaagctgtagttctatgaaaaagaattggcagggaataaatccacggttttgatctttctggttagattgtaataaatttttgtcaacaacccaattcacaatatttccaaacgacaatatccactgcaacaatggagggtggagatggagatggcaaggatacaagtggatagaaaagttctagtagctaggaaatggagaggtggaagaagaaaacaggtactcgacgagaatccaagcctagacctaagtcgccgccactgccgccattcgcccgcaccgtccaggccaagcttccgttttgggattctctccctctcctccttcccgtagtactgctgcttttatattctcttcttcttaggctctgttcggctgccattatttttactgtgctgcagccaaccagcacagtgtgttgtttctttcggctgtggcaacacagcggcggtacaaagcagccgaacaggcccttaggctttacatggaacatggtcttgggctgcatcaatagtgtggggcggctgcaccttaggaagcccatcggctcctaacaacccgttcccttaatttttggcttgtctccaagccaatgcaataaactcctagatcccatggcacctttagttctgagaattcttcgggatgtccaaaatacaaaaaaacattcaccattgttcctctagcttgcagttgctgagatgaactttggaaatcaaaaaggcagcttgagtacataaattgatactttccattagataattgttggttactgagtaggccaaactcccatgagctagaaatgtgttcagcttgttatcatgctcagcccctgtttgactgagcttgaatataacaccttacgaattttgcacagaagaaacaaccatctcggtagtccctctagttggaattgcataactattaaccttccatgtagcagtaagcaagagaagaagcactttatcaaaatccattgcttcatcagcccatttgagagaaccaacaagccaacaaatcaccatgcagatgtagtacatgattgagaacttgtgagctcttctctttaggatgttgaaccgtgccaaacagcagaaaagtagcatcaacaacatggtgttctttggcagtgacgatctcacaatcacatgatttagtgcattcttccctcatctaggtattaaattgataatctgaaccatctgagcatctagatcccacactaactgcactaattgggcttgcatgagttccattgggtccataattgtgaatgccttgccttgaagaaaatatttcctatttgcaaagtgaatcattgacttggtgccatgtaaagtaagtagcattctacacatgtattgtttagagttcaaatcaagcataccactagaaaaccaattattgtgcataaataggatgtgctgaacatagcacttctgaccaatgcaagcataagaatgtaagatcaatgtgtgtattgattcttattctgtgatgaacaattggcatctgtgattattggttttgatatttggagattatcgttgaagtggttttggagataatcaattttcaggtgatgatcggattcactgttattttatgtatccggtccgaccgagcagaggttgccggtcagaccggtgctatgtgtgcggtcagaccggccggcccgtggtttgaccggccgatgctgtgtcggtttcggtttcgggttgtttctttggatatccgtgattgtttcatggttatggcttctagatggatactatacgtatgtaatactgttgtttgctaataatgagtcaagttggggatagcttggtctcggaatatggtttctttgtttgtttcatgtgtaagtgactcgatgcctcgagacagtatatgcggtgatagaccgggagtcggcttggagataagacgatgtccgtggtggtcagatatcatgcgggatatatactaaggctagagttgatgcacgtggttggtgaagattccatatggcatacgatggaggtattgtgtacgtatgggatgcggagtcgaatttggaaggagtccaaatttggtacgattggttatgtaaagtttgtatcttgtactagagggtttcctaaggtgtttaggactcttagtatgagtttggttcgtggctttaggctgcctacctcatgtataaatagagggggagcgtgaggcttcccggtatcgcttttcggtatcgcttttgagagcaattgagttgatagtttagatagggtttcaagtttagtcaagatttttgtaaggagtgctgttggtgcactttgtaaacacagagagaagcaataaagtttttatctactttgagagttcttcgatttgtgtttcaccagggttcggcggtccaaccggcggcgcaccagcggtcagactggcaaaaggcggcggtcagaccggcagagctaaggcggttagaccggcgatgcagtcaggcagcggcaggcgatttcgacggttcgaccgatcgatctacatcggtcagaccgacgttcatcaggcggtcagaccagcgcatctacttcggtcagaccgcgatccatcgatttcgagggtaacttttatttccgctaaaagttttcggtttttgggtatatcaaccattcaccccccctctggttggcttagttcttgtgtttcgatcctacaagtagtttcagagccttgtttgcttctttggattttaatcgatctagagtttttgccatggctactcctgttaggttttcaactaagcctcatgttttcgatggaatggatttttctcattggtgtagtaggatgcaatcttatgttatggctgaagattatgatatttggagaaaagtttctcatccttatgtaattcctgaagttattaatactgctgctacaaaaactgagtttgaacaaaattgcaaagctcgtaatattcttttgagtgggatttctcattcggattatgatcgtgttgctcatcttcaaactgctcatgagatttggactgctttgagtaattttcatcaaggaacaaataatattaaagaacttcatcgtgatcttttcaaaaaggagtacattaaatttgagatgaaacctggagaagctttggatgactatctttctcggtttaataaaattttgagtgatcttagatctgttgattcttcttatgatgctaattattcacaatatgagatttctcttcactttttgaatggtcttgacatgtctatttgggagatgaaagttacattaattcaggagtctgttgatatgtctactttgactttggattcgctttacacaaaactaaaaactcatgagatgaatattcttgctcgtaaagttgattataagtctagtgctttgatttcttcctcgacttctttggatgttggtgcttcttcatcgaagtcttctgtttttgctttatttaatgccatttccgat

SEQ ID NO: 16515 - DNA, 731 bp, Oryza sativa
  unsure (1)..(731): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcgcgcccagttgtacatgtgcaatcctttatgcgctgcaccacctaataagaaagaagtctagtgatcgtcgcatgcacgcgtacgtaagcttggatctttctagaagcggcgcgccctatctagctacatattagcgagtctgggcgaaggaaagtacgaccacgaaagggtcaaaaagctccagcccagaaagcacctgctccaaaggcatctggcaagaaagcataagtggcaatcataaaaagtaataaaggttctttttgacctgtcaaaaaaaaaaaaaaaaaaaaaaaagtcgtatcgatgtcgagcgatcatgatgatgatgtcgacccgggaattccggaccggtacctgcaggcgtaccagctttccctatagtgagatcgtattagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncag

SEQ ID NO: 16516 - DNA, 13061 bp, Oryza sativa
atggctcttcaaagaagtgatgtctccatagtgtcttggctgtgctctcaggtattatagcctcgactatggttattgagctattcccattttcatcctttgcgaacaaaccaagtaatgtctattgtctgctgacttgcaactcatacttagcgcgtgctggtgtggatttgatgcacttttgcttcaccatccgagctttcattaccataatttgcacctgctatggatgtttgatattcttaaatcctctgtcaggtcgatctgcacgagttatgcagaatgaaccccattcctctcaaccaaggggtcctgttggcccttttccagcaactagcatgtgacatcgtcaatgacacgcccagaaagcttgagtggatgacggctgttgctgttgcaatcagtccaacagatcctatgatcgctgtgcatgtgaggccgatattcgagcaggtctatggcgttttgaaccaccaacggtcactgccagcaagcagttcctcggaagcgaccaacatccgtttgatcatgcacgtaatcaactcggtgctgctgacctacaagtgataaccatcttcagtagcgtgctctctcagtagctgctgtaagtttgggcaacattcttgcaatccctgtacagataaaattttgaaaagcgaagtaaaccgataaaagttgtggtgatggtggtgatacattgtggctgacaagccaaggaccactagtcattagcatggtgggcatctggtgtaaattggtccgttgtgttccagcccgttctgagctgacatttttcatgtgggtctgtcatcttgaacatgttattcagcgcatgcagaatatagctctgtactgttaacctctgttgagttgctagtttaaaccgtgattttagttcctagtttaaaccgtgcatgagatgtttgttgctgacttgctgtggcccatgagtgatgacctgaattgaaagtgatagactgaaatactccgttccgtaatatgggattttgactttttgcttgcactgttttgatcactcgtcttattcaaaaaattttgaaattattatttatttttttgacttacttattatccaaagtatatttgcacaaaatttttttttgaataagacgagtggccaaacagtgcaaacaaaaactcaaaatttcttatattatgggacggagggagtagcgtattacaagagcaaaatcaccagagaccgacaactgggcattttcgtatcacctcttacaaccggcattcccaataaaagaggttctaatacttactgcaaatatgttctcatggaacagacccaatatagaagttatatactaatcctaatagtgctctcatagcactaagctccgcctgtccatccatcctaatatcacatttcaccattttccggctagccttctcctgtaaaataaaaggattgaaaactagtgccacacaaaggaattaaacctgagtttaaacgggcgccctgaaaaggatgaaaggcaacaaatcacgcaccacaggcaagccaagcacaacacctccagccatgccacgacggcctagccttctgtgccatgtacagatacaagaaaattattcatattaataaataatattattacaactaaggcagctcaaagcttgtctgaaacgttgttgttcagtgcatatccatgcatatacagaaatgacacaaaagaattcaaatacaaaaccccagtaaactagtgatcttgtgcaaagttcaattgaagaggcgcggccggtcagcctctcaacgcaagagtgccatctcgcccccctttaatggaacaagactctctgtgtagggaatcatgttgacaaggtagaaatcctccccgacaaaatccaagccgcctgatctgggattcctgtacttgagccgatccacatgggccacttcctctacagacctctacagaccggctcactgttgggatacgtgtaggctacgatagcataaatcaaaattttctatcgcgtaaaccaggaatcatgcaagtattagatcatagatcgttaccactcgacgcgctgtgcagcggaagaagacgctgagaagtcgaaggaactctcgcgaagtagcgcgcgtcgatgtagaggaagtagtcgatcgcaccggctcgaccttctcctcctcgtgtgttctcctcgccgtactcccacgccgatcagcaccgcaaaccagcggcgcctctaccggtatccacacgtacagggacggaacgccacgcgcagatgtgctagcacctgcgcgcggctagggttttgctcggggagggaagtgacggctagggtttctcatgtgatgcaatgcctccgccggtcacaccactcacgaatatataggatccatcactcgggtctccaaggcccgtaggactcctattcagatccctatccgaattaagcttatattggatctctatccaatccccttattccggcccattaagcgtgcgaccctgtaggttcatatatactcggctgtaacccgaaaactccttttcggtccacgcgtcaacagcggcccctagcagaacgtattgactcactgggcatacataaagatcatatcggctgaacctctagtgtatactagtatgaacccctttgcctcacgatatcgattaagctcaaggctagatatgtgccatcctctaatagcccaatcattcactcgaacctgttgatagaatatttaacttgtgattgactcctcaatcacctttggcatggtcatgcacttccataatctacaacatcaaggggcccagagatatctctccataggaggggcaaatcccatcttgattattcatatcccactacatgtttcatagcatacccgaaaactacttttataactacccaattacggagtagcgtttagcagtccctaagtaagctactacacatgttgagaaccatgataatctcaggtctaaggattcaacaccaacactcaatgagatcactgatgacacaacacatatggctcttgcagtgtctcatgttgggtctatccaacaacatgttcaccaacatgtgtccacattattaatttggtatctctataccacgatccatgagacatgatcatcaattaatacatgtgctgatcatataaacatatttgttccacatatgatatttgatcagggatcctttagaaatagtaacaaacaacattaagagtctcatgaaagaatcacatattcattaaccaataaggagttatctatttcaaggaacattgtcggataaatatgtaaacatagtatgtgatacaatcatctctatgattgcctctagggcatatcactaacacttaccttgtcgtagcggtaaatatgaaaaccaagtccaaggagcaggaaatgatcagcgaagtcgaagaacagtttgaaattccaccccctcatcaggtagattaccgatcgtgtaaagacgatcccattggtggctgatgtcatcagacggagaaggtgatgatttccatatcaccatctctgtcccgaggtactgagccaggcacagttctcctcctagctcgaccaggtcgagccgtgtttcgtcagatggtgaaacaacatcgtggagtacaagaccgaatgtctcatcttgtaaatcgaagcggaggaaaccctgtggaggaggagggcttccctcctggaggagttccttgcaaatgtgccaatacaaggaacccttgaaatacatagggtctgccgtaaccgggtatggtggatcctccgctatggtcctccaacacgaatcacggttgccgatagtgaacacctccatcccggcagcatcgtgagcccactgattgaaatcgatggatcggtcgaaggaccgaacaatcttgtaagtgttggtgccaagatcaaggcctaggcctgcagtctggaacctgctcttttggccatcaggcagcttgaggacatcacctgtagtaaggggttgcaatttcagaacgaaaatctcaatttcaccctcccaccgacaagcacatatctcacccaaaattttcaaaaatgttttcgaacctccgtgaatttggttaaaatttattcaaatccattcaaaatttatcaaactttcaaaagtaccggaattccaaaaaatttcagttgccaccgaaatttgctggaaaacgaaagtgtaaacccttgcctgtagctgggttgaagacgtacaacctggtattggtggggaatataacaagcccatcatagtgcgacatgccgtaaaccgacctgaattccccatgtaggttggtcgcacgcacaaggtgcgcatcgtcctgctcggtctcctgccaacggtagaaggtgattatgttggagaatgtggttggccagggctcttcgtcgtcgatcatgctgtcaagggtgtgcggggtgatgaggaaggacggcttctgctcgtgtctggagacggcagactgctgctgctgcttgagatgcgtggtgatgaaggacgggttggagatggtggcgcgccacgccctgcacacggatttcgaccgggaaagggttttgacggggaggcggagcaggatctcgtagacgagctcgttagggagggatgatgcgccggggtggcagtggtgctgcaccctcctcctcttcctcctcttgtacgtcttgatcaacgtcgtcgtcggctcttgtgggttgcgatctatagctttcttattattcttcgtggcaattacgtccatggtacctaaattaaacacaccaaaaaaagaagactggactcgtgaatgaataatatgggtggaaaactatgagcagaggatgcgcgatgtacttatatttatgaaaagatagagtgacagcaaacatgaaaacgagtcggaatcgccaatctcggatgaatttcgagaccacgcggccgacctgtccgcatccatctcataatcgaatttgccatggaaaatggaaatccaaaatcgactgctgagtagatagataggttcttcttttttttttaagaactcataaatttatttatataatgaggattacagacggagttcaaagaaaatggcatcccagtacatggcaataaaagataagacatagagaacaacatcacccatttagaaggtaaagccagctgaactaagaaaaacatcctccaagatagtccaaacaacaataatgaacgtgatcgataggggactatggcattgccgtgatgaccacgtccacgagcccctactgaagacgcggacaccgattgacagactggtgaccccttcggctgcctccacggaaaccgcgctattggaggtttgttgatgagtcataaatttatcttaagcttcatcggaccgaacaaaatattgtcaaggagttctccatcaaatctgaagagcacatactgcaatcctatcaataagaatcgactagacagtctatactcaacccgaatggagtcctcaacttgaatactactgcaaggagaattgaagaaagtctccgtaccccaacttgccttaaacatgcaagaattaggatggcggcatttggcggaggtacgcgacaccagaggtcgaagggataatgttctcgcagagagcttcaacaagcaggagcctgagcaaccaaccaacaagcttgccaccaagagatagattggtggccttcccgcgtctccgcaaaccaagttgcaacgacatcaccgagaacccaccggcaaaagctcaacctttcctctacgtgcaccattcctcgtccacgcgtaatatggtaatgaccgatctccacgtgagtctgtgtacaattgtgcgagcgagatcgtgagctggatacgcgagcatgctgggactatgagtatataccttttagcatgtttaaatgtgactcttatgttgatgcgaaaacacgaggcctggaagatctgcttaacttcagtgcaggtccaaaaatcttgcttttaggttcgtgagtgtgacagttgatttgatcctgcaatcaacaagaaataaagacaaagaaaccgcagttaaatccataaatgaagccgatcggccaaccgctgatgacgtatcatttatctttgagccgatgtcatatgtgaatcgatcggcaatcatgaataagtaagaaagaactaaatctactcgatcggctgtagatattaacaatatataatctttatgtcgatatatacttaaatcaagtgattgggatagatcggtcaccatgtcgagacagtataaatcacttagatcgaaatatatattatcaatgagattatagatgttcataacatggccgatcagatagatctagcatgtatcggctaatactctaataccactctatattaagatattaaagcaagtaaaatatatcaaacagaagcctaatatacctaaatgcaacaagatcttaacataaagggcggatttaacatatcaatgaaacatataagctataaagtagttaaatcaggtaagatcgactgaaaccccgatactaccctaatcggcaaccagaatgcaggctagagattgaaattctaatcatgacttataaggtcaaactcaactgatgcagctataagtacaaaaggaagggcaatatctagacaatcaagccgctggttgtttcatagagtggtggatatcctgtataatctagtcaacatagatatttaacctaatcagctgccttccaataatagatgttagccgattgaaggttagataatgatattgtcgaagattatacagaatatatgataactcgacgaattacataaaaaagattagagtatcataaagatggaagcactaatcccgagccataacaagttttacctctagttaaagatcgaaaccgatgcagctcaacccgaaagcaagaactcatcgaaacaaaacgaaagtaaagggtggcgatgcgccgagattgtattgaacgtgtgttagattcattacatggggctcggggtctatttatacccgagattacaaaatatgtccatatcggacacgactcttatctctaacaaactctaaaataccataagtctttgcggcagacttttgcccaaacatatctctaaggaaattacatgaaatatcctaattaatagatacaattgcctatccgagagctttgtctccatcgcggcaatcctcataaaacacctcgatcgattctagaaacatcttcgagaccatctttatctggatcggctgcatcatctctatcggctatatcggctaccctctgtccgatccatttcagccgatgcagactccagccgatgccttcacagccgatgcattctctgtttttcgaattgatctctatatcgaatccgcctcgatcccaatgtcaaacctggttcataatttaccaaatttggtcgtcaacatcttagcatttgacaattcattttacccgtagcaaagcagaggcatttgctagtttaataaaaagttgacttcaacaattttcctaattaccttcctagaaattagaaaccccttccccgtccttctcgctctccactagtagggagccggctccgataacacatgcgggatgcagagagaacggtatatggagagggatcatgcatgaaggaggtggacagtgatttatgttctactagcaaagtgcatgtgcgctgcaatgggaaaaaattataataaacgtgagattattgagtttaaattcgtgaccggagataacattttgtactttttcaatgaaaccttatatttcttttcatatagcgtgctagagtgtaccatggtggaagaaacttttacagggaaaatgacataaaataactttgtttaaaaaaccaaccagatcatttagggcccatttgtaagtggttgtttattagattgtcaatgcaaattgtttacttaattaacatgatgaatttcctatgcattgcaatgggtgaatgtgattagggctgggcattggtcttttccgttaattttgggtggcagcggccatccgcagctgagcgtggtcatgctggcaagtgagagtgggagagtggggctgatatgcttcttaaggtcatgaacatggatgcagagagcaatgacatctaaggtagctagagtagggatgacatctaatcaacatggatgtggagagcactgcgatgatgttgagcaggtcagcagtcattctcctccatagccgcacgcacacacgagtgcctcgcctcctccagcatcgttgttgcctgctacccaacagggtgcgaacaacgccggtgagctctccctccccccaatcggccttctacccctccctcacctagtttcctcctcctccttctcaagccaacagttgcaaggtgactctatccagctagatccccgtctctagggggcttagagcaagtttaatagtactgctaacggttggctccaaaactatctatgtcaagaatagagtaaacttgtaaaatacagtagataatagtttagctgttgttcagctacacacggatatccatgtaactatctgtattttaatctatctttcccacttctctctctctggtcatccctatccactcattccttcccattcaatgttttctctctctctctctcttagcatttcacagcaaagacaccaggaatagttgagcagcagtcgtcttggagcgcatgtggagcatgagataaattagtcaccaacttatctcctctttctctctctctctccattatccccctccaactcacttgtaatcttacgtggaacagatatcgccggtgtttggactgttattgtatctgctcttatcaccctctctcttcttatttctctcttccacatggacacctaatcctacatggcatctttatagccgacacgtacttgcttggcatgcacaatgcataatgcctaagctagttctaaggtgggtctcggtgttgtatattgccacccccacaatgtatgtgtaaaaggtgagtattaaggtggacaccacatttcaagagaaagagtagaggagagagatgaaagatatactccgtccgttccataatataagggattttgagtttttgtttgcactgtttgaccactcgtcttttttaaaaaaaaaattggaattattatttattttttttgacttattttattatccaaagtaacttttcgttttttatatttacacaaattttttaaataagacgagtggtcaaacagtataagcaaaaacttaaaatcccttatattatgggacagagggagtatttgtttatttcttatgtctagaccttatagggcttaataccccctctatttccacgttgtggatagccgaagacccaaaaatataaagtttaatcctagtgtgagatgcgtaattttcacataaattcagtgttgtaggagcagaacatcgacttagaatcgtgcgtgttatagttgtttccatataaattgcatagcttgaatacaatctaaatatccttagatcaaaacacaaatcagattatattaactcaaaccaaatattgatctaatttaatcagatttggagatccattggataaaataataatagatatacacttaaaagagaaaaaaaatgtttatttgagcataaatgaatgatacgtagttcattccctttaaataacaatgaagctgccataaaatgagtgagcattctcaaacccaaaactggataaggattttacatagtgatggtaagaaaagaatattgaagcacgaattcagaagagcgacttaaaccatattcacatttattaaattcagtattgaatgtctggacagtataaatccaactatagcgtacaaacaaaaatgccagaaaaaagagggagcatactgatggttcagattgaagaatcatgttgctttttcccagatgtgctaatctgaaattagtcgtagttacaacactgcatctctactcaaatgaccacattaagcaaataaatatctgatgttgataggaggcctctaacatggacatacaaatgaacgagcctaccaaaatcgaaataaagcatggcatgggagtttctcctcgggtatttgccaagtcaccatctatatatcctttgtttgttcagccctcaccttccccttatttacaacttcagtcgctttttgtgtgctcaccgttttcattgttagtcgctgatgaagtagccccatgctgaaacatttgcagctggatttgcaacatctggaaaaaggaaatgatgttatgaatcctgttgggtataaacaactaacataaaagaatattactgttcaatgttattccgaataagtatgccattggaaaataaggtgaagcatatttttttttgctattttggcgcatggtaacgaatgccaaactgaaatgatctagttctctattctcgttatcgttaattagtctaatgaaccatgtttactgtctaaagttagttgatgaccataatcaagcatttaaaatgcagcaatgtttacacttgtatgctgcataccattctgcagtgcacctcaagatatgtccataacaaagggataggtacgtcaaataactgatattacaaaataaaactgcttgctggcatacctatagacttatattacttcatagccgtcacatgaatatggtcaaacaaattaggtgcattcatttcaaatcattttacataacacccacttgaaattaggtgcatttgaaattcaaaatcaacccgtatcaagataaacataaggagcacaatccttaacaaaaacaacagataaaataaataggaaaaggagaaagggctatgtagagcataattctctttctcacttagctagctcattttatatttttcattcgagttcagtggtctcattttatatttggaggtgagagctcttactaacaactttcagcctatgtgcgtgcaaattcagaatgttataaagttatgcatccatatgacacccagtttcccatgaatctaagtcatcaatgtctaacccaatggctcataccaagcatgtaacttgagtgcagttaaagatgtgtttacaacagacatatccagaaatttgcatgcagcctgcataagcctctggtttgtattaacaaatgtgacacttggtagtgccaatacaaaacatatatcatgatttaagttagctttaggaatcaaattgcatccttacctctatctggctctttatagcattttcatatgccttctgcagtgaactttcaagttccctggtagttgtcactgaactaacagcaccacgtgcataaaaagtaggcgctgaaggatcggcagttgcatggccttttggcgattgattggaagtacttgcttctcctgattgtggaccatttgatgtagactgtggaggagttgaatacctatgttgaatacatgatacttatcagtgtcaggacacacagagcaaatgacaaatgattacatcttgctcagcttataaaaaaaaagtattagaaacacatttcattaacccaaccttggttacagaaatacctttttttgtgggaattggttacagagacagttaagaacaaccaaatatgattaactatgtagtactccctccattccataatataaggcacaaccacttttcttagatgttccataatataaagcatgcatgcaagcatacaattaattatgacatcttctctattaaattattactttttaaaatcctccactctcatgttatctaatcctattggatgcatgcattatatttattaggatgattcaaactataagatgataataattatttcttggtctttgggttaagggtggttgtgccttatattttggaatggagggagtataagcaaatgctatgcaaataaaaatcacaggaaaactgtgaataaatcgtgcaaattaactcttctaagagtaaatttcacaaaaccagactatcttcaggtaaatcatcacaaaaatcatgcttttacacaccaattttaggtaaccatatttccttcacataacatttcactactctttaaggcccaggctcactcattgttctcacaagcttatcttatttccatttctaatgcaaatgtatttatcacgaaaggtaagatatatggattacagataagcatgggttgagtgaagttccttttttaatacgacgtcatgtggaaaataggtactagacatccttaatccacaataaaatacattggggcatcgacaactacattcatgcaagcaaacaacaaagagatagtgagaccaatgagtatgctcagcctattggagatgacagcaacactcaaaggcataatgttaaatgtcatgagagagagagagtatgcctagcattggaagaataggcaaaaaaagaacaagctctacaatcattatacatcatattaatgaaccatcagtacagcacaattaaatttataatcatccaacaaagttcatagatatgtacttagtcacagaaaaaaaggcagtttgcaaaaaaaaaaaaagaatgtctaaactttgtagaagtcacaagttccattatccacaaaagaattttcagatttggcatttgttatcatagttattaccaagtctgaaatggaattacaaaaaagtttgcagtagtctctcccagcaaaaagtagaatcagtacctgttcaaattgttcgctggaggataagcaaaggatctcccatatagggaagcagccgaagcagctgcttcaagttttgcttggcgcctgcttatgttctcacctgctgctcgttctgaacctggtgtgccattacctggaactattttttattatgttgaattagaacaaagtataaacgttgtgcaaaatgatacaaaaaggtttagacagtcaccaggctgaactccaggatgaactccatgcggacgtgctgcagtacgcccattatctgggggcagaattggagctctacatgtagggcaagtgtgttggcgttctaaccatgacctcaaacaatg

SEQ ID NO: 16517 - DNA, 753 bp, Oryza sativa
caggaagaggcagtcgacgacgagcaggaacagcatgaaggagacgatcctggcgtgcgacagcatgggcacggagggcgtggtctcgatgtactcgaccctcttctgcgcgagccagtgcagcgccttgacgagcagcagcgcggcgaccatggcgaggaaggagacggagaagtcctgcctgaagatggtgaccgcgaagaggatctccaccacctcccgccacgcctgctcgttgagccgctccacctcggcctcccggagcgtccccaggaagagccgcttgacgagctgccaggcgacgcacatggcgacgaggcccgtgttgaggagcagcacgaagcagatcttggaggtggagaggtacaccatcgccgggtagaactgctccctgctgctgaacgcgtagtacaccgccgtcgccgtcgccatcaggctgaacgccgcgtacgtctgcagccgaatcatctccgccgccgccgccggcgatcccgccacaggctgcaccaccacccaccacccaccggatcacaaaattagcacaacaaacaaccagctcatcacgaatcaaaactaaaaaagaaaaagggacgggaatcgcgacgatatcgcgaaccccccacaaaccctagaccagatccaagctgctcttaccgatgcgattgcgagcacgatggtgatggcgggtggattctccggctctaggaggaggaggaaagattgggcggagacattgtcgcggggatttttttt

SEQ ID NO: 16518 - DNA, 5800 bp, Oryza sativa
cttggtgggagaatgggcgtgaggcgagagtggttgtggacgctgttcaccacgtcggatgagaacgcgtgggtgggtcgtagactagtagctggtgttgcccgtatgcgggtggacttggttcatggaacggttgtggggtgcgacgatggcgtgtcgctggccaatggcttgtcgccacgtggagattgacacgtcgacctgtgcttttttttctttttgcccttgggaattagtttatagtgtaggaatgctaggggtggtatgtctatggacaaatgaactccatcagaagtttatagtgtagcgtcattttacgccatttgatctgctcagttgctgtaaaagagctgacgtaaaataaagatacttagaaaaatatatgttgtaaaatgatgtaaaatgacgctacactgcctaaacttctgatcgaatctaatagctgacgtcattttactcattttacgacatcattttttaaaaaataaagacacttagaaaaatatacattgtaattttcaatatttacacataatcctttaagcactattcgttttggaggaatttcagaagatttggattcctaaagatcgaagcgtatgaatgtcattcgattcctaggaatgtagagataggaaaactaaagaattttttttattcacacaaaccttatgaaaaaaaatcatatgtgcatacattcttattctttcacttttcctattcctatatgttgaaattcctccaaaacaaatagacccttagcaaaaatgcaacagtacaaatcaacacaacaaggaaaaaaacaaaagagatactactagaaacgtataaatacatcatgagcaacttgtgtgtgcctagcgcatacaaagcttcccatttttttttggcttatcagctccagctaaactttatattttgaaatttaatttagagtagactttgagagattttttttatcatagtttacttttcagcattaattttacattatattggttgtttcatttatttttctacatcttatcactcatggagcaaatgatgaggctaaactaaaaaaaactaactgaagtcactcgagaaatgtgatggcagttttctaacaaaaccgaaaagagatttggtagtcaatactgaaatttggcaactcattagattgcaatattgtccacgagctattagacaacacgtcaagtgcaaagatagtgcaatcaagccaaactctgaaaaatggaatagaaatctaggagtataatttcttatgagaaacaaaatcaaacaaaaatcaactggcgagggaactcgagttttatctatgcaataaaattcataaaagtttaacccacaacaaaaaaactaaacgtttaacattagggcagcaaaaggcacaccacacataatgagattgaaggttgtcggaagctagagtaaataatcgagtggcaacgtcttatattctggttgaaaattcataacgatcttgtcgaaattgaatggcaactcaaaaaggataggaaagaaaaggttggcatctttatttgaaatcaataggcaactcaagttgccagagaaaatattgcagcaactcgagcttatacaaacgaacacgtcaaaaacttcaaagaaaaaccaggtatcgaagtctggttgaaattaaatagcaactcgtataatcgtattacaagaatcaaattgcagcttgaatcccttgagggttgagccacatttcgggctatcatatcagagtagcaaacctcaccagaacttaacacagaaactctgaaagaaaatacgagaaaacacacttttggatggacatagctatatatgcccatgtggccaatggaattttgtggtaagaattcagagagaacttttgtttacgtctgtccaggaaaaaatagttcatgttgaggcagaaaaaaattttcttaggtcttctcgttatgtacccaaatgagctaaggtagaatacaacttattcttttcgctgttcaccaatggaaaagaaagggaaaaaaaagcaaacacattcctatatcagtacaactatgataacacgaaaggacacgacttattgagcaactgctgccttcttctttggtggtggattccccccagcaagtagcacatatgagtagaagcagatcatagcggcactggtaacacaagaaatagtaagaggaggagcaaaaggctgaaatgaacaattcattcaggcaagaaaaaagataaggggggattacctgagtgcagtgtaaaaagcccagggaagcagtttctttgtctgacataacaggattgataaatcagaaaaagagtaagattcagaattcttgagaacaaagaggaagtgtcacttactgtggtgtacgcctggaagtgcttccatgctaccgcagcagcaacagctgcaaatgatgagcagagcaggttattcacagtcagaactacaatcttgcttataatagcaatctgggttcaatttcgaatatttctgaactcgcaatcgagcataaacaatgaagagatatatcctattatactatcagatattcaagtcactgcaaaatcataacttgattcattgaaacctgagaagatgttaagttaggaaatggcgatacctgcttgtgccagtatgaatggcaagcttgacttgccactcctccaaaccttaaggctaagcacaccaagggccaatattgcaaggccaggtgcaacaccgaaagtaagacttacggtactcctccaaaacagaaatccaacaaggcccatggaaaataaaattccacctgaatttgaacaattaaatgttagtaggactcattattataaaatagaaaaaggtctcattagcctcctagaacactatgatcagtctatttaacctcttgaagtatgaaactgagcattcctagggtatgaaaacaggtttaaataacccccccccccctatagtggttttggaggtgctttcaccatagtggtagcagacgtgctaatgatgtagtcactcacttgggttggctctggttagcaatgactaagggtgttggtgccagccacagcgaaaggtagtagctaaggaataagatggaagtccacaatcagtcgatgacatgtaggaaattacctaagtcatggcgaaaccacctccaaaacttcatattttagggaatataaatctggtttcatattttagggggaaactttagaggacagaatggacttattcctagagaatatagatgcaacaaaaaataggataacagtattggagcatttaaccagcctccacaaaaagatgacacatacaaagattcctcaactagattccatagtagaatggcagagggcattatgccctttagttaggatgtgtttagttcatgctaaaattggaagtttggttgaaattgggacgatgtgatggaaaagttggaagtttgtgtgtgtaggaaagttttgatgtgatggaaaagttggaagtttgaagaaaaagtttggaactaaactcggccttaaaggattactttaagatcatgaaatgcaagaatttgaggacatcataaataataacagaactgaaccaagctatgtttttaataagaatcaagtaacagtcagaatgtcagaattataaaatcaatacagaatgttgctttgaaggaagttgaagtcataccaaaagggatccctaggcaaaagtcatgtattattgcacccttgtgttgaggaacagcctcttggtctatgtctatttctgcattagtaggcgatacagtggttggctgttgattttcatcttctgtatgctccgcgacagcattaggatcaacaggactgctggtatactccgccttcatgcacattgctatcaatggctgcaaggccataaactagacataagaggaggaaaagttttcacaaagataaggaagaatgtaaagactagtgggcaaggtatgcctaacttcgtctcagaaggaagaatagtaagttacttgaataggagaactgatatacattcatctacagacatacataaattcatgggattcaactaaaggccattttgttttaataaaatatggcctccagggttccaaagataacaaaaacatgatattgcaatatcaaacaattcataattatctcagcacaaaactttgctgccaacaaaatgatctttgcttagacattgagtggtctgcaggaaccaaaaaatatagatcggaatcctgcaaggtgcaggaatttaaatattagaagacgatcagcctgtcatatagatactatctcgcagcttacctaggcttggtttgacaaattgtcttttaatgtcaatcatcataaatggaatgttcattggtctatacaatatacgctcatctgccatgtgctatcgtccattgcatactaatataatcttgatggcccagcatgtatgttcacttctccatattgaacccacttgtttatgccaaaaacatgccaacagaagttacacgacctgcggtatcccatccagggatctcaaccgcagcaatacacttgactaacacaattattatgctctttacatagatgctaatgactgatatccaacagatgtgctactacagcattaataccactgctttagaatctatgtaaatgagttcttgagagagtatggaagtgctatcatgaatgcttttgtgagaccaggtagccataaatacctcataatatctgttatatagcagtatgtgtttataggatttatcacaatattactcccaaaagcatattacatttaattacacaaggtttgtacgaaaaggttatagttcccgaatccattcttggaggggagacgttattgcagagcacagactagctggttagcacataatacagaggaatcactgaaatcaacaggaattcgccagcagacatggcaacaataggagtgctaaagcacgacgtgatgttccattatgtggtgcctgtaacgttcccattcaattggcaatgtaagtaacaaaaaaatggggaatttagttatttctttgctttctaagaaggttttaagttaaacatatagagaaaataaaagaaatatttgttacccgaaactgatgtaaaaatacataggctagtgatagttgacctctaattttaatttcatgtttctttttaaacaaaaacatttcttgttgatggaaatgatacgcagatctcctttgcattcttggtaaaacggagtctcaacgtgtttggtttgtgtattcctttcttaacacaatgcatttctagtttctaccctgcaggcctgcaccatgtcatgaggtagtacatttctaaggaattcaaacgcggctaaaatcactcgatgcgctgaaaacctccagcggcgcggtctgcctcccttaattttgccaatccatcacagccgcgaaaacacttaaattccagatccaggaggaggaggaggagaaaaagaagttacagaaacctctctcaccttgggcagcacgacgccagcgggaaccccgcggagcgatccccgggcgatcgacgccgggaccgtcgacgtagcgagcggcgcgaagcggaggacgccgccggagggggccggccacctcctcgccgccgccgccgagggcccgcggagctgcgccgccaccgccgccgccatgtcgatgttctctcggtttggacttcggttcccgacgcgtggaagccggaaggggagaggagagggaggagtcgtcgtgctcggcggctaactctccttctggctcctact

SEQ ID NO: 16519 - DNA, 12019 bp, Oryza sativa
gggagcgagcggcacgtggggaagcggaagtgggtggacggcttgtgggcccgaagggacggcgcactagcgtgggttacgttacgggctgcttggcccggtgggaagggggtggttgtttggtttgaccattttgattattattataattgtatttatttatataataaaaataaatgaatatgtgaaaaaaaagatatacttctcacgtcaaaactgtagagggaaaatatttggttgatcatttagtattccctctttgttataaatatttgacacctagaataagatttggtcaaaatttttagattcacatcatcaattttattttatgttatactactaagtttataaaatatgtaaataaatactccatccttttcatactgtacggtgacttgtttctaagtcaaatatttttagtttgataaaatttatagaaaaatatagtaaaattttcaacacaaataaaaatgatattaaaatatattcaatgtgtcaacggggttacccatatgccgaatgaatagagtattggggtacgttggtacgaggatctacacgatacgacatcaggcaaacaagaagacaagaattatactggttctggcccctcgtaaggtaatagccctaattcagcttatatgagattgatatggaaaaaccacggattacaaatagagaaccaacaatctcgagattaccggcgagacccttgttgagatgtttcgacgagatctcctggtgagtacacttcacgtcctccagattgtaggctacagtggtggtggtgttggccttatgattcgatgatctggacccctcagggggtgtgccttttataccctgaatcaccttagtctttaagtagaacttgaatgctatagaccctgcacgatatagtataaacccaatcctctccgagtatgattctgctattcacttgcccgtgaggataatttccataatctcgtgttaatttctttatcgtatacggaaatatattgtacacacgaaggtacgccatatctgtatattccataagtcgtaggataggaggtatgtcttatccataacatgacacaatgttagatttaataaaacgaaattggtgttgtagatattgataattttttttataaacttagttaaagtaaagaagtttgaatagggaaaaagttaaagcgtcttataatatgaaacagattgagtacatgatattattatagtgattttcaacacaaatcaatgtatacctctttttagattacacattcaaaaaaatattgatggtcataagttcaaaagtttaaccgaatgatggccaaacgtcaaatatttatgactgggtgaagtatattaactaactatatacaaaattttagtatgttatcttgaaaaaggaatattgaaaggctttttataagtcaaagttctattagtttgatgaagtctatagaaacacatagcaatatttttaacgcaaattaagcatactatcataatatattcaatgttagatttaatgaaacgaatttcatattgtagatgttgctaaaattttcttcatagaagtttaacttaggaaaaaaaatcaaaacatcttataatattaaacagagagggagtagattaaactagcctgaagctaactgctggtcaactttgcatagaaagaattattaaaattttgaaaaataaattttatgaatccagttaaaatgagttgtgcaaatgttgcagcattaattgttatttttgaaagtgcattaatccccctagtgggttatggtgattaatgacaaatgtggttaagggactaatgagtttattaagctactttcaggtgcattagtccaaggtgtggaagatggatgcttggagaccccccaaaagtataaaatcaaagcggaccggaactcgaggagtgcataggataatttatttattgcaatcgagttttaggaaaaaccgtactattaagaggggttccaggtggtgctctgagatatggtgctcttagtgtgaaccaagtgacaattttccctagaagtcatttttgcaaatactccatctgtcaaaaaatgcaagtctggaacttcctgtcttccaggtccggaagttccggtctggtgaaagagattttcctatgtattgttccgaagtttctgtcttccaggtccagaacttccaatctaatttccagttcaaaattgttagtaacggctagatgacgtcacctagctgttatatctaaccagcttgtttccagctctttctttggccattccactttcccttttcgaccccagagctgttgctagcctctcccaaatatttcttgccttctccactcaatcttgagcctaattctagtgagaaagagagattgagggggagagaagaagatttggagatgtgtgaaaactaggatcttgggtgagcacttggtatatcttgtgggctgacatctcggtgcctattactcttggagataatctcctagacggttaggtgtcacccgcgagaatccgttgcatattgtggatgtctcgggtaagtttgtgaaggatctcctctcctccgaaagggaacgaggtaagttaatgaagttcttgtgctgagattctagaggttttccaagtagagcaacccacacttgtggtgaatttctagaagtaggttaagttggatcttggtgatcactcaattctagaaatttgcctaggggtgtttggggttgaaggctgaggatttcctctagggtttttgtacaagtgaggcaaggggttaattgagacccagctctttggagctcctcaacggagagtaggatcgcttgatccgaacttcgggaaaaaatcgctcttatctctttctgtgatgtttctgtgattgtctctgtgattgtgtttctgcttagaatacctgtgaatcatcttgggagaactggctaagtttactgttctgaatcttgaattacatccaagtctctgttatacccggaagttcctgtccaaagaacaccggtagtttcggacctggaaaacgggaagttccggtgttccatatcaggaagttcggggtctgtttgaattttaccgctgcgatttatttttaagttttcaaggacaacctattcacccccctcctctaagcttcatcagcacattcaattttgtcatatggccaaaggcttgacgtatcacggtcctttctcagcacaacaatgttgtctagctgtccaaactacagtgatatagcttaattgtaaaagcatctgcaatgtaggggtgctaaaggagagagaaacaaaagactgttgggccttttgcatgggtactaatccaaaggagagagaagaaattgtctcaagccaagaaccaggtaagggcaagttttataaaagaggtagatgctacatctaattttaaccagatcatcaactaataaatataaaggtaacatgtataatatattacatctttgataattctaatacactaagtcccaatgtttatttgcccaatcactcttcctctctctccttttgtcttgaattttgtgtagggttgcctcttgcatgtcttctctccttcacctcactatttaagctcatgtggcatctaggagattatgcttggatgcttatagtatttgccctaacaagggtatctttgggacccataagagacaacaaacaatagaaaacaatgttgagagagaagatgctctagttttcttagtatattccaagatgatgcaaactacacggatttttttcagcgtgatgtttgtgcatgtggcggagcttaggacccctaagtaaatgatacattgcggatgctcatagtcaaagtatagcttattattaacaattcttaaagaaaatgtttaattagtttggtcatactatgtttattttctagttgaagtaacagcgaatcgtggtctaggcataagatgcatacgactttagggtctgaagaggcatcggatgtatgggatggatgtgtgcatattggggggatttgtaattatgacactgcaaacattaaccattgctataatgatattggactcacatttcatagacacagatggacccatttgtcatccactcagagtgtcaaaacagcgaagccctcatgtttgcagtcctaatattgcaattttctcgtgcatattggggtgatttttcaacaaaatatttagtgagtccatgaatttattgctagtctctatacgtcgagcatgtagggtgtgtgtgcgtgttgataacttcattgcgtaaaggtggtaattcaatacgacataacacatgccaccagtgaatggtgcataaaattaagactctttagtcaaagaaaacaaactaagacccattttatgaagggagaacaaaaataaagtggaaagtgcctttgtgtcgcattttgtgtagggagaacaaaagtaagctcatcttgcaatcactgaaaatatcaacacaaaatcaccttttaaaaaaaggcaaaatttgctacaggacaatcaaaaaatatgtaattggctaggagacaccacaaaaacgtgacacggctgatggacactaaaaaatggtgtaattggctataggacactgaaaacaatattttataatttccgggttaaaaggggtgagaaactttccgaaatggcgaggttgcccctagcgcagctgctggcaaggttgtcgacggcgagctagctggcggcggcgcccacgcaccaggagcggcaaacgaacggaggcagacgcggtcagggagggacaagggtcggccacgcgcgaggcctacgacggcggcggcgcggagcgcgagcaggaggtggccgcgcgccaggccggcgatggcggcggcgcggagcacgagcggcggcgaggtttccgttgagcacgctgcgagcagcggggattctggttctcaaattcctgatctgcggcgccccggacccggcgaacatcacggcgatgcacagggccacgacgacgacaggtagagcaatcttgaggaaaagatgagctcgtcgggtggagttgcccggggctggacatggcggcaacctgcagctgcgccgtgcccgccgcaccggcgagccgtgggaggtagatggcgccaggggcaatctcgccatttcaaaaaatttcttacctcttttgacccgaaaattataaaatattgtctacagtgtcctatagccaattacacaatttttgtagtgtccatcaaccgtctcacgttttttcggtgtcttccagccaattacacattttctgagtgtcctgtagtaaattttgccttaaaaaaatcccatgttttctctactcaaggataaatattcctttatggttcctccttctactaatacatccaaaagcaccaagctaataaaatccacgtacggatgcatgatatactagactcaattctctgttactatgagaatttagatggttcatttgcaaatattatgaggtctaaggtttgaaagcaaaccatcacctttattgtaaaaaacatttggtttatgttcattccactgtaatgttccactagaatccacatgacataagtcatgtccatcccactgttggaattaatagatgggctaaggcccattcgaagattaattctttggaaaatcataaaaacccacctcatgggatggcatgcatgtagagtttagtaccaccttgcttattctaggagagagggacctccttaaaagggaggatgccctcctagccaattgaagcatgtgtggtggagagaagaggggaaacaagcgcgcgctcgctcgcctcgcctggcaggcgacgcgcatgcacggcgtacgcgtcgaatggtccgcaaaattggctcctcacctttgcgcagatgcagtctccttttgcagttttgttttgctgcaggaaattcggatttgttttgttttggaaacattccgaaaaatccggtgcgtgaaaacggcatggagccaggataggttacgcgcgacttatccggttcggtttacgcggcgccctgatcaggcgatctatctctatataaaccgagccgccgccttcacgcaacacacgcgaaatcaatctagggtttgcctcctactctgtaatgcgccgtcactcgtagactactccatcccgctcgccggcgtgcaccggcgatcaggagagcaggtctccggaacctctgccttcgacgtcctgcaccgggagaaggcggcaataaggtttttgggaagcgcttcgcgcgactgctccctgttcgtccgtgacggctcgccttcttctccgctcgcgtgcttcgcgccttcatcgacgctcgcaaccgcgagtagttcctgccgagcaaccggtctttccgccacctcggtacgtgttcgatatgttgtgcatatttgatttatttatgttttactgcttagtttacatgtgtagatctaatgatgtgttcaatctagtttacatctgcaatgtcatgatttatttatggaataaattaaatcactatgtgcttataatttcaacaatccaaaaccttattgtaggcactgtgattttacaatggctagttttgccgatgcactgaggccggataaattcaccggtgtgcactttaagagatggcagatcaggggcactctgtgtctgacggctatgaaatgcttctgggtgagtactggcaaacctgaaggaaattcttactgctgatcagcagaagcaattcgaggaagccactactctctttgtgggatgcattcttagcgttcttggcgatcgtctggccgaggtgtatatgcatatgaccgacgctaaggagttgtgggatgcactgaatactaaattcggtgctactgatgctagatgatctgtatatcatggagcagtttcatgactacaagatggctgacaaccgttttgtagtcgaacaggctcatgagatacaaaccatggttaaggaactcgaactccttaagtgtgtcttacccgacaaatttgtggccgggtgcattattgcgaaactacctccatcatggagaagttttggtactgcactcaaacacaagagacaagaatactccgttgaggggttgatagcgtctcttgatgttgaggagaaagctcgggaaaaagacgccgcatctaagggcgatggtgggcagtccagtgccaatgttgtgcacaaggcccagaacaagagcaaggggaaatacaaagctcaacagaccaccaacttcaagaagcagaagaagaacaacatcaatcctaaccaggatgagaggacttgctttgtgtgtaggcaacctggtcatctggctaggaagtgtccacaacgcaaggggatgaaggcacctgcagggcaaacttctaagtctgctaatgtgacaattggcaatactggagatggaagcaggtatggtaatttacctactgttttttcagttaatcagtctactaattggtgggttgatactggggccaatgtacatgtttgtgctgacatctcattgttttcttcttattaggtcgcacggggttccactgtcctaatggggactgggtcacatgcttctgttcatggtgttggcacagtagatctgaagtttacttcgggaaagatcgtgcagctgaagaacatgcagcatgtcccttctatcgacaggaatcttgttagtggctcccgtctgactagagacggatttaagttggtttttgtgtctaataaagtagtcgtgtctaaacatggatattttattggtaaaggttatgagtgcggaggcctattccgcttttccttttctgatttctgcaataagtctgtgaaccatatttgtggcagtgtggatgataagactaatgtttggcactcacgtttatgtcatattaattttggcttgatgtttcggctttccagcatgtgtttaattcctaagttttccattgtcaaaggttctaagtgccatagttgtgtgcaatcgaagcaacctcgcaagcctcacaaggctgccgaggagagaaacttggcacctctagaactcctacattcagatctttgtgaaataaatagggtgttgacgaagggtggaaaacgatatttcatgacgttgattgatgatgctactagattttgctatgtatacttgttaaaaacgaaagacgaggctctagactattttaaaatttataagacagaagttgaaaatcaacttgacagaaagataaaaaggcttaggtctgatcgtggtggagagtttttctcaaacgagtttaacttattctgtgaggaacatggcatcatacatgagaggacgcctccctattctctcgagtctaatgggattgctgaaaggaagaaccgcacactgactgacttggtgaatgccatattggacaccgcgggactacctaaggcatggtggggggaggcattgttgacctcgaatcatgtgttaaatagagttcctaacagaaataaggacaaaacaccatatgagatatggattgggagaaaatcatcactttcttatttgcgcacattggggtgcttggcgaaagtcaatgtaccaataacaaagaagcgcaaacttagacctaagactgtggactgtgtctttctgggatatgctcatcataggattgcctatagatttttaatagttaaatccgaggtacctgacatgcatgttggtacaattatggagtctcgtgatgctaccttctttgagagctttttcccaatgaaggatacacatagtagttcgagtcaaccctctgaagtaatttccagtttaatcacaccaccagaacaaactgaacatacacatgaacatgtcactgaggaggatgtcagtgaagctcctcgaaggagtaagagacaaaggacggctaagtcctttggtgatgatttcactgtgtacttcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaatctgcggggtgcaagtgtgtgttcaagaagaagcttaggtctgacggtactattgaaaagtacaaggctcggcttgttgctaagggctatattcagaaagaaggcgaagatttctttgacacttactcacctattgctagattgaccacaattcgtgtgctactttccttaccagcctcacatggtcttctcgttcatcaaatggacgttaagacaatttttcttaatggagagctggatgaggagatctatatggatcaacttgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattctgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaaaagaattgctaagaatcaactggaatactcccaaatcattggctcgctgatgtacctggctagtgcaataaggcctaatatctcctttgttgtgagcaagttgagccggtttacctctaatccgggagatgatcactggcgtgcacttgagcgagtaatgcgctatctgaaaggtactatggaattggggcttcactatactgggtatcctgcggtattggagggttatagtgattctaactggatctctgatgtggatgagatcaaagccactagtggatatgtcttgacattgggtggtggtgctgtttcgtggaggtcttgcaaacagaccattttgacgaggtcaaccatggaagcagaactgacggcactggatactgctactgttgaggcagaatggctgcgtgatctattaatggatctgcctattgttgaaaaaccgatgccggctatcctaatgaactgtgacaatcaaacggtaattgtcaaagtgaatagttctaaggataatatgaaatcatctagacatgtgaaaagacgattgaagtctgtcaggaaattgagaaactccggagttataacgttggattacatccaaacagctagaaacctggcagatcccttcacgaagggactatcacgaaatgtgatagataatgcatcgaaggagatgggtttgagacccatgtgagttatactatggtggtaacccaatctatgtgatcggagatcccatgaattagaacctgggaagaacaaaccattagtaaactagaggagagtaccaatttataccctctctaagtgaagatgcatgtactctcgtgagctgcaaggcaggttggctatgtcttaatgagttctgttggctttaattagcgaagatgctgtcctgcagagcattcttgaaagaactcacctttgtaagcttgactgttggtcgcagtctatggagattttgggtgaatcttctaggaagtttactaaagacctaggagtatgacttatacgctccacccgaggggtagtctacagacggtctagtaccagataagactctgagtgaaacttgcttacacaagacttgcaattcaaggcgtagtccattgttcaagttgtgagtaagtgtagcttggagttctaggtggatgttcaaccttaatcgctctccattgaaccgctggtatataaacagtacgttggaaaaggcaaatctcagtgggattttgagatttggtgggggattgttggaattaatagatgggctaaggtccattcgaagattaattctttggaaaatcacaaaagcccacctcatgggatgacatgcatgtggagtttagtaccaccttgcttattctaggagagggggacctccttaaaagggaggataccctcctagctacttgaagcatgtgtggtggagagaagaggggaaacacatgcgcgcgctcgctcgcctggcctggcagggcagggcaggctgcgcgcgtgcacgacatacgcgtcgaatggtccgcaaaattagctcctcacccttgcgcagatgcagcctccttttgcaggctgcgtgcgtgcacgacatacgcgtcgaatggtccgcaaaatcacccttgcgcagatgcagcctccttttgcaggctgcgtgcgtgcacgacatacgcgtcgaatggtccgcaaaattggctcctcacccttgcgcagatgcagcctccttttgcagttttgttttgctgcaggaaattcggatttgttttgttttggaaaaattccgaaaaatccggtgcgtgaaaacggcatggagtccggataggttacgcgcgacttatccggttcggtttacgcgggcaccctgatcaggcgatctatctctatataaaccgagccgccgccttcacgcaacacacgcgaaatcaatctagggtttgcctcctactctgtactgcgccgtcgctcgtagactactccatcccgctcgccagcatgcatcggcgatcgggagagcaggtctccggaacctctgccttcgacgtcctgcaccgggagaaggcggcaataaggtttttgggaagcgcttcgtgcgactgctccctgttcgtccgcgacggctcgccttctctccgctcgcgtgcttcgcgccttcgtcgacgctcgcaaccgcgagtagttcctgccgagcaaccggtctttccgtccctcggtacgcgttcgat

SEQ ID NO: 16520 - DNA, 9060 bp, Oryza sativa
ccaccatcaaagacttccccctcatcttgaaggagaagaaagaaactagtcacctaataaagagattagtgttaacacatcttttattactttaaatcatatactattactaaatcttttaccttggaccagtagtctacatgtcagcgagaaagtctctctctgctgcttcatgaactcctcaatcccatcttcatctcgataacagttccatctctctctgctacttcatgagctcctcaattccatcttcatctagatagcaactctagtgacatgggttggctgatggtgattgggagaaggtgggcttgaaagctcgagtggcatgccagctcaaggggagatcgagctcaagcttgtgagtgaggatggcccatgcccacatgcttgtgctacagatgacaacaccgtttcatcacccaaccctgtgccacggtgtctcatcttttgcagtttgcacctatgcaaccacgcttgtgtccttctagcacgtgaaatggtggcagattgcatccctccatgcatggtcgacacaacatcctcctgcccgatgaggtcgtcatccttgagggagtgagaaggtagggagaacaaagaatggtccgacggtttctttgcaatcccttgcctcacttcctgcttgtgcatggaagaggggctcatgcaaaaaaagtggagttgttcatagggagtcatccattgttggttctgttgtctgtcgagagattgatgatattatcaacgtgaattgtagacaatctcgcttgtctaaccaatcatgcatcagatagagggaagaggagggagactaactagcatgtgggatactactccaaggtgcaaatttagtccaaaatgaagagagttgctaatagtccaatatgtaatttatgtaataaaaaccggtacaaggtgtaattcattcactctcaaataatctactactatcattcttcttgattatagtctaacatagtatgcgtgcgcttaccataattgactattaacattttacgatacttgttggaaaaactatcccaaaagtcacttaatgcttgatattccacccaataagtcatttattgcaaatgcctacccctacttggttttattgcaaaaccaccccagcgcgcacatacctaaccgaatccgtatgttatcactgatgtagagccccacatgctaaactagctagatcaatcttgtccaagtgcttgcattaaacttattctttatgtttcattgattttttttctgcatacagagaaactcaattaaaaacgtttaagctctcattactaattctatttgtggaacttccaaaacaatatcaagacaatacttctagaaatatttaattttcgtatagaccacattgactcatcatcataaattataaaaacatattgatttggttaagcacatatgcgctaggttgatttttgcaacaaaatcgagtagaggggtggacatttacaacaaaatgacttttgagatagaatataaaactttatgtgacttatgcgatggtttttataatttttcatactttttttaagataatgaactttgtataatagttagtgatagggtatgactaatcttttgcaccctgataagctaggattgatgtggagatacgtattgtcgtattgatattcgtaaaatctaattcgagagccttctcgatttagcgctatcgcgcgacgctggtagagtcgtccgatcgctcgcgtcaccattgagtccatctgcgtgggcctttctagataagaatcgagatgaaaccactccaaccacacgcacatgtaattcttgtttgagaaagaagtcacaaagagaaaggttacagattctcccccatgtcatttttctcttcaaacaaaattttctctcaaattacttatccgatctacaatccgattacaccattgtgttcattacaattaaatctttacaacaagatcttacatgattatattacgatgaaaaaatatttatatttgtaaattacttttattatatatttaagttacttttatcatatatataagttacttttagatttgactaaattacttcttagacatataaaagtaaattcaataaagtctgaaagtagtaacattgtcacgacattaaaagtaaattcgttgtagggataaaaatatgactttatctagaaattaaatttaatcaacaaagatcaacacatgtaagtttaacaatttttaaaagtaacttcaatgttaattggaagtaacttttgcatggttcaagttgaaaagagatactagatggagtacaaactagctaccactagctgtgtagtcacgtctaatgaaaaatgtattagttaaagttactttcctttgttataagttacttctataatatatgtaaattacttttagggtttattgaattatttttatatgtctaagaagtaatttagtgaaatctaaaagtaatttaaatatattataaaagtaatttattatttttcatcaaaatataatcatgtgagatcttgttataaagatttaattgttacgaacataatggtgtaatcggatcatagatcggatgagtagtttaacagaaaaactgtatttgaagtataggtggatagtgccttttatagatagagtggtagctagtttagacaaaccagctaccactagcttcacgtccattgatactgtgatcatatgttttcgatctacctgatactactggctatattctaaactccacgaaatcatatcggaactaaaatccctatttgtcccattaaaattcatacgctcgttttggtcggtcttccctatttcagctatttggtgctctactgaccgacatgccaaaaacacagtatgaaaacagtaagaaacttactatttattattattttctatgtaaaaggggacattttcatatttatgaatctaattatttagtgccaactataatgaggcgatgataaaaattagaaaatctaaatatttagaatcgataatcatgacaaagatactattattatattagtttgacgagaatatcagcatgatcgggaaatttccgtttcacataaaaatcacccacctaaataatactaataaaatagcgtggtccacctacaccgagtccacagttccacacaggcgcacatcccgtacccaccccggcgtggaaaggaacccctgctgcgtcaccgctggcgctacccaccagcagcgtcttccgttgcctcctccttcccagttcccactcccacaggtagaggaactcaactcatcacaacaccccccaccccagtcgccctcccggtcgtcgacgtcgtcgtcgtcgtcgtcgtcttggaggcgaagaaagaatccggccacctataaatatactccccccccacccccacgccgacctcaccgccgctgccctcccctcctcctcccccctcgcaacctctccccgattaaaccccccaaaacctaccgttccatcgcggcggcgcggctcggcacggtggtggtgggggagatgcacctctacaacgagtggctgccgccggcggtggcggatgcggcggcacgggagcccgcggcgttctccggcgcggtgggggaggcgcgggcggcgtggcgacccgacgacccggactccgcctacgccacgctcaagtggatctccgtcttcgacctgtaaaaatttgtccctctccctcccaagcccctccccccccccttctgttctgttcgtgttttctaggttacggcggtggaggaggcgggtgtttttaggtccgggtggggttgcgatttcgtgtttcctgattggggcgcgacgagatgaggagtagctcggaatggtgcgaattgaatttggatagttcggacttctgatcggggggcgatcgcgtctggaatggggaacaattctatcctgtaatcgtcgtgcaaaaatttccgtagcttgtttagtgcttttggtgctatctagttgcaggctatctcatgaatttgaggtatggtgcgcagtaatgttgcttttggggtttagagcatgtgttcccagctaatggcggggataggtctaactgctggtggcactgcgctcttaagtcaaaacatgcgccgttatcacttatatattgatcactgcatggcatcgtttggtttcatcactggatgacaccgttatcaccctctgattcttacaaggagaccctgctggaattagaaattactgtgctggttcgagctatggatcatgctgacaaggtttctaaaagtacttttgacaattaatggtctctgagttgcgttttgaactttctagaagcatgtttgcttattcttgagctggtatatacaaatagtatgtggattttaacatttgcttttgagggctaacatttctcggattattcgatccaatttggggatttgaacagcagagtaattggcagaagcatgttgaattaaccttgtactggtgtacacaattaccgtagctgcaagcaatttgctcaactcccctgttttttttcatgaacttaatttaaaatattgaacgaccacaaagtgccactggaaagaacttttctcaataaaatgaaaagtatttttgttgtgggtgtgcctccatgatccaagtgctgtgataataacaatggcatctctgctctctactactggacatttcatgtgaccctataatccatcttgtctaccttttctaccagcactgaagtgataactgcatggacatgtaaccctaaaccctataaacctattcaaatctcacatactgtcttgtggcccacaaagttggcctgctagtaccaaatagtctccaccagaatgaaaattacctgttatctaaaaaaaaagggtctccactaccactaggttcatccccgttgtttgtgaatttgattttttatatgttagatagtaaactgtagttagtgtcaacatcctggttacattgtttacaactagagcaatgatattctttttgtaggaaagatacatagataacaacataattgaaaacgcttgatacaaacaaattgtttaaggcctcctgtgagttaatttggttggtttctgggtttacaaatgcaattaatatagatattttgtttctctatgcatttagttttatcaacgcaaagagtgatatttctcctgaggatgtacacgctcttgtagagctcgggttggagatatttcatgcatcacagaacaagttcgttgttcaggtaatgctagctatttacgatttctatatggctggttttgaccagtttgacttcagatgatcaatttttccctggtaaatgaatgcaaccagattaagtggggaggcctgctcgtcaggtttttgaaaaagcatgccaagaggatttcacttggtgtgcaatggaggccactgtatgatacgttgataaggactcatttcaagaggtatatttcgaatcaaacacactttttaagtgacgaagaatgacaaaaatagcagagttaatttcatgtctgttacagaaatatgggacctgagggctggaaagtaaggcagcagcactttgagactgttacctcattggtgcgtgcatctaggagtttgtttcctgaaggtgcagctgcagagatttggtcagaattcaggtttgactgcttattctgacttaagcatgggttcttttacttgtttcatgctcactcctattctcttgctgcgttgttaattttgttatttataactctgtgttgttgatacacctctataaacctgtacggtatagtgtttagcttgacaagatcttactgtaatcaaccaagcatctaccaagattagaggctttaccaggattctacatgcctagagacctctagtgcaggtctactacttttattttggtagctacacacaataagaaatgtccaaagcatcaactgagtactgtggtgttatgtttgcatgatcctctaattcttgtaccattatttctaatgttattgcttttctatactaccattgctgttaaaatttggaaaaatacaatatgtgattgatttttgtgagtgactatggtagcagttgtatttaccaatgacatcccattgcaccatagcagtttgcaatttgtgcttgacaatatgctaccaacattgaactgccttacctgatactatattgaactacagccccttgctgaaaaatccatggcataactcagcatttgaaggcattggatttcttaggctgtttcttcctgcaaactcaaggaatcaggatcatttcacgacgtaagtgaaacaggaagatatttgatcaataagcttttccttatatagctagaaaatcttcacttattgtttttctatcttctggtatctttttatgtagtgattggattgcagaatgtcttgacatatggggttctgtcacaaattgtaacttctgggatattcaatgggctgccattgtagcacgctgtataaaaggttccatatctgttgactgggaaaaatttatacccttattgtttacaagatacttgaacatgtttgaggtatgttgtcatcttaattcattctatggtactagccagctctaatgtttggaaggtggcgtggatactagctggttaacgttttgcatatgctgcaaaactgcattttctatgaatcaagtgttgcaagtttaattaattgacaagcatattagaatagcaatctattttgctgtaacaaaaaataattaactaaataaaggttattggaatacttgtatttttaaaaactgaatcagtttctgtaatcttctgtccttcatctcttgtatataaactgtctgtgtaaattatgttatattgcagtgggagactctaccgctgtttcattaagaaaaaaaggaagcagctattattttcatgtgccctgtaacttgctcgttaagtgtatcaaacattttatcatttcttttgtgaaggtgaaccaatgttttaaataatgcagtggaatcatagtgctggagtgtttctgttgtagataattgcattatagacaatgaaacatgcatgatcttgtttgccaaatgcatagtttgatcatttgtgcagtagagacgcatgtcttgtgctatttaactgtcataaaagcaccattatatgtaaaatattttgatccacgcaaaaagttgcttgataaaatactctcaatttattttgatactgttactttctctatgcttaggttcctatatcaagtgggagtgggtcatacccctttccattgaacgtgcctaggaacacaagatttttattttccagtaagactagaactccttccaaggcaattgcaaagtccatcgtaagttattcgaatgctgttttctttaatttttgtacaaagggaacatagagatgcaatttttatgatactttgtaaaattcatcttgttcctttgtttgactagtgcaaaacacatatattcgttttgaagaatataaagttcaggtgggctggattacggccttctgtggagtcctaagaaaataggaaaactaatttcaataaggagccatacctattttatttttaaaaataagttcttttgcaggtataccttttgaagcctaaaagtctggcattggatcattttgagaagctcgtaaattttctagaacagtctgtcttctgacctctggacccttttgtggttgctgcactggccttcttttttaattttaactagatttgtttaaacttgtaggttctatcatccatcaaatgggggtcggtggacctactcattggagcgtttcttacgatatcttgttctttactttgaaagacgccttcagcatgaacaattgtaagagaatctttgacttgcgtgacaacttgcaagatgtttttcttatcgattgcatcatcatctgatgttatatttgcactacagtgaagcactggatgacaaacacaatcaattttgtttgggaaaagaagaaagatgtggttttgtcaaagtagtcctgaaatttctggatcgtggtcagtacagcaaggatgattctcttgctgacactgtgtctattgcaacttcaatcctatcttatgttgaaccatcccttgtgcttccatttgttgcaactaatttccagctagccttagagacagtaagttgaatttatgctgtatatttcatattttttccatagagattttgttgcaactaatttgcacccccttctcaagttcatatttttgttggaaaaacgaacttactgttttaatttattcgaacagactacagctacccaccagttaaagaatgctgtcacatctgttgcattttctggacgtgcacttattctaagttctctatgttcgtctcaatctgatgatagtagcactgctgatacattaaatgatcttatcgttacttctctttcaaatgcgttacttggtatggatgccaatgatcctcctaaaactatagctacgatgcagctaattggttccatattttcaaacgtaagtgtatttatctttctcaccttttcttgcactgttgaacttacaattgctatactgagcatcctttggtgtttatagctagccacagctggtttcagtgatgatgtgcctgctttcctccaaacctcctatctgtcagagtggcttgatgaattcttttgtcggttgttttctgtccttcagaatttggaatcaagtagtcctatgtaagcggcaaaactaaattcctgtatttaacttattgttacccgatatctttcagaacatggcagttgacatcttgtttcatctggatattgcagtaatgagggttaccaaagctcaatcatgtcaggaacttttcttgttgaggacagcccatactatttttgcatgctagaaattgttctggggaagttatcaaaacctttatttaatcaggtattgcactagttagaagttgatccactttgctgtccttaaacctatgaatttcctgtcatgcacatgtttcctcatatttttttttgca

SEQ ID NO: 16521 - DNA, 8166 bp, Oryza sativa
tttcatttcttgaatcgttacatgtgtttacatacagttgtgcttgctaaaaatgcaggctacactttctcctgctctggaaacagcattagactactacctgcgggttttggctattgctatcagttatgctggccctgtcttgctcaactatagacaagaatttaaaaatataataacatcatcattccaggccccttcgtggaaggttcatatttccttcatcattttgtacttttggatacatacgtatatattacaatttgaaatgatggattccatcttttgaatacctaggtcaatggagctggtgatcacctccttcgctctctgctaggaagcctggtttcatattatccaatagatcagtataagtatgtttacaatatgaatacccattttaagggcatgagcaatggtttagacaactgctacctgtataaactttacacattatatttagataatgtacaaacaacttgtacaatagatttgtctaattagtggttcatataatcaatgatttacaattgatagatgatatgatgctatctattcgaccatttgctgatccagatggcatccttctctctctgatttcaccttcctccacttcagtcctacgtggcatcccctcctagattctgacacacaccattgttctcgccccaagaaaaactgcttttacctattttaaaaagattgcttattttgtaggcccttttcttgtcagcccattgctaatattattgaaccatggggctgttcgaaagctcatcaggacagggaagttgaaatgttaaatttcactccaaagtggcatgatcccagtcaagatgaactatcttttgcaaatgaattgttagaatttcatttccaatcagcattggaagatcttgtgagtatctgtcaaagaaaaaatcattccgagacaggtaaatattctagttttgaccatggaatgaatcctctctttttttttttttttcgcattgggtgctcaagtagagggggcaatgaatgtcatgttattaaaaaaaatggtacatgcatgtttaagtctttatgatcatgtttgttgactggaagctgattacagtagtgttgatgcttaattgtttacctatttaagtatttacttttattagatgattccttcatctggtgtgttgtttttcttttaacaggacaagagaaggagcacctaaaagtaaccctattacgcattcattctgcattgcagggtgtaatgtcttgcttacctgaaatgcggccatcatataaagatgggaaatccaaggtagtggagcccataatttttattgcaggatctgctggtagcactgttggcaactcagaaatgcgtgaaaaggctgctgaacttgtacatgtagcttgcaggtgaacatttgtttcttgtacacccaaatttatctgcttagtcttttttagcttattttgtctcaccatttgcatttcttccaataggtacttgttgaaagaaagaactgatgatagtatactcctagcacttgttgtacgtgtcattgatgctttagtaaactatggtatgttaattaactatgctcaaagactcatactggggtgtagatttgcctgtttatatattctactgctgtaggtagcttggaatatgaagaatggtcgagccattttcaagcttggaagttagagtctgcttccataattgagcctccatgcaactttattatcccatttcattctcaaggcaaaaagaggtattgtcctattttgttcagtctgattctagtatatggattttgagtgagttcattttttttttgtctccaataggcctagatgggcacttgttgataaagcacacttgcataatacatggagaagttcacaatcatcataccatagataccgtacaaatgctgatgtatctccatctagcctcatggttaatttgatgaatgatctcctagatctctcactacacaactatgaaactgttcgctcgtaagtgctctagctctttcttcctctttcaagcttgcttatgtatttagttatttgtatatgccgatatagtttcacttgtggctaagctttattattcatttaattggaatattactatcaacatacgcatccactttatgaactcaacaatcgatgaaattggttgtgttttgctgaaaaccaggcaaacaagaaacaacttcttatcttttcaaaagggggtatttcaattgcttacacgacaccctttgagccatttcttttaaataatacatgcatatttgctcttagaaatggtccaaaattcaatgctaaatgtgaagttggctgttttttttttttttttttgggggggggggggatgagacctcacaaaaactttctttatttttgcaaatgaccttcttggaaaacatttttatatatcccgaggagaattttatttcatctattgcatttttgtaatatgtggatattattaatttattgtaacctcattgtataaattgagttttgatcgatgggttatgtggtcatgccagatattaccacttcactttgttctgatgtttccatttttctgcattatttttatcctttatcctgagcagaattttatttcatctatgcatttttgtaatatgaatactacaaaacaaatggatagtattctatttgtagttacttcattggctggttattgattttgacctaattgcattaatgaagtattgatcaaataatttattgtaacctcattttataattgagtcctgattgatggattatttggtcatgccagatattaccactttactttcttctgatgtttccatttttgtgattattttaatccaggtattctggaagatcccttacaaaattacttaagcgctggccttctctaatttctaattgtgtcctcacattgactgataatttgcgagattcaaaagcacctgaacatacggtgcttggttcttgcaatattcttggaactcagactgttttgagacacttgacaactgtatgtctattttcacaatttatgtaatttagtgttaagttattcataagggcaaagatagttaagttattaaattagtgttgacaatgctaacatcactattccatgcaggactcggtatcactctcttcatttatcatgggcatcttggagaggtagtaggcactactctatgtttgtcctgttatttctaataatttggaactatcagttgttcgatatgtttcattgtaaattatacttaaaaaaataaaaataatcggcactccgcatagaggagaaacttgaaagtaagacacctgtttgacatgtcttttttctttgtagctctcatcatgaatcgctcaagtgtcagaaagctattactgaggtacaattcaataatagaacatgaaggtggtcatgagataatttattacttctaaaatattctgtatacattctttacagctctttgtgaagtataacatacgtttctctgggatatcaaggagatttttcaagaatacagaatgtgaagcagacaagccaggatttatcagtttagttcctaaaataaatgctttgagttttgagagtaatagtctgcattggcggtaagcaattgatataaccgaaccaaatttgatatatctctgtgacatatggcactttgaggctttaaccttgaaatatttaagattcatgtcttctgatagatatacaccaaatcaaatatttcctctattttcttcagttcactaccttttgctgttgattttttccccaccaagttctgaaccttgccatatctttacccactttgactaattttccatgattgcaacttctgctacctcatcatcatcagtctttcataacattaattaatcctcaaattattgaatgaaaatatttctggtagtattaacaacaacattaataatagaaagcacatagtatgtgcaaattgttgaattgaattagctcgataaacacataataacaaaaatatatgattttagatgcatccaccctgaatcatggtgcaaatgtaccatgacaaattctgaaacaattcgactgcattgagataaaatggacccatcattttacagaaagaaaaaaaaagtacatgcaaacgcaaaaatgacaaaattcaatgcactatagaggactatcttttttatttatcaatatgtagactagatttaaatttgttttttttatgataaactttattttgtgtgaatgcttttagaatttcaatttttcatgaccatttgcactgtatcttgaagaggatgccccatgttgccccagatatttttcccttttgttgataggtctaggtctcaagtccagaccggcaggtcaccggttgggccacttgtttatcataattaacattagttaacattaatttgaatcaatagtattttactaccgcattttcatatgctatattaatatacatgtatgttgaaagaagcttgtgcatcgaagtagctgcatatgcaaagtcagcctccagatggaaagtcagccttgaccacatcaatatattttaggaataaattgcaccatgggtataacaagttgagaatttgtaccttgagttgttcatcttgtttaagtgatgggttaccatgtggcattgactggcatgccattttgctctatgtttagtttttcattttgcagaaaacctctcccattcttgatctctctcttactcacatcctgttcctatttcatcaatgaccatagctttcatctgtcacctttcttaccccacctcactctatccattaccctgcatatatgaacttaggaaaaacgccggggtgggggtggggggatagagtggttaactggttgtactctgagcagtcacacagtaaaatggagttgatcatatgcaccacttctacaaagacaaatgctgcccaactgttcagtgccttgtttctaataatagttcagattcgatggtaactgttgtcagagtacaattaattgtttcagccattaatatataaccttggaacctttgtattctcagatacaatttgatggccaacagagtgcttctgttgctaattctggcatcaagaagtgaatctgacatacattcacaaatcttgtcagaaacagctggtatggatagcttactctctttggtggtttcttgtatttgtcaaccatgatatattttctttctttatgttcatgaaaaataaagtttgatacttgtatcctcaattttattacttagaacttagaacaacttttttttttgtgtaggtcatttcttaaggaacttgaagagtcaactaccccactcgaggatgcttgcaatttctgctctgaatacactattacaaggatcacctgataaggcatctcttcaagattcacaacaatcattagatcgccctgaagaaggaagcattttgtccacaggagaaattttgaataatataattcgggaggatggatttatgagtgagactctaaacagtctatctcatgtccatattatttctgataatgatggttcatcgaaagcaagttatggtgcttcatcttttcaaagcggttctgataaagcaatcacttacttctattttgatttctctgcgtcatggccacgcacgccaagttggatttctttagtgggtggtgacacattttattccagctttgctaggatatttaaaaggctaatacagcaatgtggaatgcctgtaatatcatcgcttcagaatgcattggaagagtttcttagttcaaaagaaagatcaaggcaatgtgtggcagctgaagcgatggctgggatgcttcactctgatgtgactgggaatttggagtctgggaacaactggttgatacttcagttgcagaaaattatgctttcaccatctgtggaatcggttcctgaatgggcagcttgcattcgatatgctgttactgggaaagaaagatctggaagtcgtgctcctgttctcagagagaaattattagattgcttatgcacgccagttcctcagtccgtggccaccagtgtacttgccaagagatattcttttctgtctgttgctttaatcgaaatatctgcaccaaaaatgtctccagctgaggagcagtaccatgttaaaattctcgatgaactgcttgccaacatgagccatccgtcggcccaggtagcgttgattcacttgatcatagtatatcttaatcttgcctttttttagtttcaattttatattattttgagttttcatttcagttatacccgaataacatttccttgtcttttaaagaaaaaatgtttgtttcctctttgtcttttgacaatgtggtaacatgcaaccccattcactaggatttagggtctgattatgcatgttctagtccagataggttcactggatcttgggcttggcaagtacaaactcgtagatttgtgatatttcctgctaactggagaaggcttacactatcttctgtcgggatacttgttaggaattaaagatatggtttattaggaaagtagaggttgtattctcaacagacaagggactggtcacgtgaatagtacccctgggatactgtagccaagaatcatcactatataagggacccatgtctttcattataattaagcaataaagaaaactaaagttaggtttagcttgatcagtgtctcctagtgatcaggacaagccctccacctacaaaagtgatataccctttatcccccctatcataagtcaacacccataacactgaaagttcaattctccttgtttttcctgattcactaggctgtaatctgtttgggattagcaacaggttgtcatttagagctgacaaagaaccataacatacttattgctgaacatcacaatattgcaccacttacctatttcagaacattatgtttctgctccatttgttcaatatgtggtattatacacttttgaagttcttttaactatttttggaaatgtacactatgcacaataacacatgtaatgatgcatctgagcttaggtagaattggtcaacactgtttatatttatcataattcaaacacaattcacataatatatttagaaaaatttctgagcttattgtatcaactagtttatggtttgacaatttgccactaccacatggtcacccttttttttttgtcaaaaaaggaattgccttggaggatttaactgagctaagcctattcaccttccattgtgttcagataagagaagcaattggtgtgaccatatgtattgcatgctcaaatatgcgattatctaggttatttgggcatggtgattctctagatgtttctggggatgtaagcatgactgaacaaacagggagtgagaactggtcaaaacagttgacagatggagctactgaattatctatcagtatacaaaataatatttctaagcaactggagtcaacaccagattcagtaactgaaaatggcttggacaagaaagaggaggctgatgtgaaaagaatggaaacggtccttactttatgcttctctccaaactgaaaattccacaattcatttggcatgtttcaaacttatcttgttcttgcttcttttgcagatttttcacttcataattgcatcgctgaagtctgggagatcatctgttctactggatgttattatcggactcatctaccctgttctctcattacaggtatacatcttatgtttacatgatgacatgatttttttttctcgaaaatgcagaactgcgcctcattatattaagaagagagaaaggggctagagccctacaacacaccacacacgacccacaccactcaacacaactcccaactcagaaaactcatttgttcttttctctggttttcaaatcattatttaagtaatgacttgagtcttcccttttcttgttgaaggcttgacaaacatgaaatttcttccaagttgtgcctttttgtattaagtggtctgaaaattttcaccatagtttttgcttgtctactattccctccgggttgataatacttgtcgttttggacaagggcacggtctctaaaaaaacaactttaaccattattttctattataatatatataaaagtgttaaca

SEQ ID NO: 16522 - DNA, 23079 bp, Oryza sativa
tcaacccggagggagtagaagacataagcgtttgagaatctttggattatcatctttgtttggatatttgtctgaatttagtgactctaatagattaataacaataggagttttaacactttggctgaactatcatgtatctgtaggaaacatcaaacaaagatttgtcattgcttgcgaagtcagcttttgagttgctgaagtggcgtattttacaacggccttttcttgaaactgctattatgactattctttcttcagccaatgatccaaactggcggaccagatctgcattgttatcatatctcaggacatttacgtacaggttgaatttcagatcttctcttgatttgctagtgtatcaattattatgataaatgtgttgtccgtaatttattttgttcttccctagtattccctagtattgtgctcagttataggaagatgccttgattgaatcttaccatgatttgtgagttgttatttactagagtaaatttattgataatcaaacttgccttcctggatctatgtcgccgtaatgagaaactagttatttagtcatcaaaattgtgtacgtcactatgttgttcaagtgaggtaggtcactttgtggttgctgagcatggtgctgatctgggactaggaactgcacggccaacatgtggctgccccattccatgtaaatccatttattacaagatcccccaatcaccttctcgtcctcctatcccatccctttctttccagtccactgagcaaagcaccccaaagccctagttaccaaatgccacaacctgcaaaatgcccatatgctgcttcagtagggagattgatccaggagggtaaatcttattcttttttttttttttaatctaaaggcaagatatataatcagatttcacgctttagtatccttaggaagggatgggaaggaggggagagggtttgattgagtaacaaagtcaattgcagagcagtgtgacgtccatatgaaacatggtatcacagattacaagggttaaggatggatatttcaacaactacataaacaaacacaaaagaagatttgcattggacaatgccattccagtttgccagctacagctacatcgcatttgctaaaatgataggtgggtgagaaagggcattgtgaaggacccttcactagcaacatcgcatatttggaagtttttttcccccactaaggttgcccctaggatatccatcttgtcccttggatttagattctacatctcatagtggatgggtatcaaacctcgtagctaagaaatagggcatgtccatgctgcatatactagaaaaaccacctaatcatgtcactcgaattacttgtaccagttccatgactaagtttcttagtttctgagttcgctgacctctatttgaaccactgacaaatttgatgtctcactgctgtcttttgctcttgacactatatcctcatcaagggcagtaggatgtagaaacacatttgcgctcctgtattgcagatctgtaatatttctttattaagtcagctggctttttgagacttatagctgatggaaaataaatgcattatctttgtcgcaggcatacattcattctttccagctcagagaaatcacaaatttggcaaacaattgagaagttacttgtggatagtcaagttgaggcaagtatatatgtttatttggcctgtaccgtacatacttgtttttctcttgtaatattccttctaaaaaaattgtctcagccttctaatttctagcctttaactttgcattagcacccatatgaaagcaatactgttcttattaaagatgctgtcagtgaagacttatgctgtcaactgtatgaattttgttgctgtatttccaggttagggaacatgctgctggtgtccttgcaagcttaatgaagggcatagataaagacctctctaaggactttcgagatcggtcatatgcacaagctcagcgtatccttcatacacggcaaaggttaattttttgctgatttttatattactctctagtctcttcatatcactgatttgttaaaaagatactacatactagtatgttttatacctgctgcttcttgcagaggtgcaaagtcaggccactctgttgctactatccatggtgcagttcttgctttgacggcttcagtgctttctgttccatacgacatgccaaggtaccttcgtgacttcaatccttgtctttttcgtctaaagaggacgatgtagttagattcttcgtcaaatcacatcctagtggcctacttccaaatatggtggctactttactgttctgtttgtttttaaacggacttttcgttgtctttgcagctggcttcctagtcatgtaactctgctggcacgctttattcgtgagccctctcccataaaatcaacggtcacaaaagccgtcgccgaattcaagcggacgcatgctgacacatggagcatccagaaggaggccttcacggaagacgaattggaggcaagctcaaagcggttccctttcaaccatcctttctgatcacaacacaagttgacgctcgctcacatatttgatccttttgtgaatgcaggtcctccgtgatacatcgtcctcatcgtcatactttgcttagatataaggaccacaagattaattttcaagtaaattcatatagaatattttgtatggctgatgagattgcctccatacttggtggatcatatacatatagttacatcctgtagcttcggttttatttccacagataaaggtttttcgtcgtacaaagtcaggcacgtagtatatgtcgaatatgagctgagattatgagatacagtatgttacagtcaggcacattgcttctgcagtttctttcagcagcgggttcgagtagttcacaattaactgcggctcgatggatgcatacattttactcacccagccgggtgcccgggtgctgctgattgcagttgcagtaagtaattccgataagagtacatgcgtcttcttcgtaacaaaattttcaatctctgccactggcaacccttatccagtacacgcacagcatctgatttcctttgatccggtacacggccggcacatggtatcagttgagcagccaaagtaaaatacattgcttttatatagtacaagtacacacatggtagtgactgcaagtacgctgtgtgctaaacatacaggcttgtttattaaggcctgtttagttcccgaagaacttttcacacgtattaaatatatataaaaaactaattacacaaattacgtgtaaattgcgagacgaatcttttaagcctaatcgcgtcatgatttgataatgtagtgctacagtaaacatttgctaatgatggattaattaagcttaataaatttgtctcgtagtttacagacgaaatatgtaatttgttttattattagactacgtttaatactataaatgtgtgtccgtatatctgatgtgacacgccaaagtttttaatccctgaaactaaacagggccaacactgcgtggtagagtatatacaacaagtagtacatgcatgttagagcctgcaagtacactgcttgttaagcatacaagcttgttgtatatagtgtatcatgaaacacctggtataccatggtcctcgaggtatcatgatacacctggtatctcaaggtatcatttggtacctcgagacatcattcggtatcctcaaattatcacctacggtacccttgaggtatcatttggtaccctcaagatatcgcccgtggtcctcgaggtatcatgagatacactcggtacctcacggtatcatttggtacgctcgaggtaccatgatacatatgataccctcgaggtatcatctagtacgctcaaagtatcacctacagtatcctcaaggtagtgcccgtggtcctcgaggtatcatgatacatatgggttatacatggggatttttttaggtatcaggtatgttatagtgatacatttagtctctatgctctagaaagagatatcaagtgattcaaataaaaaaacacaaagaaaggaaaagaatagtgaaaagaaaaaaaaaggaaaaaaaatgtatggttgggccgtggcccaatacacaggagcgcaacagccctaccgggccagctggcctatccatgtactcactctatcctataatataagacatgtacacattccaagattcaactttaaaaacatttaaccaacaattattataatataaattaaattttatttgttaaaattattatcattggattgacatttaaatttactttaagatggttataaatttgttgcaataaaccttatagtatatgagaaatttaaagtcaaagattagttttgaagactgtgccaatggttgaccatgtgttatattatggaatggagggagtacatatgtgcaagtgtaggagtccttgtggtctagctagccacgtaccgacgtatgtatgtataggagtcctcgctaaacgtggtggcttgtgtggatggaagcgtgccatgctagactgtcccgttgaagaatggtacaccgttctttaatatttctatctcagcaaaccattaattcatcaacagtgtgccaacatgatggtactagttttgcagtttttattaaattaataatacttcacaaaaaaggtcgttcattttctgggttactaaagatgtaacgagcaaatttcttgttaactagatctggcttatgccttttgttaatctcctttagtccactgtaatagtaccaatttgagttccctttccttagcttcacggcttgtttgttgaatactatgtgattgtcataaccaccatgatgattggcatgctcatgcccatcttctggattgccaaaggtgtaataatatgaaaatttcttcttagctaggtgaacatgatcatgtccatgtgcgaggttgccatagattgaacgtgaaaatttgttcttagctagcttcagcttaggctttttgtcaatcccattcacttcgctgtgttggtataaatctgaagttttcttctttagcttcatggcttcatagttgagtaccatgtatttgtcattgtgaccatcatagtaaacatgacggctaactgctgggttgtcataaatgtaacgtggaaatttcttcgtaactaggcaaacatgatgatgtccatctgctaggttgccatagatgtagcgtgaaagtttcttcttagccatgttcagcttagattctttgtcaatcccatttgcttcactgtgttggtacaaatctgagtttttcttttttagcttcttggctttgtggttgagtaccatgtatttgtcattgcgaccatcatagtgaacaaggtggtcatttgctgggttgccatagacgtaacgtgaagatttcttcttcactagattaagctcaggcttttggtcaatccccttcactgcactgaactggtacaaatatgagaattctttctttagcttcatggattcagtattgaataccatgtgattatcattgtggccatcatagtcaacacgaacatgcctgtctgctgggttgctatagatgtaacgcaacaatttcatcttatctagtagaatatgatcatgaccatgtgatgggttgttattgttgtgacgcgaaagtttcttgttggctaggtctagctcaggtttcttgttaatctgatttgttccactgtaccagtacatatccaagtttttcatctttatcttcagagcttcatactcgaataacatgtgcttatcactatcgccatcatagtaaacacgatcatacccgtctgctgggttattatagttgtatggtgaaaatttcttcttagcttggttgtctagcttgggattcaatttgagtattgagctcttctcatcagcccccttggctccactacctgatgtaagaaggagattcttcttctggttgcctgtagatacatgcacacgatgtcacagttcttgcattcgttgatcattataaactgaactaggagttggttattttcaccactgattttaactgtaaatgaaatctttattcttatgcgacatataatcttccccaaaggttgctcattcatgtactgttcttgtcaaaacatatctgacatttgtcagaatttacatgggaatcttccttattctaattctactacctccaccccaaaatataggggtagtgtggtgtaatcagcctcacatttgttacaaatttataaatagtgccattttacagttcgcaaattaatatacaaagtgcagtaccatggcacctttcaattaaatactatcacaaataaatgatgttttgggaaacaatatgatcatgcaccaaggtattagtttgattatgaataaattaataactagtataaaacgtataaaaatgaaccaaagtattttgaaattttttgaagataaaactagccataccattttcaagttgaattgaaatattcaaagagatattgatggtcaaagtatattgattgcatgcattacaaacattacccaactagtaggtatttaaattctatctttttttctagggacgcaatttgaagatcggatatataatttaaaatgcatatgcaggcagaggcctggattttattttcaattattaaaacaacagtttcaaatgttatgctacatttgcacaatcaactataaggcagtaaatttatctgcatcttcatatactgttgatgaaattggcaaaattcaacacttgcaacccctgtacatacgtacttgaaacattagtattttgtacgggattatatatagacacttaattttagtggacattttggactgtcaatgtccaaggcatatgttttggttacaggagagattacttactaaaacctcatcaactttgtttgatttgagttatcaccttataaaaaatttaataaaacttgagcaagtgaacggtattattatattgatcaagtataactatatattgttaactttccatgtttatagcattaacttcaaataaaatatgcatttggtcatgctggttttgagtgtgattttggctgtgttgtaccaccttgtaattaaatttgtactccctctgttccaaaaagaatctaatcctagagtgaacatgtgtctagattcattattaggattgttttttttaacaaagctaggggcccagcttttcaattacactagaaaatggcgcaccagttggcgcgcttattaattataacctgtatataatacttataacttatttagaatatatatttgttagtttttgagtttttctacaattttcaattttatcaattttatctgtttttaaaactcatggaaaatagactgtatatattttctggtttatttagaacacaataatttcgcacaattgtcagaacggctagttcaatgctcgtaaaatttatttaggatagagagtttagttttctactaacttatcgaaggttaaaatatttccaaatatcataaggaaatttgatgtattttggtaaagaaaatcacaaatctgaatatttttttctatctctaggggggtatgtgtaaacatcataatttacccaatagagtttcatatgcacacaccatagcaaaatttagtttgatatatgcacatgaattacatagcaaaattacttgtccaacttataaaaaaaatagcctacttgataataagttttatcttagggccatttataaacactccaaaccgagggcctatttgtaaatttaaattttttagaggaaaaagttcagaaaattgttttggtagaaccggacatgttttttttatcctctgcataatttttacctggggtgtgtaaaaatcataatttgcccattagaggtgcgtatgcatatcatttagcacaattttagtttgatatatgcacatgaattatatagaaaattttaatttgatgcccattgcctcatgccagagcaaaatttaaacttgataaaattagttgcgagctacctatcaagcaaaaggcacccctcttgctattttattttctatccacatttcattttatttctcgtttcaacgggtgaaaacaatctatctattatattataaagatagcttgaaaatgatacggtatttgctttgatcgcatagaaattgttacattaattaatataaaaagataatagttgtatatacataatataatgattgtatttatattaaatgtcacaaaactacaattatttggttaaatctaatcatgtttttaaaatatgttacaaaatatattgaacaaaagctaagaattgcaaatttaattctataattaaaatatgttgcacaaaacaataattgcaaaaatgaagtacatgtaatcctagtgatatttgcgtgggactttcgtcgagtttgggtagaatcatagtcggtgatattcggtgcaccgtactaccgtactatgtaggttatttgctcagtgaatcatagtcgaaaatactcattatttctcatagttcttgttctatgagtggtagggtgcaccataatattcaaaaaatgctatccacttagtatactcattcgtcagagtagcttggacgtaccgtcaagagatagaagtgcttgctcaatcacattgagttagtgaaaagaccacttggtttgatggtatgattgatcttctacgtccattataattaccacattgaatgtatatgtcagatatacttatagattcaacaaacttctagttcacgataagtcatctttagttaaaattcgcacaaataattccaatatattttatgcaattctatatattttaccgcaatattaattaaaaataataaaagcattacaaataatcaataatcataaatgccataaataaattttataatcatgaatatatgaaatataatttcagtgtattttgcaaatttacaatgccattcaaacaaatattccaaatacagagggccatttatgtattttctagaaatttcagggtttaaaacgcaaagtttccaatgcagaggaatatgcgattaatttttggaaaccacaagggcctttttgcaaaatctatggagattttttccttcttctctactttctttcctccttccttatctttccttccttcttctatttacttttctttccccttcctccactgatggcgccagcgggtgcagaggctggacggacggcaacggcgcggtgggtgcagaggccggtgaggcgctgcggccggccgttggcgtcgtggccgggtgacggagaggaggaggccgtgtggcggctccgtgcgatttggaggccgggacggcgtggtggggctggctgcggcctcggatggaggaggcggtggcgacagctgcggccgctcgcgcgcgcggatcatgcagcggcggcttaggcgcgtggatccggtggcggcggctgctcgggcgcgcggatccgggtattcccccacacggatcctgagtcggcggcggcagcgtagtctcacctccccacggtggcggcgtgccctctcactccctctccttcccgtccctttcccctctcttctctatcgccggcaactcccacaggccggatccggcgtaggcgtcggtggcccggttgcggtgccttcccctccaccagatccggcggcgagaggggaggcggtggctgcccggtggcgggatgattatttagatgttcttgtgtgatgttttagtgaaaaatttctgtgatgtttttcaatgtttcctatgatgttttttggtttgggattgggattgattgatgcggggtggataaggtcgatgcatcagctcgattaggagaggggaatctgttgttcttgaggatttttattcaatgtgatttctttatctactactgagtcctgactgttctagatgaggtccattggatatttttttttcaccgttgatatgacatcagacggccacgggaggggtgcgcatacgtggccgcttctccagccgagaatcccgctggggctcgaagcgtggtgccacgtggcccaatcactgggcagggttagaaccgtgcaatcgtatatagagatatgtaggggcagacctaggtccaaggcaacatgggtcatggcctggcgcgggttcataatccaatgggtctagctagggacagaatagtatgggccagcttgggccttaattagcctatgccttgtccgcccctataactatgatgagatcatatggcggtataataattgtgtgtgaaataatggtatatatatagagggagtgaaacttggaacacatacatcattacaatcaacaggtgacgatgtcgttgctgtaaaatttactctacaaattatgtgaagtaattgttatataaattgaccaacatcggtcgaggagcagagtgatctaatatactccatgcatttatttttgtaaggtttattttgattctataagaaatcaaattttgtagattttgaccaatgtaaagttaggaaactcaaaagtatatttaattaatgcataaaattaaactaaaccatacgctttattcatacaattaatattggctttatgagaaattgatggctaaagtttgatcatgaagacattttataattactatatgtacatttaaagtagtaagtactacttcaacaaagcataggagttaaacaaacatttataatatgagtgaggattgagtaaagtaaagtaaagtatttcttgtattgtacaccatccccgcaatccaaactacaaattgctataagttgtatagtaccacctacacattcgatgattaattatgcatctcctctactatttttataaaaatagtagaattttcttacgccacatgtgtccgatttggccaacattgtctccactcgaagcaatgagagtctgcgtccgattcctgcgtacatcgtgcaacgccgcacgtttgttaccaatttgcgttgccggcatccgattggcattgatgtcttctctgcgtagcccactatatttccttccatatctcgcatgatctacgttgccgagggaggcgacttgacatgagacgggctgggccttcctgcatcgaccgtgccatgcatatagatcgaatccgtttcagtccgaagcaagagactacgatggaatatattgacgtgcaatcctttcgcgcattggcaaataaaaagggacgatgatgggataataaacaacaagacttaactgtctatctgtataggttttgcatggatgcaaaaatcatagcaagggctcctattttcatcaagcaaataatggccaactcgtcgaccgacctcgagcttcctttctagagtaggatatactgcatatacttaatatgtgatattaacattgcttcaacccattacaacgcatgagtattttctctagttactatataattgtatcccactaattagcttaaatattttatatgtctttccacaggcttcgtaatgatcactaaatcatacccgtacaattagattcattagtaaaatcatagctgtttgattagatctatatgtcaatctctatctatatactattataaaattggagatgtttctgttggaattttggtacgttatccttgtttgagttggttgtatgtcgtccgtatccaattcgatgcgaatctagaataactattatacacccatatcccatcccaacccaaccctaccggccaactctatcccgcgtgcctccaatcggcgccacacacgaccctcccttgatcggcatctttttttctctcccttttatttttatttttctcattttttctcccgataatcctaatactctccttctccttctaatctcgtctcatttatctttttctcttccaaatttccctcctcataaatagtttccttttgaatttatcattgtttaaggtgtgcatacgacaagtttgttactctgcaaatgctttccaactatagtaaaaaaattattaattgaataatcaaaatttcagtctttgatcgatgagtatagcaaaatgcacatgcgtcaacttatggaatggccacccgattgatttgtgaagctatggaaagacgtacataagtgattcttcgtgtgatgacacatgaagcacgcacaacccggttgaatgctatatatggtttctgactttgttttgctattgatttgtttgtttaatttcggtttgttgtttaaattgatcgagttttattaatcgtgaaaattattttcacctgttgcaatgcacatgtatttttgctagttatttaaatgccagaccagcccggaccaacttctacaaacaaatgagtccatccagaccaacaaagtaaaatcagctattggcatgtggcacaatatactagtatgcagggacttagaccatgtgcactttttccatatgaagatgctagggggatgtgtttggttgaaaggaaatccctacatggatatgaccatccaacttaactatgtttggttgataggaaggacgaatcatgaatgagaccgttataagagagaatatttcatgcagatgctggatgagctatttcggaaatattggccggatgagaccatccaccttttctaatcttgacaataatgataattaatatattttgttgttaaatagtaattaattgtcaaggtttgtgttgattagagataatgagtcattttgttgttaatttgtgtataatatggagaagttaatgataactaccgctaatatagaatatattatgttattaataaaaactttcatatttccagttattcatccacatcaatctaaccaagtaagaaactaaatcattcccatccacctaacaaattaaacaaaaaactggatcatatccctaaaaaattagatcatcatagctactcaaacttgacaatcaaccattaatctggatcataattcctggtcatggcttatcccttttgaaaattttgttaatagctagtccctagttacttctgttaagattgttctcagatacgttacaatgagcattcacatcgatctactcaaacaagtaccaccataatacctggggttgattgtcttataccaaaaactcttatggttttgtgcaacttgaaccataataccctgtattttatataatttaatatgtttttttatgcaggtgttaagtaattggtgctaaaatctagcactctattttggaagaaaagaaatgagaggaatgcatataaccagtaggaatcactatgaggtgctatagcctataggctgcagtattttttaattacttagctatcttaagcatggcctatggttccatcttggtgtttatatctagctactactatgcaaatatattacccttttatagagagagaattaccagatggttgtgtcaagaggttgagtatggctgatggtattggagaattgggatgaactgtcttccagtatgccatcacgtcagccgtgcggtctggcaccatcatcgtcatcttctttgcgctcaacaacttcctcccctcgccaactccgaccaccatcacctgtcaaccaaccaaccaaccatcatacatcactactgatgtagccaagatgtgttatttcaacaaaagctttcatagatgattttttcaatttatacacttaaaaaaaaaactaaaacacaactaaaccacccactacaatatcacttgtaggctacacgggccaatttcacaccacactgcaggttgcaaacaggcatgggtattacgaatctcccccaaagattctaccataggataacccaattcccgccacctaccagcttggcaaggaacaatcaaggcatcgttcaacacacatgtgaactatgaaagtatatatagcctgtgataatttgtgacatatacacaaacatcatatcgtgtagagtgtgattcaaaaaagtaaattattccttgcaaaaaggaaaagaagaaaaaatatatcgtgagtgggtgaaaaagcatggatgtaagagctcaacttaatggagacaacacttacaagaataaatgagaggagtgacaaaagagtactcattgcttagtctcagataattttagcattggctgcttatagttcttgctcaatttggtcaggactagcacaagaggtatttataggctagcatcgctatcacgatcacgtacaatcatctgctaaaaaacaaagaaattgagaaatggtggcaggatctaaaaattaattctgaattaattttccatgctggggcgcacatgctttttttacactgtatatgtattaaattcaaataaaggaataccctgtgaaaacagtgtaaatccactgcaaactttaaaaggtattaccaaagtaacttttcataacgtctatgtatcttattatataaaattttacaatggcgaaagatataaaatcatcaatttaaagtagtatggctagaaaactacatgaaatttagtaaatttacactgtataaatgtaatacatacattgtaaaaaagatggaaatccaaaaatgatcaatcaattgaacatctaatctataccttctataaaactacaatccactaatcacataaagctcaaaatgcaagcataacagttattagttaacatacaagtagatcacacatcaacccactaagcactaaaagatcaacatgcatagtaaatactaaaacttaaatgtaactacatacattacctataaattattattttttaaagctcaacatataaaaatgttaattcattattactcatatcatttccacaatatttatatctaaattcattcatcatttcaacatcatttaatacatattcattcatatatcctgtagcaaagcgcggggtgtcacctagtaactgctatacaacaatcactagtattctcgattgacaacctcctcaatccaagcttccatctcgtggtgcttggtcacgcagttcatacgagtgaacgaaagtgagttttactatgaacttaaggatactgtgaacgatctcctttcagaaatcactcctgttgagaggccctcctcctcccttttttctcaatatggaagagaggcagaagagaaatccagagatagctcaactttttcatggaaaagttggggatcgaatgcaagattgagtccctgctggatggaatggaaacactagaaagatcataagaaaccgagctcaaagtgaatcgcaagagaaccccccatcccttagaaggatttgaagctgtttagacactcatagacaagtaaaatccaactcaggttcctcgagaagtgaagtgaacgagcaaggtaaaacacaatcaagttaggaaaagagtctttcatgccaaggtgaacatagataggtagagttagtttattttccttaattaccagagagaagacttacatgcctgtttgactccgcatatatacccccattaaaaagagctctgcatatagatattcgatgacatgtaaatcaaccattttttcctttttgataatcctacggtctgctcttttccctggggtgctggatatgttcttcattgcttccgacagcaatatttcaacctgagcggcttttcctttatatatgtaggtattgcaatgaaacatttgttcctagtaaaatccctaatctaatcttgctagttagatctagagacaatgatgaaattcgtaccacttaatgtgttgctatgaagaccagaggagctgttaagttactctagttaatttggccacagcctaatttgccattagtgtcacattcacaaactgctgatcacaactgtactaaattttggcgactgtctgggcatataacatacagacaagtggtgtaataaaatgtttggcttgattcagttgtaaaattgaaccaaacagttcctgaataaattgtgcagctaaccaacaaacaagcccctcaagcttcaacatcattttgttaggtagcagttatgtttcgtttggatggtctcttgtgtgttctgtttggaggagtttttggcagctgtagttttcttgaagtcaaaagcttgtctaaacaatatagcttttcatccagattcttagaagatgtagttatagaatccagaaaataaactagattctcaccagctgaatttctactaatagcttcatagaatctaaagctacctaaacatgcccttagatgatgccaccagtgggagctattctattatcctttttagctagatgtgccatgactatgggtttgtttagccaatcttaaggttttagctagacgatgaaatctgtttgttgaataattttctatgtagtatgtttgtttcttattttgaaagaaatgtatggcatggttcctataactttaaatttttaatgtataatgtcattgacttttggagatatgtttgactattcatcttatattaaaaaataactaattagcaagtgtgaagaaaatataagttgtgcttaaagtagctttagtaataaacaaaccacagtaaattaaatgatagctacgcaatccttttagtaagaagaatttgatcaaatgttttctcaagtatagcagcatcatatattaaaaacgtacaggaggaattatagcacccgagggagaaaaagagggagcgaagggcttccagcagttcaatgggattgtaaatacttttggttttttcctcctttcaattaaattcccgcagttcttctgccgtcgtttctgcttaaaaaaaaaagggcttccagctgagtttcatgacagcgccattaattgattgttagcccgatagaggctccacgacaactcccaactaatatcatgaacatttatgcatacatgatctgacgatcggtatgtgctactgacttggaaggtatagaaggtttggtatggatcgaccattaataacacgttggccatattattaattagttgatgacctcaacggtatctaaaatttaaagtgtgactttcaaatacaggaagttagctagatggcatgtatgccattaaaattctgtttgtcactcccctttaaaagaaattgtttgtcacaaatagacagttcctatttcgaactaacacacaaatatgcaactgggtgacaaatgtgcccctactttcgtctgttcaaatgatctgggtttgaacaatgatttttgtttgtgtacttaaccaggaaaacatcctctcaaaataagaaaaatattgttgggaggaaggtgtagtatagtctattcatgatattttactagaattaattttacgatccatctattttactagaaattaatttactcacattgtttaattgaaaagacattatccaatataatgttttggaatagcttaaaatttatccaagcaaatatatatggacaaaagggtccagtttgagttttagcaaatgtattttgaagcgtattttgacttgtgtttagggtaggacacatgcctcgggagatttgtcatccaatggacaatgacacattctccctgggtttggaataataagcatgacatacttgtgccaagtgaatttttagaggcttatttaggatcgagagatgttcctttgaaatctttttttttcttataacctgaggagatccaaggtgacaagtcggccaccgaatactgtcgccacttccggagcatggatgatgcgatggccgacctcggcgaacctatcaccgagtgcacgctagtcctcgcactttcacgaggtttgaataaaaagtacaataatctgcaaactgtattgcccttatagcgtcgcttccccaccttcctcgaggcatgctctcagctgcttcttgcggaaatcaacaagggacaacagaccaccagaaccgccattgccttcgtcgcctccaccaacaacggttccggtggagctgggtctgtcgtcactgctgcatccagcaccaccaactccacctccgggaacggtggcaacaactgcaatcactgccatgggtgtggcaatggagatagcggcaacggtggcactgctcaggcctccgaacaaggtggcggcggcatccaagccacccactcaggccaacaggctgcgggagagtggcaactagtcccaacaccaagtcacgccgtagcacaccccttacaatccctgtgccgataccattcaaatatcaggccatgctctcagcatgctgggccaggtgttggcggtccttaaataccaaatgaaacactggacgtagtggtagggtttgttactaaccaattccacaagtgttggtaaatatttgtatgtagttgattatggatgaaagtacacctgctgtgtaacgaaattgtcctccaaacgtcagaacatcgtctcctactccagcactaaagccgagtatagagcatttgcaatgttgttgttggaacatgctggcttcaccaacttttgcacgagctgcattcacatcccactcgaaccactttggtctattgtgacaacatcactgcagttcagcaccagcacatcaagcacgtcgagattgatctccattttgtccatggttgtgtgactactcgcactattcaagttctacatgtgtgaactacatcccagtatgctgatatattcacaaaagggttgccgactgatgtcttctttgagtttcggtctagtctcaatgtccagcctgttgacgttgcgattgccgggggtgttagcatatctcatgtatatcgcatgttttctttcttttggccagtcctcccaatatccctcccaggcatgtttctataaactggttgagtaggatactaggataaggatgattatgtgcctatatgtactcggcgttgtgatcaatcgatattgtgttgagtccatcaatctaagagtctgttgggccactcctctcaggctctcacgatgcctgcgcctgcacacgctcttgcacttgacgtggccgatctcacatcagtcatggaacaccaatctatggagcttgcatgattgtgacgacacctgatctctatctgcaactctgtgtctccattttctcatcctggatccaatgggtggcggtgagaacattggggatattatggaataagttcaccggaggtccctcaatttaacaccaagattttttgagatcccttaaccacaaaacaagaaatgtgcacccctaaacttatataaaccgtgcacataaggtcctatggcagtatatgtgggtggtttcgctgacgtggcatcctagtaagcaaaaataaataaataaagtacgtggggcccacatgtaagagagaaaacgatatgggcccacatcccttgtttcttcccctttcttctcttctctcgtcttcttcgatgggccgagacgcgcggggcgacggctggcgagagcggccgcggcggcggcggcggcaggcgaagaagtcaggcgcggtggtggcaggcgaacgcggtggcggtgggcgagagcggcggcagcggcgggctaagcaggcaggggcggccggcgaagcaggcaagggcggcagggttgagcgccggcggccgcgcgtgcccaccgtggtcctccgtgtccgcctcgtcgtcctctgtggttgcgccgccggccgcgtcgttgaggcggctgctcgtcgcggtggtcttgttcacgtggccgagcagagcggacggcgggcggaggagggggccgcaacggcggaggtggccgaaggaggagcgtggcggcggtgggcgagctccgcgggcctacaccgccagccgagccgtcatcgtcctcgtcgtcggccgagccatcctcatccgcgccgagcgccgcgcaccgctggttccccctgccaactacaccctctccgcgtccccgtccgcatcctcgcgctctccgtctccgaccccgacgtcccgctcagccccgccgtcgacgagtcctacacgctctccgtcgacaagtcctacacgctctccccgccgtgctcgtccgctcgcccaccgtcgtgctcgttcgctctgcccgccgccgtgctcgtccgctcgctcgcaggccgcgctcgcctgctgccgctcggctgccgcgcggacccgccgccgcgctcgctcgctgcccgcccatcgctgctccgccctctccgccgccagcgtctacgcggccgcttcttgccgctgccggcggcaacggcactcccggagtccatggagctcggcgacgacgcgttgagcgagctgcaggcggccgagctcgcgtctttgctgctgctgctgcaggtgcaactattgctctcctgggttagcacttgctcttgctccatctgtgtgacgagctagcgcgcgacgaccaccaagattgcttgctagtggaccgccggcctcactcagtgaagaagaagagaaagaggagagataaaagagaagagaaggagaagaaaagcaaagaaaaaaaaagtactattgatatgtgggccccacgtacttttttaattttttttttactagaatgccacgtcagcgaaaccacccacatatactgccatgggacttcctttgaacggtttgtgtgagtttatgggtacacatttctggttttgtggttaagggacttcagaaaatctcgctgttaagttgagggacctccggtgaacttattccggatattattgacaggagcagtgtggagccaaatccgccgctgttgctgattgctactccatcaagggctcgagctgtgtggatcaggccgcttccgccgcttggcccactccactagcttgcctacaccctaacacagcaaggggtgggcacatggctacggtgtaggtgcccccacctaggtgaaccctcactttacagtgtagattgcaacaacaacatgtaaattacaacaacgattcttctgttaactatttcgacgaacctgcagtttaatctgaaaatttaggcaaaatgtgaccattgcagtctttttcttctttctcaaacacactattccagtcttttggaatgaccctaaagctgatcagttaattgtgaaggaaccctctacttcgcagaagcagaaatgatatttggcatatactttgcagaaacagaaacacaacttggcggtggctggtttatttagaaatctctgcttggttttgatggcaagcatggtaatttcagaattctccaattcttgttgacaaaaaaattctgctggttgaacatggtgtgatagtgatttgagacattaatcaatgatggattatctgcttgcctgttctttctgttacatgagttgtggggtgtttttctgttaaattaatctaggttgctctcttgatctgatctagacagatcctgagcaaaggttgcaattaggaaaacaaaaagaaaaggtgagagagggtgctagttgaagttattgaatggcttagtatacctgttgactgtagatcagtcaattttagttcaaatgtttattgattttgtcatgtatactgtactatggtttgtgaagaacaagaagaatttgtatttggtctacttaattgatctaaattatgtagaacttcatgattttcttcagtgcaaaacatttctaaaaaactgccaattgtagctttttttcatttttctttgtatccccataaagaactaccataacttttttttttaccttgtgcgaaatgacatatgcaattttttaacaaagaagcagtcttatatcatgcgtgtgaggccatatatcaacattttcttcagtgcaacagtcttttctattctaatctgctactagaaaatcatgtgcctcacattttacaggatctttgatgatatgaatgcttaaggatgctattttgaattgctggttttctcagcaagcaaaagttgcatggttttgtctgatcattttttattacttcacaatgatgatagataggatattgcattgtgttgtctgatttggacattcttgaactgcagccctttaaacttatatttttcatattgtccttacaaataatgagatcttctcatcaaatgtttctagacaaacactgcttactacaggggaatctctgtgctctttatccaatctgcagagatgagggtaccagggagttgtacaaggttcttggtgccacttacatattgttatatgttatactatttaatgaatgtctaaaacacaaggaataggtcccccatcatagcaataagcttctgctttatgttaaaaaaaaaacgattctatgtgtgaagctttgtgatctcataggcaactagagaggtaaaagcacatggtaaacctaggttccactggtggagaaatgctctttactcccggtttagaaccctttgtagtcccaatttttcaaccgggactacgaatccgggactaaagatcgctatctttagttccggttcaaataaccaggactaaagatcaatctttagtctcggttaataacaccaaccgggagtaaagaggggaatctttagtcccggggatagcggcagtccctcgaggtcccttttctttcttttttttttcattgttaatttgctaatggctagagttaatccctgtattttctcccaaatcgagtgggatacacatccccaaatcaacatcctaaatattaagttacttatacacacagaacaaatacatcacaaatcctatacacagatcaaatacatcacaaatcctaaaaaactacacacaaattaaatacatcacatattatacaagattatacatctcagatccatgcgatgtaatgaatcacaaattctaaaaaaaaaaatacatccagtgaaacacaaattataaaaaaaaagcaaatgagccggccgccgctcgcctgcccgcgcgcggccgtgccgccgcccgccgccccacgcctggccgcgctaccgccgcccaccgcccgcctccccaccgccgccggccggctgatgggagggagtagaagggaggaggaggaagggccgactgatgggagggagtagaggggaggaggagggaggggaggaggaggg

SEQ ID NO: 16523 - DNA, 3532 bp, Oryza sativa
atttttagtcctggttggtagtaccaaccgggagtaaagatctaaatgatctttagtcccggttggtagccccctgacaatacctgtgacggggctgaaccaggactaaaatcatctttagtcctggttggagatcacaatttttttaaccggaactaaaaatcgtttttagtcccggtttttaatgaaaccgggactattgtggaatttggtcgaccgaccaaagatggtttctccaccagtgttcttatacattttcttaacattgatttttattttaactgcattttaagttgatcttaaaatcggaccatatgatttacttactctgaatagcttattttctggatgttcttcaggaatttggatgcaactgcactaggaattcatctggatttttttggttggttgtgataactgcagcaaaacatctcaagaggataaaccttcactgtcattgaaataaaaaatacacttattaattgaataacgtatttttaatccattctgaacagtgcagaactttctgaattatctatcggtgtttagcggttgattgttgttttattgaggggtattattaaatatcaaagtagatagatgcagataaagaatcaagttttatgacttggttttagttatacatatttttcttcaaagtgcaaaaataaaaattgtactccctccgtcccatgatataagggattttgagtttttgcttgcactgtttgaccactcgtcttatttaaaaaaattgtgatggtgactcatacatatattgtcattactaaatatcaccatagcattagcacgggcacaataatgttttatagtcaattaatgacttgtttctttttagtatcgctaagcagctcacctaaaaaagttagaacaaaaccatacacaggggccaaaaaaagcagggtgagtggcggccaaggatcaaagtgtcaagggggcatttgcccccgctcactgcaaaattgagtggtgttgatgaaaaacacgaggcctgggagatctgcttaactccagtgcaggtccaaaactcgccttcgggtatgctagcgtaccataccaaatttggtcgttaacaggtgggggcaaaggtccccacttgtaatactctagatctgcacatgaccatacatccctagctccctgccaaatctatgctccctgtagttggtcggcttgtagtagacttgtgacgtacaagtgtaaagaaaaatctatgcactccatcgttataaaaggaaacgctctctcactcccttctcatcacttcgctcactcactctcactcatttcctcccattagtcttcccactcacgtctcactcctctcactcacttctcactcgaatgagtcagcagccaccctgttgtgggcacgcatcctaaggggctgccaaggcaaccagggcgggaagggtagtcggggtcagctaggatgaaaaggagaaccaggtggcgacggtggcttgagcgtacacggtggcgcaagcggcgacggtggtggtctaggttaccatggcgctagaggaggatgaggacaagatagcagaaatggtggccgcgggtcaacggcagtgggcgcataaggtctagggcgaggtggtaagccatgatgcggttatgatcgttaggttggtttagtcattctttttacaacttgcctcgatccttactgcaaatggcaaattcatgcaagaaagagtgtagctaataggtggaggataactagtgcaggtgaagacaaacatgctcagtgcggaattatctggcaagtacttgcagctaacttcaaggtttattggcaacaggttacagacatttgtccaagctgagccaatcttgtgtcctgtaggtattgtcgaggcagttgagcaaatatgtcactatcgacatacgtacaacaaagcttggcgtgtttagcaagttgctatgaaggttgtttggggagattgggacgaggcatatgaatgccatgaaagaaaaaaaaaacccgaacatgcattttcgtgttgaggctcaccatgagaagtcaagaattgtggaaggagtgcatagttgtgtatttggccgtgcgtcatgatattcgggcagttagtggaggcattcaagcacttgaggtcggtgttagcaattgatgggaccttcttgaccggtaaatttaggggtgtattgctcacaaaaatagggacattgtctgatcagccataatagagaagtgtgtataatatctgataagcacccaggcatattgaactccatcaacaacgagatactagggcatcaacccattcaccatagatggtgcacgaggcacctatgcactaacttctatatcactagagctacccaggatcagatgaatgacctcgagcgcatatgtcaaataaacaagaaagttgtgttcctatgtgcggtgaagtgccccatgggtttggttggaaagtgatcaaagaagtggctagaggacaatatgccacttaaggttaaatgggccagatcatttgataccgatggacgtctatacaacttcatggctagcaatatggtcgagagtttctacaatgtcttgagaggcattcaaaaattctttttatgtcaaaaggagaatgtgtaataacttttttataccaagagcacgatatgagaggagagatgagttgcacaagaaacgggggcgggtggggtaggaaagaaaattcttgacattgaaaatagaggaggagcgagggaggggggaatgagtgaagagtctagtggagacaacaaatgttgataaatgtgggtgtaattctttttacatcaagatgaggggctgtgaggcgcactattaagtagcgcactgtttagcgcatattagtttgttttttttactttacgcatgcatgacctatttagttttatatttacatcagattttctttcatatgaccgatgaaaggtctgagagttttataaaaaattaacagcaccatacatttaaaagcaagaagtaattttttttattagataaggatattttttacctggcctatacatccaaccgtgtgtatatatatatatatatatgtgtatatacatatgtatatgtatatatatatatatgtatatgtatatacatatatatgtatatgtatatatatgcagctatttaaattgggaacttagccatacgaacaaccaaatctaaaattcactcctatggagatatatttgaaggatcttatggtgctaggaataattaaatgtgcaaccactatatcttccattcactcaagtacattcttgtcacatcacatcttattctcacgttaagctcgcgctcttagtatgatttcacgtgtttctcgcaggcgtggttatttgtcacatcaagttccagatctcattcaaatgcatttcgctactaggtaattaagttaataattacatttgttagaagtgtatatcacaataataaaatgcaaacgcatttccaatattgctgattaaataacacttattctaaaagaaagta

SEQ ID NO: 16524 - DNA, 4839 bp, Oryza sativa
cccttatattgtgggacagagggagtaaaaatgaagggagctaggagagcgatggatatatgccttcctagctagttcccacacccctcttagctacggaactaaaaataacaacaacaacataataacagaacacataaaaaaatggattagtatgattttttaaagtaattttcctatagacttttttagaaaaaaaatattgtttaatagtttgtgaagcgtgtgcgtgaaaaacaagttagaaaaggttgggacattcacataaaaactcagcctaattaagctggtgtttatgtcacttttaggtccgtatgttttgatacaccatgaacagtagtgctccccctctcacatcgtaaaaagcagtgctccctcgtaataattcagtgaaatgcaaatcagtactatgttgtgttcttaaataatgtagaataaaaataaaaatatactaccgttgttccaaaatataccattataagatggatacatgtattaagaaaatgaaagtgattaaaaacatgttgtgattgattgagaagaaaaaaagaaaaaattaaagggaacatagttgtaatttgttgaaaaaatatattaaaaaattagctttattttggtacaagttaagtacatatctgggttagaagcagtgagaaagaagtgagaggattcattcgatcattcgtcgccagctacgaaaaatctacaaggacaggaacaaacagatggatgtttcgtcgccatcgcatgcggagcgcgcggtgagccctgcctgccgaatccacgagatatcatatcaaccctgcagcactagctgccactccgtttggtgcagcgtccataaccaaatctagaaataattgccatttccaattaaataattgcacgtgcactgcatgtctggttaataattaaataatcttcgaaagttttgacaaacttgacccggtccattgtcgagataagctctttaaattaagggtcaatttttcaaattttcgcggaagtaatccctagctaactagctagctgaccaattaccattgtttctttaatatatgacttatttggtttttcaaatttatttgactattcgctgaaatattcatgcaaagaaatcacaaacacggtagacatgcttaaagtacttttgattattagtattttttaaatttacttaacaaagtaactaataaataggaaaaaattctatatgtcccaaaaacattggatagaagttcattgaacaccctaaactttaaaattaaacatccaaccaccgaacattgtcataccattcatatattacagacattggttttttatattttaaagtttaaacgaggggttttgacaaaaataatataacatatgcttacataaaatccatcatccgttattagtttgtacagtaatgttatattaagttcgcactcatcccttctttctataaagctaatgcccactaaacacctagagctcaacatgtaagtgttgtatttattagtactcctaaaacctagatgcaagcatgccacatcaacccattaagcacacaaatctcaatatgcaagcatatagtaattatatctacaatttatttcattctaaaactaaacatacacatgctaaaccatcattctcaaattattttcatattatttcaatccaaattatttcattaattctccaatatctaatatatatcccgtggcaaagcgtgggatatcttttagtttatataggagtacaagtgaaagaaataagggggtaaagaagagaatcaagtgaagatttaacatatacatccaagacatatgtcacatattcaaactcatccattgtatatacaaattatatagtaatcatttttttaaaccatcatatgggctgcatagatggtattataaactacataggattaaacgtctggttttaaagtttagggtgttagatggactatcatctaaagtttacggggtatatggaatttcttccccaataaatattattcaaagtttaaggaaaaaaatctacatcatatattagaaatggagaggtatatacgtgggtttagactgatggtgtgatattatctttcacgttatattttaataaacacggatgacctataacatgtttattttttttcctccgaggaatggccctcgtaaccatgttgtctattcagatctgcacaatatttttataattaatgatttctaatatagtatacatgacaggctatcatcttactataatagagcgtatggccccatcatttggcttattacggaataagccaaacgacatatttgcaaatgaaaaataatttgtaaataaaacttttttatatgtgtttttagtgatctaaaagcaaaggctaaaaagaaaacttcggtgaaaatccctaaaatcatgataagtataagcataagcgaaaaatgaggcttgtttctcccttgttttctcatgatttcacatcatcatagcatactccctcatactataaaattgttcatgcgcaagctactccctcacctagtcgattaattatattggccgcgtggtcactagcatgcatcatttcgttaattaattaattgctcttacgtacccttccattttcggtgtataaataggcaacctccagtggacatggcctcttcagagatacatataccatcaactcacgtaatggatgtcctcgtactactcatctcactgatcctcctggtgagtgtgaatttgctgttaatttagtttagaaattaacctctgaagatacattctgcgtgacagttaattgattatatatatgtttatatgcggcaatcaatcgtatctctcctgtcagtaatttttaccaacgtaacttaatttatcaaggtatatataccttacaaagtgtaaaccctgcttactactcttacttattagtatctctgctatcacttaatttttttttcatttactcggaattgattgctttacattgtttgtcaattatgttaggctttgttcggcaacaatatacagtgttttcttattaaaaaatattactgtgtttctaaatgaagagttagctagctagttttggaatatgtaataacatgggaagaataactgtaaactagcatgcactacccagtacctacatagagtgcttatattatggtatatatacacattatttagttttcatttgatttattgtctagattagttttttctgtacttcatatgttggtgagtatacatgtcagttgtaacttaggtgatgtcacaaattatattataagttgcaacaattttggaatgcacgataatcataaatataaggcaaaatttgctacacgacacgtaaaaattgtgtaattagctgagggacaccgcaaaaacgtgacactgccccaacacactacaaaaactgtgaaatttgctgtaggacaccgtgcacattattttatcattttctagctgaaagtggtgagaatatttttgaaatgcccagattgcccccgcacgtcaccacacacagacaaaaaaaacaattctccattaggatggccgaaggggcgcagctagctgcggccggaggggcggcgcgagcggcggggcacggcctggtggcggcagcgccggtgcgacgggggcgcagccgagcggaggaagagttcgaccctggcgttggcactgggcacggcagaccgaggatggcacgacgatgccagcggctgggcggaggtagcgcggcgttcacggcgtggacccgaaggcgacgacatcgacattgagggcatggtgctgctacagcctgcttctggggcgcgcggtggctgccgtcggaggaggaggaggaggccagctggcgcgacgagccgctgatggtcgcgccggacaggctggacgcgctcgggccgtacatgacgggcggcaccgctggcaacgacgccccgcggatcgaccctcccgccaaggacgtgtcgttgcttccacgctgcagtgcgctggttgccgtcgccgagaaggaagtactgagtgaacgcggccgctagtactgagtgaacgcggcgcccttggttgaacaaaaagcaacgagaaagagagagaatgggagagagagaaaagataaggaagaataaagaaaaaagaaaaaaaatgaaggatagaatcgtacttacacaggtgtttctctctccaattcctccggatataataaaattatccgacgggtgtccaacagcaaattaccggttttttgtggtgttctttagcaaatttacgttcttgcgatgtccacaggctaattatacatttttttggatgtcctgtagtaaattttgcctaaatataatgcagatcggaggaagcagcggtgcaaacatggcggttgctgtgaccaaaccgtccccaacagcgatggagtattggcagaaaaaattccctgagacacccatgcccccagccatactagacctgctgacaccactgcctacaggtctctatctttctgctgatagttattaaaccaagaaatatttaaatttatatggttaaaatttaagtacttgttgagacaaatatattgctagatataatttactgtacattaaatacaaacatttaagaagatattaatacacagttttgaaagtgtaatataacaccactttttcaaaaagactagcctttttttcccaagcctcctattacactgctagtaaaaatcgattttcgcaggtgatctaaataaagaggggacgagtgtgttgtcaaaaatggtttttttaactactatgagatcatatagttctttttcctgataacatggaaaaa

SEQ ID NO: 16525 - DNA, 1167 bp, Oryza sativa
cgggctacaaagaaactaaaggaaagatgtatgttgtaatacgctggatatcttatatatatatcaactgaaaacaaaaagaattgggccacattagctgcagaaggactcaaggaagtttctgtgtcatatggaagtgaaggtaaagaggagcctaagaaagcattccccatgggacgatatatgttagacaaggaacgagaaatgacttcatgtatagataaaggttagaacgtttgaatttggtatattgtatttttgtatatgtcattgaaatatataaagaactaaataaattgtttctatatgggccttgaactagagacaaactcaaagaagtccaggtattagagaacattagcgtattgtatatttgtaaaagttgttaacataaaaagaaaaaatataaaaatattttctgtattgcctatgaattgtagaggacctcagagaagtctcagtgtcatatgactcaaacgtgaaactaagcaatttgttcccaacaggtatgcacatcagaaatatatactaacaagcggaggttacattagaacttgtggatgttcatgttacatgtagtgtatatatgttgcatacatgtatatttggaattataaaatgggggcatatgagttgcagcgggactaaaggaagtctccatgacatatggaagtgatggtgaagaggagccaaggaaaacattctctcaagtagggtatatgttagataaggaacgcaagaagtcttcagatgtagatgaaggtacaatatttgagagtgcattatgtgttctgtgttttctctatgttgttgacatatttggaaaaactacataaattatttctacatggaccatgaactgtaggggaactcggaatagtctgggtgtcatatggcccaaaagtgaaactacacaattagttccccacagaacataagaaataaatatacataaacgaagatgatattatttggaactaaaggagattagtgtaatgtattgcatgtctcatataaatgtctattgaaaataaaaacaaatgagccttacgagctgcagatggactaaaggaagtctcggtgtcatatggaagtaatggcgaagaggagacaagcaaaacctttgctatgggaggattcatggcagataaggaatgcgaaatgtcc

SEQ ID NO: 16526 - DNA, 711 bp, Oryza sativa
atttggtttttatattccaatttcctaatctatgatgatctcgttgagttttgcttgtttgaaaaaacacagtgctttaagaactttttagatcaccatgtccgactcttttttgacattagattttagtaagatttataagctgtataatacttatcttttttgaagcgtgggatgtgccttttgcacaatacataaccatattgactaatcttaccgttgcctgatgctattcttctctgtatctgactatctgccgatgatttcttcttgtgttatttcacaatattgagattcataataactcaaggatgtgcatatcaggtacatgatactagcaacatccacagtatcgacattcgtgaaatatatattctatgtcagtgacatgctaatggaaggtcaatgggagaaaaaggcagtgtatacattttacttggagctcatcagtgaccttgtacacttgtctttgtatatgctcttcttcatagctatcttcctgtaagttctcttaagatgatatttctgctttatgtgttgtactgtcaacctgggtaattgatcttctatattgatatatcaggaactatggtgtcccactgcacttgatacgtgagctgtatgagacatttcgcaacttcagaatccgtatcgcggattatgtacgctacagaaagataacttccaacatgaatgaaagattttcagatg

SEQ ID NO: 16527 - DNA, 617 bp, Oryza sativa
  unsure (1)..(617): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagttggagctagtaagctatagtgacaatgtccactagcagcaatccatcctatcaccagctgggcctcgacgccatcagctgctgcttcgtcgccggcggcggcggtgcagaggcggcggcgccgttctttggttttgggttcggggatgtggacggcgagttcttggtcgcctcgccggtggctgctgttggcgacgagctggcgtgcgccgtgcctctgcggcggccgcaggggagcgtgtcggaggaggaggtgaatgccgccgcggtcgccgccgccgcggccggtggcgcggagagctgcagcaccgtgcactcggtgctgggttcggtggagtttgggtgtggaacgtcgtcgggtgtcaccattgctcaggcgtcgaggatgggaaggctcgccggagaggcgcc

SEQ ID NO: 16528 - DNA, 10980 bp, Oryza sativa
gagatgcaggtggacgagaagtgcaaccaatgcgtcgaggagatgcagagcacggcggcgaggttcaacagcatggtgcgctccaccggcggcggcggcggcgggctgacggcggcgttcgcggggcgggcggtggcggcggcgtacaggagggtgaggaggcgggtgatgggacagctggtggcggcggcgacggcgaggtcgtcgtcgtcggcggcggcggcggcgctggaggagaaggagcggagctgggagtcgtcgttcatccagaagcactgggcgatgcagcagctccggcgaggtgaccagcagtcgtggcggccgcagcgcggcttgccggagaagtccgtcgccgtgctcaaggcctggatgttcgagaacttcctccgcccgtaagctcaacccgcattcttataatctcttcttcttcttgctctcaactctcacatgtcacaaatgatcactctgtgctcatgatcatcactcttactagagttctttttttttttgaaaaaaaaagtttcaaatcagaaacatgatacaatcacacagaaaaaaaggtattaatgtgataatgtccattctttgaagtatagaacaaatataacttgattactggagtaatttctatcctttagacttcagagtggacattaatacctttctttctatcctttagaatggacattaataacatgatacaatcgcacaaacatattgtaagtaggagtagtatgttaacttgagtgctgaagatcttatagagaagtttgcttcgaacggtattgattggatagatgtcatggaaccagttcaaactcttggagtcaagttgtaatcattttttttttttgaagtttgacatctcaaatatattttcctataggtatgaaaatatgactgttttaacagtagtttctactgatggtagaagtggtctagacatttcatcttttctcatccaatggaccatatctactactattaatcatccaatggaccatatcatgattcaaagcaacacaagttcaatgaaaatatgtcaaatgctgattcaggtatccaaaggacagcgagaaggacatgctggcggcgagaagcggcctgagcaggagccaggtgaagcctcattcaatctttcatcatcaaacatccaagctactactacttcacaagatcagagaattgttttcctacttatggaaaaataggggaaaaaatagtattaatgttttgcattttcaggtctcaaactggttcataaacgcccgcgtccgactgtggaagccgatgatcgaggacatgtacgaggagctcaagaagacctccggaggaagcgatggcgcagcagagattgagcatcttagcagcaaagatgtgctcagtttagaaagttagcaagtttcagatgtacaaaatctgagctctgctttgtgagcttctgcatttgcagctaagggccaactagtcacgagtgtccactactgatcaggcccttatctatgaaaccttgaggtttttccttgcatatataaatttatataagttaatttctggtgcctcaaaattgcaatggatagacagtgtgttgccctcttctgtctcctcattttttgacagattgcagattttgctacagttcttgtttaccacgggaccaagactgaatagtttcatgcagatagttccagtccaaaggcagggatctgcctcatttattttaagaaaaaagaaaacagtccattttgagcttatgattgatcgacgaatattccattgatctgagcatttttttcaacgtgactcttctacccaacccaattatccatgcatataaaagtgtactactctcttgttctatattaaagtcatattgagtttgtcctaaatcgaacaaagtttgatcatgtttttagaaaaatgtagtagtgtttcgaacacataaaaaacatgctgtaaaaacatatttagtggtggatttaatgaaaacaatttgatgctatagatatcactatattttttctataaacttggttaaggttaaagaagtttgacttgtaacaaacctaaaatatggagtgaacagagttcaccctaggcatctttgggttgaactcatgaagttggcaaaatccaggtagggagaatcttgcagttacaatgtctgcaaaatgtagatagatatccagtgcacatttctgaagattgaacctgaaccaagcagggtcaaaaaagccatcacatttggctgttcagtgtgatggaaaacaccatgacagattcgcagtcactcagatggaggtaaaaaaaccgaaaagaaaaagggaaagggttttgaaagattttgaagtggccacaagtacaagcatgcttctgttgctgattggatccctttttgcattgcactgttccttgcctgtttgcaatcatgccccatctccctgtatatggttcacggattttgaaaaagaggaaaaaaacatcatcagcacatgaattgtttggcacctgatttggcgtgtgcatccaagttggagtctttggaaaaattattttttttgtttatgatataactggattttccgttcagttttgcgtgatgagactagttgtactggattcgatatacaactcttagggagtgtttgaagagaaggggattgaggagattgggaagatacgcaaaacgaggtaagccattagctcatgattaattgagtattaactattttaaatttcaaaaatggattaatatgattttttaaagcaactttcctattgaaattttttgcaaaaaacgcaccgtttagtagtttgaaaagcgtgcgcgcggaaaacgagagacaatctctcctatctccacctaacgaacactcccttagtttcttttttttttggtatgcagggttgtaatattgtagatatacaatagatttcgatagtaagatttcatttgatataaaattcttagctcttgttaccatttataaaattgtacgttgcacacaactattattggacaatctacgctattataaaatgaacccaccgtaataaattgggattttattcgttttctttgattaatgtgagaattttgactcatttttttagctattttgataatataatagaaactctatcgagcattggtacacatatgaaactgctaggaattaaaacacaagtatgctttgagctgaccgatcatatctgaaatggcaggagtcatgcttgtatgtgcatggatgtggactcatctgggtatacaaggaacaaaggatggattgggacacctttcatctcctaggatattgccacgttagctaacaatcctaccagcacaaggaaaaggtagtattctctcgatcgacgaaactgatgtggtagattcatgggagaaaaaaaccacttcttgatatgttattgttgtacgaggttatggatgcacattcaaatctagatgtgcacaaatacatatatgtgagtgtgtttatttaagatttttttttttgcaaggcatatgatcttatccctggtctttgtctatttctgtgtgtatcaatctaagagggtgcacctaggatggatattgcagggcatgaacttacatgcatgatgtagtgtatgtccatggttctgtttgaaaagcttctggttagaagtcgatattgagttagcttggctcggatcattattctaacgagctaaaagaccttgagctggtaaatgagccgagcaaaagaagactcctaaatccctagctgctagttggtgaaagcgtaattgagtcagcgtgataattcgattaatcacgggccatgagtacatatagagacaatacttccttatctctacatccgacttgtagaatcagaatcgggaaataattagagaaaccgactaagataagatacaaaatatatctctaaatgttggattcctaggttgccagttttcccatggcttgtttggctcatgaggcttgttatgtgtaacactaaaccccccttgctcagtttgttggcaattctaaaagagtcgagtagcgagctaacgagccattatttatctagctctacttctggtaactatagcttatcctagaaccttcaacaccctaagcaatattattgattctcacttagatcttggtagtatatagtcatatttttaaaaaaaaaatgaaaagaagctgagaaatttaattttttagattctcattagctgcctattcacgagctatttcttaaaatccagagttcttaaaccaagctgcatttcttttgtagctcggtaagagaattgaaattgcatgtagctcggtaacatcagcaaagaggaggaaaaaaaatatatattttaaaaaatccgcctcctacaaaagttgggcatgaaaaaaagaccagtacatcgatttgggctaccggtacataagtataaggttcattttatacaatgggcttgggacagcctttgaatccaagtgtggaaaagaacccaacaactcgatgggcctcattcttcttgtttgccttttatgctccttaggatctatagaggtttataaagtataaaccctgaaaaccaagtgggataacaagcagagcattttttttaacgtggaacgttagagcaaagcacattatttttgtagcgataaaagatcagtctgaaataagaatgatcttctaaaattattttgtacaagtaattgtagccactaggtgacaatcaacaacctcacataatgtaggatatgcctattaatctattttgacctaatgtgttgcatactaaactttagcaccgagtgatgatagacagttcatgaattaaagaaaaacttacaaaaattcgttattttccatctgtttatcgattaacttaattctgcataacaaaacattttaatccaggtaaaaacatagtaacgacgatatcctaaatgttatgatcttcttagatgcgttgtgttggaagtctcctattagtgtggtgtccttagtggtggtccccaccggatccgttcgatggtttaggcggtagcaagatttgagtaaatgactaatttacaactcagttactctctgatattatcttttgttgtggttttcgtcaacaaggaggttaacgaaattcaatcggtaaatgaacgactgttgttttcggattttctgttttctagtttgagaaagataaggactacatatacaaacgcagatgaagtagtttgcttgttttcaattaaggcatgattttgtagttcgtagttatttgacctataatttctaataatttgttgtagctttttaaaattaaaaccggaatgaatttcattataaacaatcgacttcacagcctgaaaatttggtgcacatgtgctaaaaagaaacaggggttaaaattaaagtgtcatccactaaccctgctttcagtttagataaggaagatgaacgagccatgcactgactgactaacatatgtagatcttttatctatttttaggtttcatggcattgacttgtcttgttagtgtactgcgttgacttctgccgtggcacagagatatttttctatagttgggagttgactttggtgtgtgaggacataaggctggaattatccattgcatggggcaggtgccatgggccatgcattgatgctgcttatgcagctttgcatcttcaacaaactttctttgacagcgtttcagcagaaatgtctgtgtgctatgcgcaatctgttggaaaccactgaatcaaaaacttatggcaaatgctttcagtgctttatgctctcctgtttcatattataagtcgtttgacttttttcttaatcaaacttttttaagtttgatcaactttatagaaaaatatattaacatttttaatatgaaacaaacatattatcaatatatattcaatattaaatttaatgaaactaatttaatgttatatatgttgctatttttttctataaacttagtcaaacttgaaaaaagttaaatgatttataatataaaatgaaaggagtagtttatatattgattaacggaagagggtttttatattgaaaagataacatgaagtaatatactcgctctagtcaaatggagtatactaacttggttctcccaacatcaagtaaatttgattggaggaattgatgacctttttaatattgatttgtgatacttttggtatcttgcgctagtttatattagaggtatcacaaatttataggggagaaatatctttgtcctacgaaatacgatcaagagaaaattgagagttactccctccagttctataataattgacgttttggacaaggttggagtcaaacttttataaatttgaccattaataactttaaaaatatttagtttaaagaaactagaacaacatatatagatttgtctttcaaagcactataataaaagtaaacatgcatttatttattatttatttattgtatatattataatagaaaaataaggtcaaagatatattttgtagttcgtgtcattgtccaaaacatcaattaaaatgaaaccggagagagtagctccgtttggaacaatgtcttaagacattttgttaggagaaaaaacaattttgatctgcttagatattttgaggcaagtttgacttattttcttccatagtcacgaatacacaatttattggtacctgaattcacctattatcaataatcatacttctggtcaaactttgcataaagtgtgataagcattaacacatataattgatggatacagtcatctcctttggagggaaaatgcctttttccttttcttttctggaaaaaaagtgtgagactcatgaggccatacagtgaccccacaaagcagcttagccacccaataagctaactataactattcagctaatttaattattcagctacctatatatttgcatgtacatgatcagttttgctttagggagtgacttgtcctaatctatgccgcttgttcttgctgtttttctgtgtgtgcttagctgctttgctttggctacccaagcaatggtggccactgctttttgcaacaactctttttcatcaggtcagaatttgctcacctaaaatttttatttagagtcagctcatcagagtatttggaatcttttcgaattaaaaaggcatcattatatatatgatgtttatattttagtagcatttatctgataactgtaaaaaaaaaagggtctcacgagatactcgaagttattgacatattgttgggcaggaaattccagaggtttcaggccggccgtaccttcaatatttgtttggatttaagatgaaattaagaaatgattttatccgaaataaaaaaaaagaatttgagaaatgaaatgggaattgaaagcaacaccgtcttgagttcatcctgcttgctgttatcaaccacctgaaactctgaattgaacaaaaaaaaaagggcagatgacagcaaagaacaaatgaccatgcgtgcatcagaatttcgtttgcctttgcctatcttatcattttaaccctgagtactatcagggttcaatatttttaaaatttcaggtctatcggttagcactggtaggatgtgcctcctaccaaaaactttaaacaaaaataatgtttagattcccaaacatcaattttttttttcaaaataccacttcttttcttttcagtttcttcttcaccctaaaatcacttcgcgttttgtaattggtttgtttggcacagctacagctccagccaaatagttttagctccatctgaaatgggagcgaagctgagtggagtgctctcacaaaattaactagagaggtggaactgggtttagacagcggcacagctttactccagactcaactcctaatctaaatttaggagttggagctctaccaaacatacacgtaatcctaaaatgttattactttgtgccaaggtttaatctaccgccgaaaacaattgttttcacgatattcttttacctatcgacgtggctcgaaatcaattttcgggagtgatttcgaatggtttttgacaaactaaaatttaaaaatagtaattttgatcgcaatttggtcaaaacttatcaaaatgctgttgaaatttgtcgaaaacagtgataccaccatggtgaatcggaaatgtaaatcccttgctcgtacaaaccaaaacaggcttccttatgccacaacagttgtttttacaagaaaaccaaaaggaaagcaaaagaaaaaaaaacatgggaaaagcaaaactaaaaaaaaaagtaaaaagaagaagaagaagaagtgacaaataacacgacaccgccgccgccatggacgacgacgacgatttattgacgaggcctctcctagtcgcgccgccgcgaagcagaggaggagtcctcggcgacggcggcgagcatctggaggttgagcttgacgacggtgtcggtgaacatcctggtgtcctccgccgtgttcccgtcggggacgtcgacgacgtaggactcgacgacgacgcagtacggcggggcggggccggggccggcggcgggcggctggaactcggtgacggaggtgacggagcggtagttgcggaggcggtgctggccgccgacgacgcggaagctgatgatgtggcggtcgtcgtcgagcatctcgaggcgctcggtgctggtggaagccgggaggccggacacgacggtgacctcgcggacgctgccgacgctggcgccgtcgccggcggcgagggcgcaggtgcggacgaagtgcttgtaccgctgcgggttgccgaagctgcgcacgatgggccacaccgcgcgcaccggcgccgccacgcgctgcgtcaccagcgatgtgcacgttgccgccgccgtggtggcggtggtggtggagggcgggaacgtgtggtgcgccatcaccgccggctccagcgccgccctctcctcctccgtcaggccctcccggagcgccctctccacgtgcgcctccattgatttctgatcgacctctctctctttagtttctctagcgcgtgcgtgcgtgcgatgttgggggtgagctaagctagctatgcctatatagggagggaggtgatgtgtggggcgcggtttactaggaagccgacaagcagcaacttttcactccctccgtccagtaacacgttttaactttgatcaaagttaaattattttaagtttggctaagtttataaactaatatagtaatatttataatactaaattagtttcaaatcaataattgaatatattttcataataactttgtcttgggttgaaaattttactacttttttttacaaaattgatcaaacttaaaccagtttgactttggtcaatatcaaaacgtcttataaggttaaatttagcacggtgtatgaaactaatttttaaacttataattatatactataaggtttatagcatcaaaattataatatatgaaaataaattcaaataccaattcgatgatattatttttagcaaataaattcaaattatattatactaattgttcgtcaaatgtttaatagttgaatattaaaatacgtgcgtgttttatagtatgggatggagggaataactttgattgttttttataagggcaaattatgctaagtacaaatacacgcaacaatttataaattatttgctctactgcaactcatcagtagtttgcaaaaatcaaaccacaattgaatggtctgacatggtgcattggcgctaaaatggatgcaatgttcacttccactctagcacagttttatcatggtttttcatttttctttttccagataatcccatatgtgtggttatattcggcgtcgaggtttctgctgtgcttattccattccacttccctctgtttgagacgaaagaaacaagaggtcggcgagaggcaacttgctgctgaaatcatcgccattgtcgggacgtaaatttcatatataggtaacatatatataaatatttctgaaaaaaaatgcatccgaaataggatttataaactattgagatcacaccattagaaccaaattgcatttcaaaagaaaatttggaacaccctaatgcagtaaatgcaacatcattttctcatagaaataccctattgcaatttgaactgcaagtttctcgatcaatctctcactagaaatctccatgcaccaatctattcaattgtactatcatgaatcgatcgtgtaaattagagcctacacgcctagaggtctcaaacatgttttggcatctgattgatcagcaagattgccacaggacagctacacagcaatacgccagggcccgatctaacagcacgaggtcacaaattagtttgactccacttattgattgctggactgttttggccttggtttatacttaagcaagttgtatggaatgtgcaatttacaagtttgttgcacctatttaaggatcctttaggacgcataaatttgtccgattgattcctataaattacttcagcttttgtaatttttttttaaaaaaaacttctctatttcaaaggagactttggggaacatatcagatgaatactaaggtcctgtttagttcccacgcaaaaattttcacccagtcacatcgaatgtttgtacacatgcatggatattaaatatagattaaaaaactaattacacagattgcgtgtaaatcgcgagccgaatcttttaagcctaattgtgccatgatttgataatgtggtgctacagtaaacatttgctaatgatggattaattaagcttaataaatttgtctcgcggtttacaggcggaatctataatttgttttattattagactatgtttaatactttaaatgtttgtccgtatatccgatgtgacacgccaagtatccatgtactccctccgttccagaatatagcaacctagaaccggataggacgtatcctagtacttagaatatagcaacct

SEQ ID NO: 16529 - DNA, 25551 bp, Oryza sativa
  unsure (1)..(25551): unsure at all n locations
ctaggatcccccccattcggttttaggttgctatattctgggatggagggagtaagaaataaaagtgtgtcagttaatgggtggggtcatcagcatggaaacaagggatccccatatctcagctcgttgacaaactcttctttcttctctctttggatgttgtttgtgtcccccatttgggtccagagcatgcttgatgagtttcctttggagaactctaatgctttgtgtatacggttagtttttcttctgtatgttgagttgcatgaagtaaccactttacctgatagttcaaggtgagagaagtgctgctggtcattctttatgttgtagcgagcttaagcgctgacgaagaatgattgcaatttcaacacttttccctgatcacatgaaaattcacacaaagcttcaaaagcagaatgccaaaaagatttttacaaatgcaagtttatgtggacacacatgctgagccgttggatgctttgttaagatctgtgctttactgaaaagaggaataatacaatattatgccttgttaaattttgcgttgtacgcacaaatctcaaaacaacgatgacgatagaaggtgcaggttgtactttcagtcgcatttgtaactagacttttttttagcaagtcaaattggttttgtttatggatggctaacattatgtatccagttacctttatattcttctagttcaaggataagtgccggggatgcccttttataaaaagaagaacaaatactttctccatctcaaggatttttggagttttacattggtacttaaaaaagtaagtgaaacaatgttgtgacttagtttagatgagaaagtaggtgggaaaattaaaagattttattgatttatgataaattttatgtcaaaatattttatgataaattttgaatgcatgaagttgctatattgtacaggttctgacatggtttatcattaaatatacattttaagtataacttacatttttcataaatttgcacaaaagttttagtaagttaaatggtcaaccgtatgtcaaaatagttactgctacagaaacattttttttcatacggccagaatgcgtgcctgtgagcaagtgtctgcacaaattgggactcttccaatcgaacagcgcaaccacatacaaagacgtaattttacacgtaggcacattatgtacgtcgcccatcggaaaaaaatcggcaaaaaaaattcccaaaaaaaccaataatacataaacccaggctcccatttctagaaaaaaaaaaaaaggcattgccaccaccattcctgaagccgttgcctctccaaaagccattgtcatcggggccgcatggatcttccattccagaggacgccactgccggatccaactgttgcgaggctgccggcgctcgatcaggccgtcgctctggccggcgaaatgcccctgggtatgtcgttgctgaggccgccgccgtcgtcatagtcgccctagccgccactgtcattgtggtcgtcctagctgcagtcatggtaaccaccattcgtctctcctttgtcagcagtgccggatttgcccatccagctgctcccgtcatggcgccggcattgttggctgctctcgacgtaataccgcatcacaggcccagctcacttcccgtcaaccccgccagctgtttctgtcgtgggtcatcgaggaatggagggaaaagaggacataggagagggacatgcgcctgcatcggtggcagctagttgggccctcctctcagctcattactggtccaaccagcccgatttaatctccggtttataaaaaaccgcccaggttaactagtttcatccggtccgactgcacgcccgatctgttaaggggaccggactggcgggggccctggttccggttttttttggtcgaaccgtctgaccggtccgatcttaataactctgcttctttcagctcgtctaaaaaagaaaagaggctgtccgagaaaattatattttaagtgtcattagaagggggaagtagatagggggctgtttgaatgctataataagttactaacattataatcatttgttacacttgtttaccatatttaactaagttgtgaccaacaaaaagtaaaccacactttaggtagcaaaagaagagtgtgccacatgtttttgagttgatgacatgtgagactatagtaaataagagggcttttttttttagaaacacatgctcacgcattctcatctctatgaacgcacacacgtataacctacacctatgagttatatcttaagattgacgaagtcatcatggatacctcggtatcgatgggtacgtcgcctaccattgaaataataattagccgtaaatacgagtacatgttcaagtctagcggatggactggtttctccacaagaaacgtaaccagttgactaagctcgcttcacgaataaaaggaaatattgtaacaaatatgaccatgaacaaatcagtgagtaatatgagatatattaggcaatgtttggcaatgaaccaaacagccccatcctactggttcagctcatcagctggcacatgcgagaggaaccaaaatctagaaagctcgcgcggatccatggttggcgtggtcggatcggatcgatgatcatatatcgacgcacgcgagcgcggcatggacgtatacacacatgctcgtcgtcgcgcgccggccgggcagcgcccgagacttccgaagaattgcgatggatcatgcacgcaacggacgggttcttaaatttgtttttccttttgtctcgcccgcccgagctgcgcactactacaagaactattttttcgtgcggttaaattgatttttccgtgcgaagattttcccgtcggagcaaagtgtctgtaaaagtaaatattttcacgtgcggacggtctaaccgcacgggataatcatttttccgtgcggtcaggttaagtggaccgcataggataatcgattattccgtgcatactgcggttaaataatatcacctgcacggaaacaaaaaaaccaaaaaaatcgaaaaaataaagaaaccctagccctaaccctagaaacgcccgcctccggacttggccaccgccgccgcgagcaacatgccgccgccacccgagcttgccactcccagattcacacatcgtcgttgtcccgcctgctgtgcatgcacgcggagccacctcgtcatcgtcgtcgctcccgccgccgcgagcaacacgccgccgccgcccgagcttgccgttcccggatccgcggctgcgccgcctcgtcgtcatcgttgtcgcgcccgccgccgcgagcaacacgccgccgccgccagagctcgccgcttccggatctccgtcggtgccgcctcgtcgtcgcgcccgccgccgctgcccaagctcgccgctcccggattcgcgtcggtgccgcctcgtcgtcgtcacgcccatcgccgctcgttcgctcacggagccgcaccgcagcgcctccgccagcagccgcctcccgcgccgtcggcggcagcggcgctcgatcggtggggagggaaggagaggaaagaggcagagagagagagaggagagagaggggtgggaggagagaaaagaggcagatagatgggagggaggagatcgaggggacgaggagagtaaaggggagagacggcccgtttggttggggggagtttttaagaagggattgggagtttagagggatgatgctattaaatgttttgtttggttggaagacatggaaattttggtgggatggggatgtggaattgaggaaggaactccctccttttcaccgcttgtttggtaactcgagggaaggagattgggagtttacacgagggaattgatgatgagattaagatgggaatttgatttttaatcttaatatcttgttttgtagaggtgatggaatttgataaggagtttagttgaagatttggtcattaataaaaatggatggctgagatttgcttagacaaattaaaggaggaattctctcccaattacctgcccctacccagatattgaaaaggatggagttccttcctcaattccccatccccatcccaccaaaattcccatgtctcccaaccaaacaaaacacttaatagcctcatccctctaaactcccaatccctcctaaaaactccctccaaccaaacggaccgtcattacctgggtaggaggtggtaattgggaggaaattcctcctttacttttcctaaacaaataactgccatctgttttcattaatgacttaatctccaactaaactcgctatcaattcccaccacctctaccaaacaagatattggaattaaaaataaaattttcatcttaatctcaccattaatttcctcatgtaaactctcagtccctttcctttgagttaccaaataagccgagaaaataaaaagggaaaagaaagagagagagtgtgtgtgtgtgtaaaatttgaaatgagtaagagggaaaagaggaagagtatttttctgtgcggtccacttaaaaaggcggcacgcgaaaatcgattttttcgtgcggtcctcttaagtcgaccgcacgggataatgaggaatatcatgtgcggcgacagcccggcgctggtcccttattttcccgtgcgatttcagttactgtccaccagaaaacaaaagggcccgtcaccccggaaaatcttttactgcgtgcgtgcgggcatcaggtcattggatcttagcgtagctagctatcatcatcatatcaactatgctcatctgtcgcccacagctctatctggatgcctccatgcatacatgtgtgtgaccgagcagcggaagaggggaggtccaatgggggagggacaaggggtgcggcgctgatctggttgccgctgggaacagatagatatcgatcatcgcccgccgccgccgccgccgccgccgccgtcttccaggcgatcggtcgatctaggtgtgcgtgccgcatgcgcacgcgccgtccctttgtcgaccggtagatcggcggtggtccgtcttgatcaatttcttcttctcctttcccggcgcgccgtgttgcatgctgcaggggttttggctctattcgactcctcgtcgtcgtcactttgtcacaacccttgcaacttgcattgtcacattgtctcgtctctcatgtcatcgtatacaaacagcggcatgcagcgccagccatgggtgcctagctagatagcacggctagctggcatgcatcaagatcattcctcccaactaaactgacgaaacgggagaccaacttgtcatcgacttacaaaattgtcctctaaccacgaaaccggatacaacgctcatcccctaacttataaaaccagttcaaactaggcctctcagcggttttaaccccggttttatccaacgtggtggctgaaccagcatgggacccacgtggaccccacatcggcaggccagcctctcccttcctctcctttcctcctctctctctctcactcttttctctagactaggcaggccggccagcggtggggaggaggtcgccggggcgaggaggtccgacggccggccgacgatgcggcggcggagacacaggagaaggggagggcgacagcagggtgaggtggcgttggcgggcgagcgcgatggcggagaggcggcggctgcaacacgggaggggaggccgacgccgacccaaaagtggaagccgaaggcgacggcatgggtgagcatggaggcagaggggctcttcgccgttgggggcgtaaaggcgtggaggggcggggcggctgccggcgggagaagagaggcgcgcgggtggcggaggagcagctgggtgcgagtgggaggggggagctgcttgcggcggtagccggcgggggagcagctggccaccccacctccatctccggcacgagccgcttgaagtccacctccgcgcggtgctcgtcgttgtcatcagcgaagcgacgcatgttgacggcgtcgactaagccgtcgtcgtacttggccgcgacggagcagtcgatgtcgacgttgtcgtgggaggggtgtgtgagcttctcccccaacccccaccgttagccgaaggagagcatggcggaggcggtgaagaagagcacgaccggtcgccgctagccgccactcgcacccagctccttccctgccgttgttgcccagttctccccattcggccaccgcccgtgcgcagctccttccgtgccgtcgctccagctcttccccctttggccactgcccgcgcccagctcctcacctgctgtcgccgccgctcatctctttcccccaccggcagccgcccgcgcctagctcctcccgccatcggcccagctcttcccccttcggccaccgcctgtgcctagctcctcacctgctgtcgtcgccgcccatctcttccccgccagtagccgcccgcgcctagctccttggtcgttgtcgccgcctagctcctcccccgtcgcccgcacctgctgaaccagcccacgcctagctcctctccaacgctactgcccgtggagaggagagagaagaagagaagtggagagaggagtagtggccgatgcaagaaagacctcgcacaggctcgccgcatccatgtgcagggcggggagagaagcagaggtggagatggacgtggcggcggtgctcaatcgaccaagcctttctctcccatcggccgccggcgtgcccgccacgtcggccctcctcccttgccggccttgatccttgagaggagaaagtgagaggagagagagagagaggaggatgaagggggaggaggggaaagagagagagggggtgctgacgtggcatcctaacatgtggggcccacgtgggtcccacgctgacttagccgccacttcggacaaaactggggtcaaaaccaccgaaggacgtaaagtgaaaggttttgtaagatgagggatatcatatatcgggttttgcggttggatgacgattttgtaattcgatgacaaattgagggaccttggtgtactttttccgtgtgtaaatgggctgagatttaaggcccatatatgggccggatcgtggcttccacgaagcccatacttgtaaatgggctgacatttaaggcccattataacaaggcctttgggtcaagttcggcccagatcagtgcacaagccgtcgacttccgccgccggcggcttcgtcgacggcggcgacatcgatcgccgtcgccggcggacagatgatcccccctcacgacaccggtacgtcaccctgctacaccatctcaaatctttctcctgctttgattcatctcatccgtgtgggtttttctagtagatctcgaatgacggcattccccgttagtttttttttttttttttactttgctcggatgaaatttgctcgttttgtttcctgttcttgcgattgcaagtcattagttgatgggatagtgaaatccctgacgcgcattggtcgtgtagggagctggatctgttccatgcgttgctgattggatagaggggattagagtttacgatttagggctttcctctgcaaaaactccttgccgcagcacaggaagcaggtctcctccaaccgctccacaggcggactgctcgtttcaatatggccttatatgcagatgacgctgtagtgttccttagaccagataaacaggaactccaaaaggtccaaatgataattcaaaatttcggcctcgcgataggcatggtgaccaatttatcgaaaagcgaagtctatgccattagatgtgacaccctcgacttacaggatattctctaccccttcccggcacagatgaaacacttcccttgtacctatctaggacttccactccacatcaggaaactcagaaaatcagatgttcaacctctcatcgataggttctcagctaggctcccaacatggaaaggaaagttactaaacaagactggccggacggttctgataaagtctaccctctccgccctcccgacctatcacctcactgttttcccccttagaaaatgggctgaaaaaaagatcgacaaaatttgtaggggcttcctctggacagggtcagaacagacacaggggggacactgcctagttaactggaagagagtctgtagaccataaaaacatgagaggccttggtataacaaacctcgaactttttggtcgctctttaagactccgctggctttggcaggaatggaccgccgtcaacaagccttggcagggatcgagtcttccttgtgatgaaacagacaagcagctgttcagagcttcgaccacgataacccttggaaatggcaacaaatcaaaattctggcatgacagatggttgaacggatcacccctgaaagaactttacccttccctctatcagttggccacgagaaagaacagatcagtggcataggagatacaagggaaccactggttgaaacagatgagacgaatgaataccacaacacaggttagggaattcatccttctatgacaccaaatccaacaggtggagttccaggaaggcatagacgatgcgatagcttggagatggactccaaatggatcatattcagcaaactccgcctacaggatccagttcgttggaggcatacaagacaataggtctgatttcttctggaaggcgaagatagaaaacaaatgcaaattctttggttggctcatgatccacagaaagatcctcacagccgacaaactccagcttcgtggatgggacaacagccacatttgtcctttgtgtggagtagaaccggaaacagcaatgcacctcctcatggaatgcgcctttgctaaacaggtatggagacacatctggcaaaaggcagggctccacatgcatgtggcttccaccttcgttggagatatgctacgatggtggtcaacctgcagaagagagatggccaaagaacaaagaagaaattttgatggcctcttcatctacacagcttggggcatttggctacagcgcaacgcaagaatcttcaatggtacttatagtacagtgatgcaagtggttgattcaattatcgctatgtgcaaagcctacgttggagcgcatgttctagatgagtagtgcccatactccctttctagttgcttctcattttcttaaaattttagccccttatctccccgggttgccttgatagaagaatgcttgggatcctttgtaatctgggtttgtaaaaaacctttgttgctttttctctactccttaatgaaattggcagagctcctgccgtttactcctcaaaaaaaaaataatctacattgaattgaggagcttgtccgatcattttaccagtgtccctaaactttattttagcctagcatttccctgcaagtctgttattgtggttcctaattaaacttttttagctgttctactttagcctgcaaactagcctaattatttgatagtcttacctaagtgatacagagtttagggacctctcaagctataactaagtaaaacagcagaatatgtgctttaacgacatctaagttaagattacatcaaacacaacatgattattttgcacaatgtaattaccatgagcaattttatggttnttgagaangtnttatanngtannantttttttattgtaaatttggtactttttngtanttaantattataangtnnnnnnttnnnnnnnananntntnanncntnanngnncctcctcaaggaccgtagaattgcttaattaccatagtaccatatttggtcctaattgaattctccgtctcccccgcatctgctgaaataactaacgtgcaaagaatttgcatattgttgtactgtgcaaggcatcaagcaccgatcttgggatcaaaattctgtctcactgacaagaaaatgtttttgttgatgtctttctaattccacaaaccactaaaggagtgtgataaggcccttctaccagtcttctacttcctctgtttcacaatgtaaggctttctagcattgcccatattcatatagatgttaatgaatctgaatataggcaatgctagaaggtcttatattgtgaaacggagggagtatttcatgattgaattactcatcttctttatcgtgctctgacaatgaacggtagaatcatgttgcattccgcttggaattagcccaatattcagccacaagtttagcaaaggctgtttgtttatcttccaacaacttggcgggcgtgtcatattctataagcttccctgcacaaacagaagggccatcagcttgaatcatccaaatatgtgcagtttatatatgtgcagtttggatgacagggccatcagaggaaggttcggatgagcgatgactggaccagaaccttcctcagatattcagattgatatgcgtgtgtgtagtaacttaccatatgaaagtaccatgaccttgtcactgtctgttacagttggaaccctgtgagcgatagttaccacagtgcaacttgagaattgctgcctgatgaccctctgaatgattgcatcagttgcggagtcgatggatgccgttgcttcatctaacacaagaatcttgttcctacggaggagaactctgccaagacagaagagctgccgctgcccaacactccagttactgccatcatcactcactacaattggccaaatgaacaaattgtttgagatttctaaaaatattttgcatggtaacttttttcctctgaaattgatgtcacttacctactgtatcaagaagagcaggtgtgctgcgaatggctgtctgtagttgacacttctccaaggcctgaaacgttcagtgttagtttaatcaattcatgaaaccattttggtctaaacaaaggtaccagtctggttaagttcaggatcatgattgagctcaagttcttctattgcttatgttttgagaagatttttgtaaagtgattctattagaaaccgcactattgtgtaagatttttatcacgtcttatatctgagttttgcacaaatgtaatttttcttacctcccatatctcttcatcggaatgcagaccaagaggatccaagttgttgcgcacagttcctctgaaaagtgtaggttcttgggggataatgctcagttttgttcttagatccttgagaccaatagagctgatatccaagttgtcaatgagtatcctcccacccgcaggatcaacgaggcggaacaatgagctgatgagtgtcgatttcccacttcccgttctccctacaaccccaattttgtttccagcaggaaatgtgcaagtgattcctttgaggacaagaggcatgtttgggcggtatctgacctgctcataagtataagtgtgtaagttactgcaaacattttttaaaaatgttctgtggccttctctattgaaagcaacttactgtagttttaccttgagatcttgcaggtcaatttgtccctcctgtggccatgaacttggagccctattctctggtataatggctggaggctctggtggaaggtgcatatactgctttattctctcaactgaaataatatagttttccatgtaggagtagaactttgtcaggaaaacctgaactgctgtcagcgacaaagcaaaggagaggctgagacccgcaaagcctggaaaagttaacattggaagtgttatacatccttgttggatgtagaggccgggttttaattaatccattatctaaaaaaaaaaactggaagcgttcattgttcagcatactgaaaataccattgtaagatgaacatgttaaggtgtaatggcttatgtacatacatacctggtgagactgctcctggaggagccaaaacaaggagcagtgctgctgttagtagtgtcaggctctgcagtgcttctactcttatgagaacccactcttgcgccgcaactgtgtggaagaacaatgtcgcgtcggtatcgataagaagtaggttattgcggatgaacctgtctgtttccccaaaagacctgatggtcaccacagcaagaattgattccgccgcatagttcatgactggtgcctttgttgttccattgattcttgctagatctcttgctgaggccacgtagtgcctcgtcaaaggttttaaaacaaacgtgagatcttgagttcagaaggtaacatttgatctatttattcatctactggtttaattaacgatggtagttgtttgcagcaattaggggactgacctgaacatatgccacagtaattgtaactgggattgctacaattagaacttgccaagttacagcccctgtaaccagtattgttgtgatgagctcactagcgccaacgacgacataagccacggagtaaggtatgtcaaagtccaggatgcttaaatctgaagatgcctgcagagaataaaagggctacagtcaggtactagcaaccacttgacctataataattgttcatggagaatctaaaggttagctcttatgatcttattttgaagtccatacccttgtcaagattcttccaaccggtgttgaatcaaagaaagacatgggggccttgaacacagaatccattaggccggtaaagaatgctttggaggccttgagccccaacttagctgcataaagggttctgatataggcaaagcagcagctcaagatggacagccctgaatatgcccctaccaggagagcactactgacgttcatctggacagccactgccagccagaatgtggccatcatctggaaggatgtgaagagcacctgagtaacacccatcacacagagatgtgtgattcccttggacacattgatgtagtccttatatggcttccatccaaggtctccaatctccttttcttcctcttctgtgagctgggttgcagaaggttggccttttgcagagattgaatcaatatcactgatgtattttgcagaaggttgtcctgatgtattttcatcagtcacattttgctcctggacttggctttgctggctggaatcatccaatgctgtgattgaggacttgtgagctgagacaagcttctcaaatgctgtcccggattccattagctctgcgtaaacaccttgttgtttgacataaccatcttccattacctgttgaaacaatggcagatcattcatctgaaggatctttgataccctttgatatggctaaatgatagtctgaagatcaacttaccagaatccgatcagtctcggtgagaaattcaacctggtgagtcacaagaactacagtcttctctgaaagtgctgtcattacacaatccagcaagaacattgccactgattagaacttttttttcatcagggagtgcatccatggatgcaggtcaaggagcacctcttacatagaacagaaccgcagcggtgtgcgcatcgaccgcgctgaaaggatcatctaggaggtacacatctgcatcactgtacacggctctggccagctgaatcctctgcttctgaccaccgctcatgttgattcctctctggccgatctctgtcaggtctccatggtcgaagttctcgaagggcttcccgaagaggatgttgtcgcgaacagtgccactctatccatgagttctgggaaacatacgccactgtgccatacaactccacctgaaaattgattgtagttttgtcatgttcatattttagaaaacatagatttgtcattgtcatttttttttttgtatatgaacatgacaagacaatcttgtgttttctcctttcatggtaaaatgaaaagaaaggagataaatatagagtcgaagattatcttgagtcttttttcaggggaaagtagaaagtttttagtgataatgccctattgtttttgcatgaaatctaaataattatgagaaattatgaacagattttaaatactagattataatgtcatcagtcaaactaaattcaaacttggattacaaaaggaaaatattttctttttgaagtcaaaattggatgtaaagttttacttaattttgaagaaaaaaaaatctatatatgaagatgggatttgattttgtatgtttgtgaaaggaaagaggacacatcattttttttttctgaatttgctatgaactacttggattacaaaactaaagaacatgatgattcaatctgtatgcgaaaagctgttcttttttcttcaaaattcatctcattttttctatcacttaccattcctgatgttctaggtatctccccaagcaatgcacagaggagtgaagatttccctgagccaaccgggccacaaactgccaccttctcccctctgcgaatgctgaggtgagcattcttcagtgtcagctcagcttcactcccactccagctgaagcttccatcctggacatggatgattcccgcatccgaattcttcgtcgtcgtcgtcgtcgtcgccgctctcgtcacgtcgtcctgtttgatctcctcctcggcgaggaacctcccgatgcgttccagcgacaccttgtactggatcatcatcgtcatggcctccggcagcatcctcaccggctccgacatggccctgagcgcggcgagcgcggtgaacaccgtgccggcgtcgagcggcgcgctgccggcggcggccgtggcggcgaacatgacggcggacaccacggtgggcgccgcccagtagagcacggcgccgtaggccttcttcagctgcgcctccctcagccacgcgaactcgccgccgaggcgcgactcgacggctcgccggaacgcgccctcccatgactggagcttgatggccctcatgccggcgagggcctccgacgtcgaccggagccggccgtcctgcgccgccatgaacctggactggtagccctggagggccctggcgaacggcacgttgaggaagccgaaggcgacgaggggcacgaggcccgggagcgcgccgaggcggagcgcccagaggagggtggcgacggcgagggcgagctgcagcggcgagctccacgacgtgtggagccagctgacggcgtcgccgaggcggtacgcgtcgacggcgacgtagccgacgacctcgccggcggagtggcgccgccgcgcgcgcgccgacagccggagctgcttccggaacacggccgccatcagcgccgaccggacgcgcatccccgtccgccgcgagctgaagaaccagtgccgtgcggccagcgattgggcgagcttgatcgccagcagcgagccgaccagcgccaccgccgccgatgcgccggcggcggcgaggtcccggcgctcctcctcctctgccttgtggctgctgtaccggacgacacggcgatggccagcgtcttgacgagcgcgtagaagccggtgagcatgatctccccgaggaagcacctgagcagcacgccgacgaggcggccgccaccgccgccgtccttgccatggccgtggaggctccatgcctcggcgaacctctccgacgcgcgcgccgcgccgtcctcggaggcgatgagcgggacgtcggcgaggtcgagcgccttggagcggccgaggcggagcagcgggttcagccacgagaaggacagccggctgagcacgccggcgccgtacagctccgagtaccggcgaggcgcctccttgccgagcagaggctccgacaggtcgccgccgccggcgccgccgttctcgccgctccggccggccattgccgagcccagttgttgccaatgacgcgcgcgacgtggcgccgcgcggttttttatggcggaatttgcttgatgaagctcagagaacgtactcctctccatcgctttcacctcagattttgggtcggatcatgcgtaaaagagataatctgtaaaatggcaaatcacatgcataatcaaagtggtaatctctataacatcaaataatcatttttttcctctaggagactgatagctggtaattagtccctccattcaaaagtattaagaatatttcatgttttgttttttccaaaatatatgtgtaaaaccaaagcgtgtttgattgttattttgtgatgaactattggtatatgagattattggttttgatatttggagattattaccgaagtgattttggatataattagaatttttaggtgatgaatagggattactgctgacacagtgtattcggtcagaccgggttgtggtagttggtcaaaccggcggtatatgtgcggtcaaaccagccagcacgtagtctgactggctgatgttgtgtcggttttggtttatggtcaattgtttggatatacgtggataattcatgtttatgacttctagatggatactatgtgtatgtaatactattgcttcttaacaatgagtcaagttggtgagaacttgtgctcggatatggtttcttggttgatgcatgtgtaggtgattcttaatgcttcggaagagtgttgtcggtgatggatcgggagtcgacttgggagaagatgacgtccagatgatcaagatatcatgcgggatgcttaggctaaagatcaatgcacgtggttggtgaaaattctatatggcatacaagggagatattgtgtgcgtatggaatgcggagtcgaatttggagggagtccaaatttagtacaattggagtttgtaaagttttctaagggattaggacttcttgtactaggttggctcgtggctttagactgtttacctcagataaatagagagggagggtatagcctcttggtgttgatttttgagagagttgagtttagagaaaagttagggtttcgagtttagttgagattttcatgagtgatgttgttgcattttgtaaatacaaagagaagtaataaagtttcaatttacttcgagagatgttcgatttgtgtttgttcgggttcaatggtctaatcggtggttagaccaatagatacccggcggtcaaaccggtggcggcaacaggagacagtggcgcattgggcggttagaccggaccaactccatcggtcagaccggaggatattgagcggttagaccggcgcatctactccggttggaccgatcaccgtcgaatttgagggtaacctttaattccgctaaaagtttcagtttttggtaccacaaccattcaatcacttctggttggtttagtttcttgctatttcgatcctacaatatgatcatatttttagtctgcatgttctaaaataattgattggaagcaagcagccgtcttaatatttatgtatgtaagtatatagttctttttttacatgggagatgagagatgagttaatttttctttagtcttgataataaaagaaactagatgatgccccgcaatttactgcgggatatatattagataatagagaaatgatgaaatgatttggattgaaatattatgaaaatgattcaagaataatgatctagcatatgtatgtttagttttagaatgaagtaaattgtagatataattaatatatggttgcatattgagctttgtgtgcttaatgggttgatgtggcatgtttgcatgtaggtttttggagtgataataaatactatgtttacatgttgagctttatgggccttttgaatcgtaggaataggaaaaaaaaggaggaatggaaaaatgcaggactaggaaaaacaaaagattctgacaagaatgcacatataaaacaaatgattgaaaaatacgagaaaaacacaggaatgaccgtttgattggatcataggaaaaaacacaggaatcggatgaaaaagatagactaaaggaatttttttcaagaggttggacctcttgctaatttttctccaaaatctctataggattactcattccatattccataggaatttaaaggatagaataggattcaattctttgtttcaaaggcttccataggattgaaatcctccaaattttccacacttttcctacaaataaaaaggcccttaggtgtttagtgggcattactttatagaaagaaagaagagataagtcttacatgtttggatggagggagtagtagtgatcgccagttcttttttagccttatgtagaattactgtggttgtttgattttatttggaggttgggtttttattttaagttttttgggtgcatggatttggtttggtgttgattttattttgtatttttccttagagcataatggaggactaacatttaatttcacgtctatgaacctatgattttgctaatagaaaatagcaacgacgctggcaagttggagagaagttggagagttgaatcgcaaaaatataaagttccaatatttagttgtgcatgtactggcaatatttaggccaacagctggccctttcatattttatactttttttaaggatacgtcggagaaatacaagataattttctatcataattattatagttattattaatccataatgttgattgtggatatatgaaaatgatatagccaagtttgtcgtcgcaaaagctttacaatataatgtttatataatttttccgagaaagactacacaacggtataccacttatctcccatgccgcggctccacgtgctggcttctcccgagcatgtcgcgtgctgctaggattatcatcacgcacgtttgttttgtgtatcagtgtatagtcttgttcctgacagatagctagtacctagcatggctaagtcctgcctttgatactagcctagctaggaaataaaaccggaggtactactagcttgctgtgcatgccaaatccctataatagctactagtagtcccgtaccctagctatgtaaggtacttattaagcctagtagcctagctatgtgtctaagattggttgcatctatttgcatgtgtcctataccatgcacggattagaccagataaataattacctatattatatatggatacaatggattctaattagatatgtcatgttaggctcttggttataccacatcttagaaactctagtatgtgatacatagatgctagattatcatatctgatatccaggtactgggtcaaatacctaggtaccaagtatgaaacctataaatacaagatctgatgccgagttatcgggtctgatacctataagtaccggatccgataactaggtatcgtgtctgatacctatgagtaccaatcggatacccgggtattgggtatctgatcttatacctatgagtatttgttccaatacctatgcgtaacgggtcggatacccaggtaccgagtatgatacttatgaataccaagtctgatacctaagtatcggggcttatacctatgagtatcagatttgatacctaggccaggtttgatacctatgagcaccgaatccggtatcgcgtatgatacctatgagtatcagattggatacccaggtatcgggtatctaatctaatacctatgagtatcagttccgatacctgtaagtactgggtccgatacccaggtaccgagtatgatacctatcaataccaagtctaatacctagatattgggtctgatacctataagtaccggattcgatacctaggttgggtttgatacctatgagtaccggatccaatacctagatactgggttgatacatcttagtagcggatctgataccaaatatagggtgtgatggcatgagacttcagatatgacaccactaattctaatatttatgggtattcaacaatcaaataaaaagatggaccatgcatagctaggccagaaagtacagcgaaacttcctcacgtgctgctgacatgctttgtttaggctcatgctactagctctagtgcttaattctaactttgctaattgaagcaggtgtcagacccatatggacctaaagaggtgtacaagtagtgatgtactagagtatttcatagctattttgtactgtaggagaaaagagacctctcgtcagtcgtcactagtcagcagtcttcatgtgaaaggataacacacgacacgcttttagagagaaaaagaatcggtgagtgattggtaagtataaattataaactataccgttaaaacggtacaccgtcccattgtttttctcaatttttccatgtaaaacaattaatagtctaggggattttcaacaaacaataattatgttgtgttgcatgactgaatagataaataatttgtggcaattatttgaaagcacaaatgaattaattaattattataaagtagaaaaaatatctaaaatattatcatgagaaattaatatacggtgtcttggtgtcatgatagtttagtggttgcagtgacctgagtagtatcttaaagttctgagttcaaatctcaatatgaacaaattttggattgggctatttgaggagtcaagttcataatgtaaaaaagctgcatatatctggttagatgtaaaggccagataaaaattacccttgtctaaaaaaataataaaaaaaaacctaaaacctatgtcgttccggagcgaacagcacacgctagaacatgcccatctcgagcagtcacatattttttgtttgttcaccagatgtgtcaatcgcgagctatcatttcctcgggagacaacaccgtttgaaccaccaagacaccatttgtttcaattatttgccttattaactttgaaaagaccaaaatggcgtcgtttgtgacatactgacatcctcgatcgactgatcaattcgatccaccattaggcactaacttagatgattttgaatctgatgttagaaatcatacacgatgcaatcattcgagcaatggtagattggtagaaattgagagaatagcactgcgttagcagttccagtcaagggcttcgttgtcttgcactcttgcaatatcagtatgtcagcattacaactgttattgtcgtgaaagcgtcatggctactgcaatctttgcttttcttctgctgtcatcatggctttttaacttaagctcagtacacagtgacaaccaaaatatcttcaaatctacttcctccatatcagaaaacattaagcattgttttctcattctgaaacggaggatatatctatattcatacctaaaagttaatatttttttctgggatagaactattnaatactctctggcttttgttctggctggcttgtgtggtctgcacacatagattgatcatatgtgatcatgtcagcgcctctatgcttgctgtttcttcttgtcacgttttctttctatccgacaagtcggctttctccttgcaggaacgccaaagaattttttgttttttgcttcagagacactatacaacatacatatgatttgatagatgctggtacgacgaagcagatcacttgccgtccatctggcatctgcccagcaagttctggccccacacaacagataagcgttaactctaatccgatcattgcaggttatattatcaaaacataattagcatatataacctcgtataggttctgcgcatcttaattaaaacttcctttatttaaaagaactatataatctcatgagagaggccaatatcttcaattaatataatcaagttaactgatccatagttcatttgaagtgctggtgtgtgtaagtgtgtttcttccatatattcggggaaaaatgtttgaagtgcatgatgttttgagatgtcaccctccactattcttaccattcaaacaaattttataggagcacttgcaattattttaggctcaatttagagagcttactgtagccacggcttattcgaaaattttagctttcaaacactggttctgagaataggtaataaaatctagaaaataaatcagaaggtggaagctggaaacaccatctttgaattctccaaacagggctacccggacctggctggagaactgcaagggacagcttttaccttgaattattggacaatttatatataacaagcatacccatcaaatcaaaacttgcagacacattgacaaggcaaatgagtcaaagttccagcacactgcatcatatttactctgttctaaaataaacaaaccaaatactcccttcgtctcaaaatataagcatttttagcaaagtgacaagtcaaacaattttaccaaacaagtggaaatgaatagtcctggatgcagaatacttcttctaattcttacacttattgtatggacaacaaataaaacccttatgtctgttagcttcggccactctcaattatatatgtttggtaccaaccgggactaaagatcgagctgacctttttttttttgcatggccctgttgctgcatatatatatgtttcaatacatatatatgcataatatatatgtatttatacatatatatgttacgcaaatgcatatatatatatatatatatatatatatatatatatatatatatatatatatatgaaagcacttaacattttatgtgcatatatatatatatgaccaaaatatatatttacattaaagaaaatgtgtacatgcatatagaaaaatagacatgtattaattacaatctattatgatgtcctagctagctacgatttcgacgtagtaatagtcgttatctcagaagctaaggacctatgaattgtattttcatcgtagtagaattcacccttgggatcaaggatttgttcgttgatgaatcccatgagttgttcttgaaccgccgcgataaattccttgtgtgtgatcaggttatccctcatgcgaataaactatatgaatgtatgaaattaattagtaattaaacaacaaatcgatacgtacgcaatgaaattttgaatttatttgtacgtacaacgagctctcttgtggtgatgatttggtctgcaaggcagtggcaatactcgcacacgtagtagctgcacaagttagttccctgcttttgctttgcgcactataaataaatgacaaacggcgagagatctaattaatatacacttgtatgtatttgaattggagattcaatataaatgtagagcatgtgtactcacaggaaaattgaacttccgcctaagtctttctctccatttgccgcggaccaaatgacggaaccgataccaagccctacatggagtttaaagctatgaatcgtagtagcaattaattataacaagattcttaattaacataggaacttatgacaatacctatctataagttcgaaaaccttgtcaaacgtagactcttttttatccattgagtcatatacgttgacgatgcaggcctccaggtcgaagagtaaaaggacctagtggaatctgcaatgtgcgtgggatgcattacatatgaaacacttagcatgttcgtacgggaatgaaatttggtataggaagacagtaaaattaaactaactctgtgttgttcggcaatagtataaacgtcttgtaatgttgcgccttcaggagatggacgagattgtcctctgtggcttgcggatactggtcgagcattgcgacgttaactttccgagggtcgatgaatccagtatcgaaaacaccccgccgtcgggccctttgaatctccattctacaacgataaaaggaagtatatattatatatagtctacttatatacaaggacctaattaattaaaggaaacgtaataagaaatctaactgaacgatgcttacaaaatccagcaactcataatagagacgtcgagggcgtccagctggtatagttcgtagatacccttgaaattnnnnnnnnnnnnnnnnnnnnnnnnnnngaagtctgtgtccctaatcctcgctccgatcatctctctaccggtggcgctcatctccatgtacagttgatggaacttgtacatttgtatgggtagggactgcagctgctcaggcttgacaagcggtttaccgagttctcatgatttcacttccccctttcaaaggtgtgcctcgtaccaattgatccgtagttagcccgatgcaataataaattcttctatccaaaatcttcaccggtcaccaacggctcgatctcctggtttggttgctctccaagctgagggactggtttggactttccagaagatgctttcttgagtgttcgctcatagtccgatagctttatggcctccttggcaggtgcagacatacccctgaagaagttcctaacacttgggtctataggaatcttcttttctggacttcgaggcttcaattgtctcctgacttctgatgccacataagcgtcaagctcctcttgcatgcaatcataccccaggtccttgttcttggcggcgtcaactttcgccttcttcgttgcccttgtgggggcaggcggtgaagcttgggggggccttgacttggaaggtgccggacgaggagcttgcggaggagtcggtgtaggagcctgaggagtctaattataaatctaataatcttatattaaaactcaaataatcttgtattagaactctaataatcttatattaaaactcaaatagtcatatatgctaagtctaactgtcgtatattagaaccctacacaatcttatatgctaagtctaattacaaatctaataatcttatattaaaactataataatcttatactaaaactcaaataatcttgtattaaaactctaattatgttgctaagtctaagtgtcgtatattaaatctaatagtcttaattgcattaaaaatctaacaatcatatatttacatcacttgcctacgcgaattccttcgagggctagcgaccactccggcttgagggacgacgacgacgtcgttttttctacaacatacaaaaagatgtattaggataaacgcaaagtaacatatattgtatttcacgttcacgttgtcgttaagttcacatttcgttcacgatcgttcacgttcgcgttgtcgttaagttcacgtttcattcacctacgttcgttcgttcacgtacgtttcgttcgttcacgttcgttcatgttctcgttcacgttcgttcgttcgttcacgttcacgttcacgttctcgttcacgttcgttcgttcacgttcgttcgttcgttcacgttctcgttcatgtttgttcgttcgttctcgttcacgatcgttcgttcgttcacgtggcggcagcggagcggcggcgcggctgcagcttggcgaggcggcggcgtggcatcggcgtggcgcgcggtggtgtggcggcccggttgtgacatgccgcggcggcgtcgtggcgtccgggcgtcgtgccgccgcggcggcgtggcgcggcccggcgtcgtggcgcggcttcgtccgcactgctggcgcgacatcgttgccggtggcggccgcatcgaggtcggggtcggcatcgtcggcgcggcggagtcgtgtttggccgcgacgacgtcagaggcggcggcaacgagacggctggcggcggtttggggagaaagagagagatcgaggtcggagagagagagagggaggcggcggcggctctcaccccagagatgcggccgcggcggaggtggcgacaacgacgcacgtgagacgacggcgagatacgacggcggcgtcggcgcggggatgccccaggcagtggcggcgaaggagaagccgagagagagatcgatcggggaaaaaacttctaagt

SEQ ID NO: 16530 - DNA, 14066 bp, Oryza sativa
atcaaccgggactaaagatattttcccgctatttccaaattctttttaaacccggttagggttaagaaccgggactactgataagcgcactgaatattaatttccattacatatgtgtttctaaaatagaaaataatgcattaaaattatttccaaattctaagtcgaaaaattaatgacaattacttcaaaaaattattattgtctgtagtaaattaagtggataaaacgtaataagcaaatatatgatttaaattaataaaaattctaataatcatatatacttagcatatgaatgatattaaattggtaagaaattgtaattaacatatgtatatacatccgacatgcatgatttaaaattaataaaaattctaataatcatatataattagcatatgaatgatattaaattaattgttaaaaactctaattaacatatgtaaatgccacatgcatgatttaaaattaataaaaattcgaataatcatatataattagcatatgaatgatattaaactaattgttaaaaactctaattaacatatgtaaatgccacatgcatgatttaaacttttaaaaattctaattatcgcatataactagcaattacatgatttaaaattgttaaaacctctaataatcgtacgtaattaacatatgccatacatcaattgatttatatggataatcaatacatctaaaatagtttacatcgtgtacacaataattacggcaatacatcggaggtgacggttgaccgcacgtactttctcctcactattgttccctccttgtgatcgctacttgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacgtgacgcttcggctcgtcaggccctctgcccttctttcctttgctagacatgtccttcacgtaaaagacttgcgttacatcattggcaaggacaaaaggttcgtccgagtatccaaccttgttaaggtcaaccgttgtcatcccactgtcatcaatcattacgcctccaccagtaaacctaacccattggcactggaacagagggaccttgagaggaccatagtcaagttcccatatgtcctcgatggtatcgtaattcgtgccagttgttccatcatgtcccatggcatcgatacgaacaacgctgttttggttcatgctcttcatgtcttgggctctcgtgtagaatgtgtacccattgatctcatatccctggaatgtcgcgatcaacccagatggtcccctcgccaggaaggccagttgttggttgatcgtctcgttacccatgagatgttgacgtagccacgcggcgaaagtatcaatgtgatgtcgtgtaatccatgcatcggacttaccgatgtttctggcgcgaactagagccaagtgctcctcgatgtaaggagctaccaatgaagattgttgcagaaccgtgaaatgggctttacggaataaattgttatctaccgtcattattgctttccttccgagagttccctttccccgtagtctcccttcatggcgtgattcaggtaccccgattgggcgaaggtcttcaataaattctacgcaaaattcgatgacctcctctgttccataccccttggcgatgcttgcctctggacgagcacagttacgaacatacttcttcagaacgcccatgtacctctcgaaaggaaacatgttgtgtaggtacacagtcctgagaatactgatctctttgacaaggtgacaaagcagatgcatcattatattgaaaaatgaaggtggaaatatcaactcaaaactgacaagacattgcactacatcattctgaagggcttctaatctatccggattgatgaccttctgcgaaattgcgttcatgaatgcatatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatctagatggtacctttatgctctccaagcattcaaacatactttccttctctgccttgctaagagtgtagctggctggactcaagtaatggcttcctttctcctttagttctgggtgaaggtcgccgcgttgttccatatgctttagatcattacgtgcttccagtgtatctttcgactttccatatacacctaggaagccaagaaggtttacgcaaaggttcttagtgaggtgcatcacatcgattgcgtggcagacgtccaagaattcccaatagggtaactccacaaatatagagttctttttccacatcaccgcgtgaccatcttcgctctctgtaggctggcttccaggcccctttccgaacactactttaaaatctttaaccatagcaaacactgttttcccactacgatatttaggcttcgtacagtggtccgccttatgttcaaagtgcttgcctttcttccgtaccgggtggtttgcagcaaggaatcgacaatgacccatgtacacaaccttcctacaatgcttaagatacgtactttctgtttcatccatacagtgagtgcaagccttataccccttgttggactgaccggaaaggttgctaagtgcaggccaatcgttgatggttacgaacagtagcgctcgtaggttaaactcctcctgtttgtcctcatcccacacggggacaccttcctttttccacaacgggccaagtgctatggccgctgctcatctctccaaaaggattcatgccatccgtacttaaaccaaaccgtatgtttcgtgcgtcctttccaaagtctttaaattttctgtcgatgtttcgccactgcgaaccatcggcgaggtgtctcagcatcccgtcctgttgacgctcttcagcgtgccatcgcatcattctagcattccccttgttcctgaacaaacgccttagccgtggtattatagggaaataccacatcaccttagcaggaattctcttctttgttagctgcccgtcaacttcttctggatcatctcgtctaatcttgtatcgtagtgctttgcaaacaaggcatgcttctaggttctcgtactcctcaccgcgatataggatacaatcattcggacatgcgtgaatcttctgaacttccagtcctagagggcagactatcttcttagcctcgtacgttgtctcaggcaatttgtttccctccggaaggatgttcttgacgagtttcaataaatcgccaaatgcgttgtcactaacaccattttttgccttccattgtaagaactccagagtggtatctaactttttgtgcccctgctcgcaacttgagtacaacgacgttctgtggtcctctaacatcttgtccaatttatgggcccccttttcactttcgcagtcctccttggcgtcctgcaacatctgaccaagatcatccgcaacgtcgttaccatcagcatccctttcctcctcgcccgtttgatttccttcaaatccagcgtactgagcaaagtccggaatattgtcgtcttccacttcatcttctttcatttcaacaccttgctctccgtgggatgtccaaaaattatagcttggcatggaccccgactcaaacaagtggaaatgaatagtcctggatgcagaatactccttctaattcttacacttattgcatggacaacaaataaaacccttatgcctgttagcttcggccactctcaaaaaataataaacgtcgtcaataaactctttggaccgccggtcagcgtacatccattgccgatccatctacatgacatgaaaaaaaatcgtacacaaataattattcttacaataatgatagtcatacaataattataaataattacaaactctttcaacagtcatacaataatgacatatcattattcatacaaaaattataaaatattacaccaaataattcttatttactatttctaaagttttaaactaatattaatgtgttgtacttattttaattttcattttagtttgttttctattatttaagattaactttcactgtattttccttctcaactattttataaaaccttctttagcaaataaactaaatttctatatattctttcttccccacacaaattttctctctcatcaacttacaactaaattttggagacataaaagtgtgcaaaacatagctccaaatgtaatatgacaaaaaaaacattggaggatgaagttgctaaccttttaagcacctccgatttgtatataatcaccaaaataaattcactagaaattttggcatgaccctcttttttgaagaaattttgaagcttgctcgggcagctggaggaggaagaagacatatatataggggtgggacttaagtcccgatgggtgtaatgacttggggtaagtatccaagggggcctaccaagcctacagatttgatttggataagcggttaaaaagggtaacggacatatttgatctttagtcgggcatatttgatctttagtcccggttggtaacaccaaccgggactaaagatcatctttagccccggtttttattgcaaccaggactattgtggatatcggccgaccgacgaaagatggtttctccaccagtggttatgagtcttctgtttggaaagaaaatataaaaaagattatacgacggttcaaaaaaaactcgttattaatacgatgctagataaaccttaggtcagtgtcacgtatacgaagagggtgaaatgcgatgagcctcatcaattttatgcctacaagaataatgcatgtgtatgtgcacacaccacacatcgctataaaataatttattattatctatgatcgattttaggaggtgaattttttctgaaagataattatagggtgttgcgatttcgtataagattatccataatactgacatacttatagtaaatatgggtttttaactgtaaatttatctaacaacataaacttacactaccacagaaacctggataggtgctggttgggaaatccggcacctatgccgagttcccaagcgatacctaggaagcggcacagatgatgaaaatcaaatgtgctagttccaaaaccttgacctttgaggcttcaggaattccaaaaaaaaggatcgagtagcttcccttcaccctgcccagaacacatcgaagaacatccaagaacacttgaacatgaacatcaagaatattcttcccagccactgggaaccatcaaagctactcatccccatcaagaacacaatcacaaaatacacatcaagaacatatagataacacaaaaggctgccgctcaacaccaactccgctgctgccgctcgacaccaccgcccctgccgctgcctcccctccgccggatctagcggagaggagaccgctgggaaaaaaattgtatggcaccccatgccacaaagcatgcgtggcacccctatcaagatcttgccacctggcgtgcacaaatcttggagcactgatctaccttcaaaaccatactagggcaaaaactaattaacaggctatcgctaatctcgcgcgcgcggaaggatggcggcggcgatgcgcgtgacggcgacgcacgggcaggaaagacgacgtgcgtgcaagaaagggcggccgctgccggcaacggcgacgcggacgcacgcagcaacacggcggaaatcgacggagctagcgctgcccagattgatcgcgcggcagaggtgcacgggttgatcgatcatgactcgaggacaaacttcgctgacgatgccatgaaagaccaagccactgcacatcatcagttcggttcagatgatgaggatcttgaagattgcatgaatgaagaaaatgattagtgtgtgagtgtggagattatgggtacgccatacccacatggcatggttatccgactagtcataggggatagcttatatctatggaatatgtaacaaatcatgacttaggtattacgtttccttttatattatggagcggcctaacgtcctgatttgataatattgtaaaatagatttaggaaaccgataccgtattggttacggtttctatcttgtaattctgccaaccatcctatataaggtgggcagtgtcacgtcctgataaattcatcccgaaattaaaaatcattcgctaaaaggaataatagaattaattaaaattcggaaagaaattggcaaacactaaaatacgtacaagaaaaattcgaatgtggcccggagaatttttgttaaattctccttggtctaaaaaggagccctcaaattttacttgaattttcagagcaccggaaatatttattaagcaacaaaaacaattatcagagtttattaaaaagaaaaacctaaaaataatctctctccccccctttgggcagagtctggcccaaagtcctccctctctcccctcggcccgcggccgaagtctccctctcctccctctccttctctccctcctcctcttgggcccctcttcccctcccagcccacttcctcctcctccctctttctcccaggccgcctccccctcctctcctcctgggccggccgcccggcccaagccgcgcccaagccaggccgagccgagccggccgtgcacacgcgcgccgcgcgtgcgctgaccgcgcgtccggccgcgtggggcccgcgcgtcaggcgggtcatcgtcctcctcccgcccggccgtcctctctccctctcccgtgaaccctagcgccattcctccctcaaatccgcgcgattcaagcatgggattcccaaattgattagggggaattaaacccctttccctcctctctctttcccccttaattcccccttgaatggcgcccccaatcgccgggaacggacgcgccaagtccggccgccttcctttgccgccggccgccattcccgtcgccgttccgccctctcccgtgctcggctcgcttccctccgctataaaatgcaaccccctcgctccgttctatcattttagccccctcccgcgatctcccgtggtccctagccctctccccgccgtcctcctctctctcccgtgccgccggccgcctccagccgcctctccctcctcgccggagcgtcgtccggtcgcgccgtcgcctcctccagcatcgcagctgcctccccttccccggcttgccctccgtttcccgcggagacccccggagctgcgttcccgccgtcgcccttccctttcctccgcgtcggccgcctccagccgcctctatctccctgcctgagcgccggtcgacgtcgccaccacctccctcggctccgcgacgccaccctcatccccggcatcacctcctcctcgcccgaatttcgccggaacaccgtcgcccgcgccggcttctccttcctcctcggcggcatctcctccggctgcccctttcgccatgcccgtgcgtcagccggcgctgccgtcccctccctcggcacggtgacgtagccctccacctcgtccacccctcggtttcgcccggaagccgccgcacatcgccgcgaacctctccatccgcctcgccggagttgttcggccgcccgtccctcctcgcccgtgcaccggtcggccacacctccaccacctccggcatcgcagcggcaaggtcgtcctcggcatcgtttcccctccatccaaacccctccgcggtccatcagcgtcgtctccgatcgttctcgtcgtcgacgtcccatcggtcgcccggctcgtcgtctcgcggcgccgcctccgtcgtcggcatcgcagcggcgtggtccgcgccatcctcgcctccgtgcagccactgccggcagccctcatcgcctcctcgccggccccggtcgtcgtcgtcgtcgtcgtcctctcgtcgttcccggtcgtcgtggcgttcgtccctccgtcaggtcgttctcgtccgtctcgtccgcgtccgtcaagtgtgccgctgcagacccgtcatcgtcttcgtcctcggctccgcgtcgtcaagcctcgtgccggccgcgtctcgccttcgtccaaggatcgccgctgaagccgtcccctcgccgttcgtctccgttgtgcccgtctgtctccgccgcgcccgttcgtcgttgtcgttcccacgcctcgtcgcgtggtggtaaggttccctctccctcgctgccccgtcctcgtcctttcggtgtcccccgtacccgttgtgcggttgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacctgttttatagttgcaaaacctaattacaataatccgcaaatctccatataacagcattaaacttcggatgatcatatcttggtcatacgagctctgaatcgacccgttcaagtctcctaatgtttgtataacctaaagaaccctgtgctttcttcttatgtattgttattgcttctttttaggcttgtagctttgcttgtgtgcttcgcgtagtcttcgtcgttccggaggttcccgaagcgtggttcgcggccgtcgccgaaggttcggaaggccgttctctctgagcaaggcaagtcacatcatcctttagcatattgaatcccagtttataaaattattttgatttaaattaatgcattatcgtttaattcccgcgttatcactgttttatctagccatgcctatttacctttgttatgaccttatcattgttgttattgttactattaccttgttcaccctagaataaacaaaaccccaactagtgggtactctattcctggttccactagtatgaatttaggtagatgcttcgctgattaataggacaacattaggtggtttttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggtttcggccgtaggtggggttgggtcggtactcttgtttatggctaggatgggttgggaactatgtcacgtcttccgtccgtataccgtggtggtatgtggcatgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacctagggtcgggttgccagttcggtctgaatcatcgtaggccttgggttaaggcaggttcgtgagggttcacgaccttgattaataatactgtgtagctctaggatcgtctttttaaaatggctttgggcaactaagtgacttttaaatgctgtttactgcaaaacttaacccttattattaaccccttgtacccccttgcattaatcatgcatctgccggtgtgacttgctgagtactgtggttgtactcattcttgctcaatctttccccccttcagtaagagaagcttgggagaagaagtcttaggtggagtcctggcttataccccagttgagcgcctgtgaagatggagccgtaggcccgcaagtccgctgctgtttatttttgtttgtcaggcctgaggtgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacaagctggtatcagagccatcttgactgtaggataagccaagtggataaaacctatggacatattttataaatgaaactatttgcgaaagttcctttttcctcctttcccctatgctatttgcaaaatgtttactctttctttcttcttcaaatttcaactagtactagatggtcaggtcagtgaagaagaagacatcgtcagttgtttgccgaagctccggaaggctgcaggatccgctagcgaagtggaggaagcagtgaagccagctgtgaagcaggagtgaagatcttggagaacccgtcgcagaacctaagccaccctatagggtagtgttgttagtcgtgtgttccttgcttgtgtgtgtagcgcgtggtttgcatcggtgggtggtgatgtaaccatgctaggttgtttgcttaatcaacctgcagaataagcaaaacaaacaacacatcaacaaaaagagttagttcctttaaggtcttgtccctagttctggtcgattctttccttgtatgcttcccctctcaacctctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaattggaacaacccagcaggggcaaccaacgttcaagtacctacagtccagcaacagtgcaagttatcagaatttctcaaaactgagcctccaacctttgccattgccgtcgatcctatggaagccagtgattggttgcgcacagtcgagaagaagctagggttgattcagtgcaccgaccaggagcgggttggcttcgcaactcatcagttggttggacaggcttcagagtggtgggatagctacgaagcatcacggccagaaggacataccatcacctggaacgagttttcatctgtattcaagagatcacatgttcccgcaggaatgatcacactaggaaaacgagagtttcgctacctgaagcaaggagatttgaccgtcacagagtacctgcacgagttctatcgtttggctcactatgcaccagaagatgtggaaacggatgaagacaaacaagagaagtttctccaggggttaaaagatgagcttgcagtgcaactactcctagaggattatgaagattttgagaaacttgtggacaaagccatgcaacttgaaaatgagcataatcggatgacgaactgcaagagaaggattgtcaacatcccagtatttctaggtggtaaccaaagacagcgcactgagccacttcagatcaccggatcttctgttgtgcatcaagagttcctgccccaagaagatggacgcaatgcagacaccaacactagcaatactaatgatgatgataccaccaacaaccatggttcttgccccattagtgaccactcgaataaagcgtgcaatgtcagtagcattcaccaagatgtcaacgatagtatcaatgttggaacccagaatgacaaccttagcaatgttgacactgagaaagactccaatggtgatagcaactatggtaccactgatgccaatgttagcaaggatttccaatcaccaattccaactccaagccaaaatgatcgtccccagatggacagctcagtaaagaagacgttgatttgttacaactgcaaagaaccaggtcatttctccagagattgtccacagccgaagcgtaacctgcgccatcactccggccattatgcaagaagaagacaagtcactcgccttgtggtcactggagcaaacgccgtacctgtgaggcctcatgttaatcctaacccatagtagaaacaatgtaccgatgttaagcatcttccctttttgtttaaggtagtgccttgtattcatgtaataagggagacatgtgtgataaaaacaagttctatgaggattattttgcaagatgctgatatgggatcatgcgtataattgtttactgtcaaaggagacctagggtctcattccagaggaactatgttctaacctcgagttaataaccaacctgttgatggaaaagaaaaccaattaaactgtgttggattaaaaagccaaagagacttttgtttggactgagagtttcagatgtgtcctctttggatcaaaggcaacaaccgccagtctagcttttgacgaaccacttgaaggtttctttgaaaggcagcacgctcaagtaccacatcgtcaccagaagcatccacaactctcggagtgaagagtacttagttgacaaaggtcaaaagatgattgatagaagatatcgaaaaagttgcttattaccaggcaaagaagtaggtcgaaaggtgattgataagagaaatcgggaaagaacacatcaaggtcaaaggtgtaaaggaatacgttgaatgctaactgaggacaacatgaagagaatagtgggaagtgaaccaaatgtgaagaaagtgaatccgagttgcttgttcgtgagagctattcccagttatgaaccaagtgatatgttcgaagataatctacagaggtcagattaaaatcgcatctaacaacgaagcctcagatttggcaggataatgattagacaataacaaatccagcagtaaagccatttgggaagacgtcaaagtatatcaagtgggataagttggttctcttgggaagcataattcaaaggcaaagttatcgacccttgcatcaaatagcagaagtagctatcacccagggaccaggaaagctaatatgaggcagttggtggcaagttagaagtaaatgacaagcatgatattctcatgatgacaagcatggtatcctagtaatgacgagctgatctcgacgcataacgtgaaatgggtaacttctatgaggttgacgccaaaaatatgaactatgcgaagttctggaactgaagcaccatcttcaagtgccgcaacccagtcgaagtcagctaaaggttcaaccagggacaagtcaggtgaagagaagattccatctgcaacaagggatcgagccaagcagcctagagtggagaagttttgctaggcaagtttgttataaaagacgcgacggaagaagtcagacaagaagagaagaccgcccaacctatcttcatgctagcctcctcgaatctcggggacgagattcttgtaaggggggtggatttgtcacgtcctgataaattcatcccgaaattaaaaatcattcgctaaaaggaataatagaattaattaaaattcggaaagaaattggcaaacactaaaatacgtacaagaaaaattcgaatgtggcccggagaatttttgttaaattctccttggtctaaaaaggagccctcaaattttacttgaattttcagagcaccggaaatatttattaagcaacaaaaacaattatcagagtttattaaaaagaaaaacctaaataatctccctcccccccctttgggccaagtctggcccaaagtcctccctctctcccctcgggccgcggccgaagtttccctttcctccctttccttttttccctcctcctcttgggccc

SEQ ID NO: 16531 - DNA, 15728 bp, Oryza sativa
aaaaagtcaacggtgtcaaacatttcgaaacggatggagtatttatcaaggatcaacacttcacctgacagtatttaccattaccaggtttatcgttctaattttcttataaaaattagattaatcttggtatttttctagtcttctaattgacagatcactaatgttgtttgatctgttatgcacgtacatctgttgcatccgccgttacggttggtgtactccaccgccattgttaatggtgtcattgacttcaccgccggttcgccttcatcgccgtcgagtgatgttttcgcctacacggatggttagtcacaccaccgttgttgggcatctacgtcttcactgccggcctgcctccgtcgccgccgactggtgttttcgcctgcacggctgacctattatgccgccgctgttgggcatctacaacttcactgactggctgcctcatcgccgccgaccggtgcttttgcctatacggtttgatggtcacatcaacgttgttgggcatctacgtcttcaccgaccagctacctcgtccgtcacgccgactggtgttttcgcctacacggctggcctattatgccgccgttgttaggcgtctatgacttcaccgccggcctgcctccctcgccgccgactggtgttttcgcctatacggttggttggtcacaccaccattcataggcgtccacattttcaccgccgaccgcctaggctgcctccacggctggtgttttcattgccattgatggatgactttgttcccacatcagtcacctctatcatcaccgcgggaaataccaaaaagctaagtcatcattaattttctttatatgatattttccttttcctctgcctcactacatcaactggttcgccgttgactagtgagtcgggggctacagatgttatatcatatttttttaacaattttcatttatctttattgcttgcgacataatctgagtacaaaagtgcctatcgagttatggagttccatcttcctatgctttccgtttggtttgccaatggatagttgcctttgggccgattcctagcactcgggggctcgttggatggaccgagtaacgcaaggtgctaagtattattcggaataaatcaaaagcatagagataagataaatttactttcttctccacaattgcaaaagtacccgagtagtaaattctgattcgtgaaactttgttccattaatgacgaactcatgtcactcatatgcatgtttgggaggtgcctaggccgactcccgatgcttgggggctatgactagtcggacagagtgtttaaatgtacggagtcatctgttcggggaaatcaaaattggcaagaggagaaatacatatttataaatttttaaaatacttgaatttttctcgagtattatattaacatcagatactactcatcctatatgtttgttctgcaggatccatatctaaatatgcataaaagggattcatggctttaagcttatctcttacgctccaggaatggatcagtcagaacatcaccgactggcttgcctccgccgccgccgactggtgtctccgcctgcacgactggcctattatgccgttgttgttgggcgtctacatcttcaccgaccggcttgcctccgctgccgccgactggtgtcttcgcctgcatgactggcctattataccgccgttgttgggcatctacgtcttcaccgaccgacttgcttccgctgccgctgactggtgtctttgcctgcacggctagcctattatgccgccgttgttgggcgtctacgtcttcaccgccgtcttgccttcgtcgccgccgactggtgtttccgcctgcacggctggcctattatgccgccgttgttgggcgtctacatcttcaccgaccggcttgcctccgctgccgccgactggtgtctccgcctgcacggctggcctattatgccgccgttgttgggcgtctacgtcttcaccgctggcttgcctccgccgctgccgactggtgtctccgcctgcacggctggcctattatgccgccgtgtctccgcctgcacggctggcttattatgccgccgttgttggacatctacatcttcaccgatcggccgcctcgtatgacgccagctggtgctatcgtcttcacggctggccacgttgccgccactacaaataggcgtcatcaccttcaacgcaagctgtctacgtctgctgccgactggtttcttcacttcgatggctgcatgattctgccagtgttgattggacttatcgtcttcatcgccggtcgtctcgtctgctgctgactagtgccctcgcctctacgtctggtttataccgctaccactactgatggacatcatcgtcttctatcgtcgactggttatgccgccgccgactggtgcttttatcttcacagctgcgcgtcttcgctaccggtttgcttttgttgccgccaactcgtgttcacttcatcacggcaatgcaactttgtcatcatggtggagcgacttcatctttattatcttcggcaccggcaaactctattgctgctacttcgcaagttttgctacttcaccaaccacgacgtctttgtgaacctcaacatctcggcatgcgatgccgtgttattttactagaacaagtggctctccaatattcaggatttctacttggtcatcttcaacacatatcttcaatcaagcaatgactactcgacgacaagaagctataattctcgactctatattcagttgtttctcaactaaccaaagagtcgggggctacacaaatacaagactcaaaatttgacagatgctatgtcaacatgaagcaatcaattaatcagccaaggagttctatggaatctactttgggagtcatcagcttcgtcctcgctccaaagcaggcgttctacttcagcaatctcaattattttaccggcaattttggcttcttagcgctgccataatctactcaaaaaatgtcaagtatcaagttcaagatttaatctacatgttcgggagcttagagttatcaactaatcagctcagtttcgacgagttggacaacaacatctactttcttctaaatgaagcatctgcaatagctacaagaccaagttctactgctatcgtcataaatcaagaggcgttgcattaatctcaattatgcacacgctaacatcaagaaaactatttgagcttcgccatcttctcaacaatttgaaggattattgtcactgacatcatcatcaacacccctacttcatcggccctgacgtctccgccgttgctaaggggtgactacgtcttcggttgcttttgtcgtcaccaactttcatcgtcgacttgttatttcgtcttcacggttgacctactatgcaaacactgatgagcgtcttcgtcattatcatcggttgctacatcgctattgcctggatcaccgacatcgtcatcttcatcaacatcctgtcaaatctcttcaacatagcccactctactgctattaatgggcaacttcgtcatcatagccggctatctctattgccgctaatcatcattaccatcggatgcgtttgtcatcgctgactattttcttcatcttcatgattgatggatttcgccattgccattgatgagcatctatgttttcaccactggcttgcctctgccaccgcccatggtgtcttcgctttcacggttggcttattatgcctctactgatgggcgtctttgttttcttcaccgagcgccttatctgttatcgactgattatttcactgccacggctacataactttatcgttgggcgccttcatcttcactgatggctgacctgactgctgccgactggtttcttcgcctccacggctgtgcaacttcatcacttttgactgatatcactatcttcactaccaccaatatttttgccacctctgatggacaatattatttctatattggtcgtcttgtctatatgccaactacgtcagctaccatcaatggacaattatgactacgacagaaggacaagctatatgctcaggggcttactagctcaaacacaagtatcataccatcaatttggacttgttccggatacatgcaacatgaattcatgaccatgggcctattttctacgctcaaagactggactatttattattccccgtaagggttatcaaccgaatacttgtgccagtcgggattcacttattatatctatttgggagtatcccataagggataatcactcagatcagaagctattcatatgagctacacttggtctatatcacctggaagatttattactcggaagcatgttacatgcgtcatcctttaaagggtgtcgaaggcatattttttggcctatgcctaatatgtctgcagcccatattttcaggtgtggcctgtcacgttcttttagggacttaggcactttttgcttaggccaaagtacgcgtgatcaagtgcccaataccttaaaatccttttatatcgcagttactcaactttttaggagttggtacaatgcatcttaaaaggtgttaaatagtaaagctttatatagctgccccgctgacttttttatataagtcaaggtgatgtttgggtttttaagcaattgattggatacaatatcgttgctttttgccacgtaagtgtgcacttttattgaccaatattatggcttaggctgattatatattgtggtcattttccaggcggttggtaaatcctttatgagtttatttactcggatgttacaccacatatgccatatattttcaggtgtggtgaaaccatgtgtcttttagggacttaagcacatctgttaaagcagtgtacgcatgacgtatgcccaatactttggaaaattctttattcacagcatacaaggttctttatagctatttttgctatgtgatttttcaatgatgtagtcaactttaggttgtacgcatcttgttttacaaagcagtcagtatatcacttggattatattattcgaggattcacaccgcatatgctacatattaatatcaagtcgcttggttgactacaattatcgaaaccactcggttggttggattattttccttgactatatgcttggtttgttcaattgaccacatagttggggggctacacctattaggtgcatctagtcgatgcacctgactttatttttcagccctccacagtcttcagatttggtaaaagtactcgggagaccatagcaacgatgattgaagcactcggctttggagtaatctagttcgagagaagattatcttttcgactatgaaggtcttaggggctactgtggagattatgggtaccccatacccacacggcatggttatccgactagtcataggggatagcttatatctatggaatatgtaacaaatcatgacttgggtattacgtttccttttatattatggagcagcctaaagtcctgatttgataatattgtaaaatagatttaggaaaccgataccgtattggttaaggtttctatcttgtaattctgccccccatcctatataaggtgggtaggaggccctgtagggggcatgagcacatatgatcgtcagatctataatacacccggcggattcaaatccccaaacaggagcagagtattacctctcattgagagggcctgaacctatctaaatcctttgtctccgcatccatctacttttaggtctcgtgcgttacccccttttattattgccgaattcatgtttcgacggtgaagtaattttgattgatgtactttgaagattgcatgaatgaagaaaatgattcagtttatgattcaacaattccttttatcacaatatttcattaatgctctgctttatgtacaaactatatcaaaaataatatttatgttagttctgctctcatgtgttaattccaaactattaaatttatcgatcgattgagtcgatgtcgccgccgtgtttcaatttgtgtgcactttgctgctgccgccaccgccgtcggccgtgctgctgtgcaatgccgcttctttgccgtgttagtgcgtgcgttctagtaatacgttacgtcgatctgccgccgtctctatttcatgtgatgtgttcgtctccacctgcatgcgtgggtcgcggctcgcgatcgccggcatccttccgtgcacacgaccggcggcatccttctgcgtgcgagattagcgatagccagttaattagtttcatgcggttttgaaggaagatgtgctccaagatttgtgcacgctagggggcaatatctccataggggtgccatgcaagctttgtggcatggggtgccatacaatttttttccagggcgctgccgccgcctgccgcctgccgcctcctccccgtggggagggtgccaccgcctcccctcccgccagatctggctgaggggaaggcgccgccatcaccgctaggccgagaaagaggagtgcgcgtgcgtgagagaaagaggaatgtgcgaaatagagagcgagagatagagatagagatagagatagacagagagaggagagagtggagtgcgagagagagagcgagagactctcggtcttatctacgcgagagagaggggcaccgagccctctcagccttatccgctcaagaccatcggtctgctctgttttttagtgccgaattttaaaaaccgagtgtcggttttaataaagtaaattaatggtgttagtttttgttaaaaaaaggcacttatagtctattaaaagtgccagtttttgtattttcaacctgcagatatgagaaatggtctataagtgctggttttatcacttgtggcacctaatgtcgatctctatatatctttttatagtagtgtgatcaaaacatatacgtatgattttgttactatataaatagtctaacagcataagcatattagaatacttttatgatttaaatgtaatagttgcctaaatgtttttacataaattttgctttctattagaagaagcaaaataggagagataaatagataatagaatgaaaagagaagaatggaaataggagcgtacagagttgttacgtatatacgtgcatccgtacacattgagtggggcccaaattggaggtagattaggatgagtggattacttatttttttctacgtctaatctaatggtcgaaaaggatgcacccatcaatttaaatgaaaatcaagggttagatgttttttgccacgtggcagcttagtagcgtttgtagagtgtcatgtgacgacataggagcgtttgtaggaagttaatgaacttttagtatatcctccctctgtttctaaatatttgacgccgttgacttttttaaatatatttagatgttcgtcttattaaaaaaatttaagtaattattaactctttttatatcatttgattcattattaaatatacttatatgtatacacatagttttacatatttcacaaaagttttttttaataagacgaacggtcaaacatgtgctaaaaagtcaacggtgtcaaatatttagaaatggagggagtaatagatatttttaatataaataaatctttatttaaaaaattactccacaaatttatttttcctcttttttgaacgagctgaccatcaggagacgcttgtgggccatcttttccatgctccattttcatcgttttctattgtccgagtatgcacttgcaacctgcaagcaattttttgtctgtttcggtgggtgcctccgtggaggccaaataatccacgattttaagacttgttcataaatactccgtatctagtgccaaaaatagctggggctggtgatttgcacatgtatacatctggacaggggaccttgttagggaaggttggtgccgtacgcagacaccgtcattatcacgattaggatcgagattttcaacgtcctctcctaattactatagtgcacatggatgctaaggcatgcaattgatgtgacgtgatagtgtaattatacaatcattgagacctgcaacgcgcacattgaatacaaatatatgaacgcaaaatggatatctaaaaagaaaaagcctaccgaaagcaagtatccaaaatggcatccattttgattcgattcgaagtcagtaatagaaacggacaaggttagataatggtaaaaggtcactagttacaaactacacagcaaaattcgcgatgagaaacgcgtacacaagcgctgacaaaatgaatacaatggcatggtaacgaccaagccaaactaaaccctatctcgctaatccaatcaattaatcagcatacattgttatgttacatagaaaaccctcatttgtggggtttacacactcaaatttccagcgagcgatgcagcacaccgccattcatcccaaggcaggtatgctgcatgctgctctcctcccaaaaccggcaaactctattgcccattgcaccactcgcagatcaatctatcccaagacaaccgaaacgagattgattgatttcttttgcctccactccactccacaggttccacggccgtgcatgtgtggtacaaacacttttcgtacatgcgaaaaaacactttacaatgtggagctgtttagcgtaagccatacttaaaaagtagtaagccttttgcgtggtgccaaaatatgtcatgagtcatgtgagccttggactatcaaatttatgcgcttgccgctatcgatgcggaggccatcactttttaggcccaactgaaaaagaaccgatgaattggttggaaactgattcccagagtaaaacaatcgagagatggaactcagttgatatgaacgtgtacctccacctgattgctatcaacagaaaaccatctcaagagaacaccgaggtggaccaccgcgggtatcattttgaatagaaggggtgttgttacctgcaatggtacacacgcacgacataaggtaaacgcatcatgaccacaacaatgtcacaaaggtttggtgatcatgctctcatttgagccgctccttcaaatgtttgctgagtatcatttacagtgagaacagaatatagcttaaaaagaaatgaagcgtataggtgcataccagactgagtgcagtggttccaagaagaagcagataaagtttgccctgaagaaaagcaattcagctatcagatgaaagtacacgcacctcagtgctcacaagacaacatatattatcataacagaacagttaaactattgactactccaaaagcaagctagagcaaaattagtcagaagctagctagaactgagtgtaaccatgagagtataaaacaacattgacaggcaggaagctttggagcaacacatgataggaacaaaatatggagaaataacctcaatcagatggatgcttgaagcacggcttagaagaacaaaagcaaactctcctatttgtgcaagagacatgccaacctacaaggaaaataacatgagatcagtgtaactgcatgagcaataacagaagggagcacatgtaaagcaatcaagacttacaagaagagatgttttgttgctatagccaaaccctttaacgacaacagcaacaataaacgtctttacagttatcaccaaaatcacagctgcaaggagtatatcgacatggttccaaaggaaatggacattaattagcatcccaatgctggcaaggaaaagagcagcgaagaagtttcgaataggttcaatctgcagaaacaacaaacctgaaataagagaacatataatgaatcattaactacatgaatctagctaaaactttgactaaagcagtaaaagaaacataaaacaaaaaaaaagtgcattgtcattcaaattgtcacagaactgacaaacttcacccaaaaaaaaaagcatataatttcacggcaaggaattacttgttcaagtgtgtgttgtgcaagatcagttgttgatatcattactccagctgcgaacgaacccaactcaagactcaagcccaacttatcactgcactgcatcatagaaggccgcacatgagtaaacataagttttaggataccgatagaagagagcaaatagaactgttaaaaggataaacataactacattttcttgcaagaaaactgtgcatgagccataacagtaaagaaagagttgctgaaaactgaagagcaaaacttacaaagattagtgcagaaacttggaacagaagaaagatagaggcaaagcactagagtctgcactacacattcactataatacatgctataaatcaatctagaatagtgtaaaagatcaagtttagcaaaattgttactttcacaatttttctttgaataaatttaatgtttagcatcctttaccggatccagttagagtgtcacaacttttggccaggtttagtacatgtaacagttatctgcactactccagtcatccagtgtttaaagaaaaatagtttcccattactgaacaattgcattcgatactaacatacgagcagttaaagaaactcacccaagcaaacaacaagcagaatgcaacagctgccaactggtacagttcatttgtctgcaagaaatgcagaaatgttaatgtaggataacatgatgatctgaaccagaactaaattaaatgcaaattaaatgctcaacaaaactattcatgtagtgcctgtcgattatattcacctgagatgaaagacttatcatcagcttaagaaaccaaggcacaccagttcgggagaggatggaaaggattgtaaggaatgttatcaataccaccaacctgagaatgtcagaaattgtgacaaaagaatttaatccaacacctgattatattatggaacaactttcacagacaataggaagttcaaatatacataggacaacatgatgtcattatcaagatataaggcaataaacttttgtgctgtcatgatgtaaaggcaggtagcactgctattttaagtaccaccatttagacattgatgtggcatgaatttactgcaggagacatgattctagtgtacagattattgtagtggtaaaaaattatatgtaaataaaagtttcaagccaaaaacacactacacttacgacttggccattgatgcaactccttgaagaagaccagaagcgccactcagaattggaagaagtgcaaaaagaagaccaacagcacagtcctgagacaaaggaatgtcaaatcaccaatacaaggaaagtagtgaagctcagataaagaaagaataatcagtccactcgttcgattcttaagaagaagcaagcaaaacgtgcaactttacgaattcatctccccaaacaactcaacaaatttagaagatggtatccatttctttcatacctgcaatatgagtgtgccaaccgtaacttggccatgaagggcattgatgctatttctttccatcagaaatttcaaaacctacatagaaaatattttcccagaaaagttaagcaaaggagatggaaatgggatttacaacacgaacataaccatattgcaagttatacgacattcaggaaacagttggcacatgagtcaagcaccatctacgaggtaacaacgtgctaaattgaaaaccatttggcatctatcgtctatgaaaggggtaatggttccactacgaaccaagacgaacaagttgatttacaacaaaagctgcttgagaggatgtgtagcaaaacactaaaagataagagtggcattccacggtggagtgaaatgaggagttaattagcaacacaaaagggtcatctccactgtctctgcacatcagaaaggagaacagaattgttgtgcataaaccactggaggaactgaaccaagcacagtgttttccggattaaaacccatgaaactcaacgtcacaaaaaaaattgagtcccagtcagattgtgcaaccaagtccttgattgtggcagagttggcagaggcaagactaatagataaggaaccaccggctctgcccaatggtcgtcaccaacacaatcagagctcccaccaacaaattgggcaccctgccacaaaaattagagctcttgatgatgaattaactatcaagttccttgccatattaacctctcgctgccaagaagagctcctctctccctgccgctaaatcatctcccgtttgcagttcctcttctcctcctactgccaggtcctgcatacttcaagttccaactgcccaatctactcaattttggcaccaaaacagtagatgtggctagctttttgtggagggtgggggaaccgagagagggaggcagaagcactcctgacaacggacactgggagagaaaaaatcaaaccgaacaaaacaactgcatgccccaaatttccttgtttggttcaatatatcctgatgatggcctgattactaagtagtatcaataagattatcgataacactgtcataaaacacatgcgagagagaatggacatattgctatttaaagagacaaagaacagtaaacggctcaaggactacgcacattgaagcaactaaaagccattgatgttataaatcataagcggacctgtagggtccattgtaaacttggatgaaaggcaatcgaatgcacagatatgcaagttcaaagatttagaaattaccacagccgttgaagacatagaaagaagaacaccaacaaaaacaccttcttttgttttgcctccacatagctgcaatgtgatattaaatataaacaaaaattaaaagagctgtaagacgtgttttttaatcctaatccataatccagagcaacatataacagggtgtacagtacttatgcttgaaaatggaaacatcaaaacatggttatttaaattacaacaatgaaacataccgtagcagaaataccacaaagcaacatgaacaggatgatttggagcaatcctccaacaacagcaaccgcacgaacaactcgaagctgagacaatggggaaacacctcatgttgttattatgtcaagtccatgcttgcataagtgcaaatatataaaaaaatcaaagatgtatacttttgctgtagaaaattcaagtcccagagcaaacagcagaaatatcacaccaaactgagctactgtttcaacctgtatggtaaagtatgagtcataaacacacaaattatatacaagtagatatatgcattacactcagtctttttacatgtagatttattgattgcattacaatttctacagtgtctgaaagccaaaataagcaggaaacacgaatgtgtataccagtaaagaagataacaatggtaagttggcaggacagaaatggtccaagaaaaaacagatgagcaacaattgagatatatacacataaaaaaaagaaatgtgcacagataaataaatatttgcaatgttacgagaagcatgatgtttttctagtcaaatgccagagggaatttctcgagcatacagctcgaaaatcaattgaagtaaacttaggcatttaaactagaaccttgatcttttacatggatgggatttggtttcttcaataagtccaaagttaatggcctcactgttatttatgtgaagttcactaaccactacacatgtattgtacgaatacagttaccaatttcagacaatgcaaaacatatctcattatatggcttcatctcaaaacaattccaggttaccatgccattttccagcaattagatgaagcgaatcttaattttcatgtacatctctatctaacaactgatagtgaaagaaacagagtgttcccatgaacttgtagggtgtgaagatagaaatgtaaaagcacttaagcggtatatatttctctccatgtgcacaacaaattgccaatagaaaaacaattacgatttagctgatagctgaagaagtcaaacaattgagcaaaagcacaaacatattttgagaaaagcaaccaacaaaggaaaaagcaccttacttgcaccatttcactgacaaagctaaaacctcctggtccaattatagatcctgcaagtaaataacctgtaatcacctgcaatatattttagagttgtagccttaggtggcttaatataaaaccacaacactcaaatagccacaagaataaatgccttgtacaagtaatgagaggaagaatgtatagcactcacaggttgcccaaggcaagcaaaggcaattccaccaaatgtagcagacacaataacaacgacaagatccgatatcaatctacaatagttcacaatcaacaaataagttaatacttaaggatactttatgaatattcaacatcagaattggataacatacctaaggtccagttgcagcacagggtattttgacttcggatttgatataataaaaacattatcctggatttgcaattgtgtcaattcaggacagtaaatcagaagataagaactggcacgttgtgcacaagtggtagctttaaagtcaaataaatccttcaaccaattgcagtgcttgtaccttccgatcaatcaatgtgggaacatcctcttgctctggccgatccaagaaaacttccttaaatgggaatgacctagggggttaagatcatagatttggggggtttaataaagagtaagataaataatataggataaaatcacttaaacaaggaatatcacaaagtcaaattttgatcaataacatacttattgtctttggtctcattcttctttgttactcttctggccacagtttccaggactccctggtaggataaagaacaagatgagcacttctacagagacacatgtgcgatgtatacagtatagccaacaatatttcacaaaaagtaatgaagacattgaaattcagaagaggaatataactagtttaatacaaggaacttcagaagaagaatataactagtttaagtttagtaagatttttcaagcaagtaaatacattaacctaggtacaccataaactaatattagttgtgtttgaaagtttcttagttccaccataaataaatattcattattatctagtctagtacaatgacaagctacaaacatcatccaaggtattgtcgtcagcactaggaaaatgtcaacttaactacaccaggtcaaaatatactgggtcaaaaggcacaaaaactacatagcaacatatgaaagcatcacggggctcatggagtttacagcggtagaaaacctagtggagcattatcaatttagcatgatcagagccagaattaacagttgcatcctcagtttaaacgccaactccatcgaatttaagcatgccaagtaagaaatttctttagaggcacacacccatatcgaaccaattctcactcaaattccaggcacaaataacgatttgaacttccaaaactaaagtcggcaggatccaaatatcccacccgtttccacacgcagcatatgatactaagaaatttaaccagattctaccctcaaatgggaacgaatggctgaaagtaagcaagcaaacacaagtgcgcaaatgaaatcacctgcttctcagccaccgtgttgttgaagctgccggggtccttctctgcaaaaaaccagagccgccgaaacaagtaagcacaaaatggcagtcccaaataatcccaaaatcccccaccgccgcggccacggaggccgagatctcgacgccgccgaccctgaggcgccgagtgggagtaaccagatccccaggcggatcacggggcacccaccc

SEQ ID NO: 16532 - DNA, 4577 bp, Oryza sativa
cctcctcctcctccaccacccccaccccctcccccgccgcagccgccgccgcggggcagaatgcgaccaccgccgcgaaggcaacgacgaggacgaggaggagacggaggaggcggaggggccccgcgcggcgacgcggcagcatcgccggagaggaggggagggggagagaggggtttagattgtggaggcgggtgtggcggtgcggtgtgcgtgtgagtgcgcgtgtcgggggggaggaaggagaaggagagggagagggaagaagaaagcgagagagaaaaagcgaaacacacgcgcacgccaacggggagaggcgagacagaagcgtgtgagatgcttacgtgcagttgcagcgggattggatttgcggcaatatgtagggggggtgtgtgtgtctgtattgagatctgttgctaatgggattggcgacctaacaatttcgtttcatttcttcaccaatttttcttttcttttttgtggggagggttttgagggcccattttgttgggtgtcatggtagtacactcccttcgtctgacaaaatatcaacatagcactggatatgacacattctaatataacgaatttggatactaaaatgcgttacattctgtattaggctggtatttttagatggagagagtatgccggtaagatttacaaacgtgatataggggttcatttgttcagtgacaattgttttcagttgaaacaattcaatttttgaagagaacatcagagtaaaacagtgtataaaaaaacataggtattcaccttagggcattctcaatttctcattattgagcaacagttttttagaaataaaacattgaacaacagttagattttttcttttgcaaaactaatcgctccattccaaaatatagctatgaatttagatagtaccatatagtagttactttaactatgaatctagataattgtatatattcatagctacattttgggataagggggtatgcttttagtttgtcataaaaaagttacaacatattcactttgttacaaaattcttcattagcattgaagaaatttattaccattccacttttaacacttgttcagattcatcgttctaggatatgttacatcttatcttaagttgattctttttgatacagggaaactagtttcaatagatagtttcctcttaccaaactaagcaagcgaaatgacttttatccagaattggttcaacccgtaaacaagtttagaatgtggcatgcttgttgcgcttgttgccccaacttaagccataatatattgccttcatttggctgctcaagcttaaaaggcatgtcatagcaacataatacaactcgtcttactggtgctcttgtcatatccattttgagtcatttgttgctttttttttataattggttggttattcgttgatgagcccaacgagattactttcatcaaattatcacaatgtcatgcactcctcattcatcacttccagacgagaagctggaggaaaggagggaggatcatgttgagaatggcaagaagcaatggattcaaattaacattagttgcagcttggagtgtcaactatagtatgagagagatgtggtgacaagaacaacaatgagatgaccaaggggctgagtgagtatttgactttgatcgaaaatgcataggaggagcaagaaccatgcatgaagggtgttatcctaacatagccatagtaaaataacatgtgactagtgcatatcaaggtacgagacggaatagaagataactatagtcaatgaaactaacgagtcgatctttattgggcttgaaaaagaggtgtggtcaaaccgaataatcttgtaaatggctaggctcggaaattagcattacactcaagtcaagacgaatgaaattactcacagagttgagagctgtcatcaatgtattgtgattgtgaaaaacattcacggttagccaaaaaagaaattccactattattcaaagtaaaatcgatatatctcgatggtggtgattttttccttttgtagatcatatcctccgcccattctatgcactgttggaagtttgtacggaaatatcgtttaatttgcttcttacgttaactagctgtatgcaaatgcaatgtacttgaatgcatttttagtactgctggtcattcaacgtaccagctgctataggatcattgtgtgatgcaatgctacaccaccgtacaaaatgacttgtacgacaccatgatggaagactttttctaaatgtatcatctatatactcctttttagagaaggccccacctcctctgccctagtacatttcttttatcagctgctccttaaagtttttcaagattaatactaacacttttatagattgcatttctattggtatctaaaatacgcatagcgtccttgcaaacatccgataaaatacgaattttttatctaaaatacacatagagtctataaagataccaaattttcatgtatatcactagactgtcataacaaaaccaacctagggttctataaccaatgtttctctaccgatgcatgggttttaattaccagcaccacacggtaagacaattaccataataaccatgcaaaaattcaacttcaatttattttttcttaaattagcttcaatttgtttttaaatcaacaatttcaaacccaagaaacgaatactgtcgaggagcgatcctctctagcgggaggtcgtgagacccccctttgtgagtttgaccgggggataaggcgcgatgatcaagagcgtatctccgcttagggtctagctgctagatcactagcgaatctgtgtggaagacgagggattatccagattcgggccgccgggaggcgtaataccctactcctgtgtgtggaattatggtggagtccttacaagagatcttgtgctccttggaaaccctagctgtgcttcctctggagctcaagctatcaagagtcgtccatttttttcggtgggcaaggttctcattttatagtttaagaggatactacatgcaccgttcatacctatccctccatgggggggctcacttggcctgagtcagatcaccatccgtgccttcaactggaagcaaagtggttgtccgccgccaggtgcggcccaacgccgtcctccgcctgacacgggggacatcccttccattccctcttaaatgtatggagactttggtggattcaccatgtacatggggcgcacttggcagtgtgccgatgggacggggcatatctacccccactccacctgacacagggtgggacgtgggggcactatcgcttgtcctatccgcctgcgatctgtcgcagaccggtcaaggtcgattgacatgcgtcaatcgggcggcaccgcacgtctgcccacaccacattaaatgtggtaagagatggttggggcgccgcgcatttaagacgctggatggcaccgcctgctccgtccactcactcgccacgtggtggccggtgagggcctcgaggcagtatgcctcacgggcccgaggggtgtgacgtggcgccccgaggccccctggccacctcataaccacctgacctccccccgagggggtggggaaaaggcaggccgcacggccacgtggctagatgggaaggtcattcccctctaccatgcgtacccccggacccatatcaccgacaaatacaataagaaagtactccctccggttctataattcttgacgttctataattctataagcgaaaacttcttgtgctattttttgggactgtttttttctgtgctatgaatcgaattttcttaaatttttttatcaagtaaacaggcccatatttttttccaaaataactgtatatctttccgtgccccatgtatggtctgcagcgacgttacggcgtgtacctcccaccggctggcctctgggtgcattgccttcacacacaccactatcgatatcccctgcaggagtccacttccactggcaggcagttgcacgagcactctaccaattcaataataatcatcaattcatcatccccatgcataatgactctagtacttcctctttattcgtaaaggaaatcatttaggacaatatttaagttaaatcttaaaaatataaatcatgaataactctcaagttattgagtttgaaaatgtaaaaattatatgaatagatttgtcttgaaaaatactttcataaaattatacatatatcacttttcaataaatatttttatagaaacaagaagttaaagttatgttttagagaccgtgtcgctgttctaaacgacttcctttacaagtatggagggagggagtactagagtatctacgcactataaaatcatcgcaacgatctccgaacccctattattggccgcataggtatatactccacaatctggtcacactagcactagcagtagctcagcttttttttttttaactccggtagctcagtttggtcatgtttgaaggagtttatgtctgactaaaattatttttttaaaaaaaaagtctttagctccttcaaacggtacaggtttttacctaagaaaataatttaagaa

SEQ ID NO: 16533 - DNA, 12295 bp, Oryza sativa
agacgaccaaacacaatcaagcttttgggtggagggagatggcttgatagatttggctgtagatgcagggaaaagcaggtagaccctttttgttggcactgtcggctataatggaaaccttgaattatttaaggagatcatgtcctcatgtggcccctaactattagccttttcgtaaaaaagcatgcgtgaagagcgttacatagaaatagcagctgacagatgaaatcatacatcaaacccaaattttttatacctcgataaagaggacagattgttcctatttttttatactaagaatggaaaaaaaacacttgttcaagaggaatcagactcgaaaaccttacacctgctgttaaaggagatcaaacagacaaatggacaaatccacgtcaaccaagttagacctagtttcagtcatgcaaaattacacatctaaaaaggaccgtgttacgtaaatgtgtaattctagaggagggcaccagtttggaacacatgaatttcacgtgatatgatttactcctatcactaagcatgtgcttggttcaaggaataggatgtatcggcatagatcaaacacatttttcagtgtcattggtttaaggacacgcatgatgagaacggtccctaaaaagaatattctcataagacccaggtttaattgacgctatcccactaaaatcgacaaactaattaacccaacccacttagggtgtgttcgctactccagtttccccgcatgcacagtaaacacggaaaacggagtagtccattagcacatgattaattaagtatttgctaaaatttttttcaaaaatggattaatttgatttttttaagtaacttttgtatagaaacttttttttataaaaaacgcaccgtttagcagtttgaaaagcgtgcgcgcggaaaacagagggagatgggttgggaaaaaggagttacaaacacacccttggggcatatttggtaaagctccatctccagcttagcatcgttctatctctcatactagacggataaatagaaccgtctcataattaataaacatggataagtccatcctattctaccgcgtgtccaaaataattaaaacacatgcttttacgctttttctgatgtgcgcgatacaagttggccaatagcatcgtgtatatgctcctccagccttggtgggattggatttggagcgaggaggcgatatcagttgtctcgccaccactccagtccagtccagcaggttgtggttcggccgcggtccacttcgctcgcgatcgtggcctggccgtcgtcaaattcaaattcaaacccccaaaaaatataaccatatatcggacgaaaaaggggggattttgttcagacgtggtgtgtttcatctttcaacggatgattgcatcacaagggaaaatggaggactcgcacaaaaaaaaaagcacagatacacgtcctttttgattgggttgtggccaaccttcctctcgctttctctgcctcctgttgccgtgaaaactgaaaagctcactggtcagtttgatctcgcaccgtactagtactactttactttggacgtatagatgctgcttgcttctccctggtgcacggagacaacaagcaaggctgcaggacggatggagtactgtttactcggttgtctcgtccgtcctagccagtgaacgagcggcacgtccaagcgtagggtacaagtatacacgtacggtgacaaactttgcaaaaataattataccggattctcgacatattatagtctaattttcaagtaatacaataattaatataacttaaaatagctagaagtagtaatataatgattaatatgacttaaaatagctagaaatagagataagctattcggtatctgagaactgccgtcactatactcaaagtgctatacaaaagaaatagattttttcttaaacatcgaatctatgttatcaacgattattatgaacacgatttgagtagaaatttagagatatttacctttgtcctatgtttcatatatcatatatgtcttagctagacctatacttatgtggcattcttctctaataaggtgaccgctagaagaatcccctccacgtttgcacaagtcggaacctcggtaaaacccgtgtatctctgtagtggcatacacccaacttcaatcgaagcatgcattgtcccccctccccttcccttccattcaacccaacccaatcgtggaggggaaaaaagggccaaccgatgatgacgacctcgactatggacgctgtcgtagggcactcctgtcacttgagctcgatcagtggcaccaagcttgagccgccactgccaggaggaaaggggatgggaggaagcagagagacgagaggtggcacgaagagggggcgaaggccggcactcgaggagatggagaagggaggaggcgaaaaggaaaccaatagagaggggaggaggcgacaagagaggcggaaatggagatcgatctgctggggagagaattagaggagagagagggcggtgagggagaaaaaaataaggtagggtgatagtgggtcagcctataattaacggtatgtatgtatttttgatgatgttgttatagcgtctaaattgtaaaagtttcagttaatttgtgttaataaaaaatatgagaagggttggcatcaagaaatcaagagccaaaatgataataataaagaataatgagtactacattcgtcccaaattagtagtcgctttgacttttttttgtaacgtttgaccattcgtcttatttaaaaaattagtgtaaatataaaaatggagaaatcatacttaaagcactttgataataaagcaaatcacaaacaaaataaataataatttcatattttttttaataagacgaaaaatcaaatattataaacaaaaactcaaaacgacaaatattttagaatggaggtagtagccatcatcgtaaagctatagcaacctcgtcctacatagtgtgatgtgacacaactatgaatattacactaggaatgcccctattggtgagtgtgtgctggtagggtggatcaagaaaaaaagacaatgttctatggtcaggggtggagcaaaaactctaataacacggtccatgcctccgcccatttctggatccggcccactacggttacatctactaccaataaagcatcatgcgaaatgatttacgagaagggaacagtttagggtcaattgaaagactgttctttcggcccattttcaacttgcaaaagatcatccacattccaaaaggaatgagttcacttcaggtccctcaaatttgtcgtcgaatctaatattcatttctaaaccgcaataccagatataacgcattcctcaactctcaaaaacaatgcaaataaaatcaaagacggtttggatggtggttttaactaacacgatgtttaaaatgagaaaaaaatggtgaaacccatatgttagtgacggtccaattaaaagtaaaaaaaaatacagtgggactcgcgtctccttctccccaatctccccatctccgcggcgagcaattgggggtcgctcgactccaaggcggcgtcctccaacctcaaggtatcacctcccagccgatggcacctccgatagatctgctagcctcgcctgcttcactctcaaatgattcttgtcttttgtgtttttcttagccataggaatgtccagttctagatgattggtaagtactttgggactctgcgctgtagtgatgtgtaattgatcgtgaagttgtgattactcgtttgctattacttgattcatatataaaaggaaattgacattttggttttcggtgttggtggccaccagattctcgatcattgatggcaccgcccccttcgggttgacgatgttatcacgaagtctcttgttggaggagtcgaaaccaccatccgaaaccatccaaaccatattgagatcttatttgcactggttttaggagttaaaagacgtgtcatatttgttattgtggttcaaggatgattttcagactctgcaataaattaagggacctaaagtgaacttattccatccaaaaagagctgtcaccttgccaatggaaaaagtacaccgaaggttcctcaacttgtcatcgagttacaaaatcgtcccccaaccacaaaaccagatatccagcgtcccttaacttattctacgtggtggctgagtcagcatgggacccacgtgtcagcgtgaccacttcaacctcctctctctctcttttccctcttctctcctttcctcgtatttctctcccttctctgactcagcaggcgggaggagaagggcgtcagcggccggcgatgggcgacgcggcggctggccgacgcgagggagctcgtgttgtcgttgctggagaacgcgacgggccgacacgagggagctcgtgctgtcgttgctggagaacgcgacgggcctggcgacgctgttcgacgcagcgaagcagcgcccctacgagacgggtcccgtggggaagttcgtgaaccgggtggaggtgaaggcggccctgggcgcgcgtggcgatatggagtgggaggagtgcagcgacgcggtaggcgcggcgatgcatggggacgtgatgaagagcgtgaagccgaaggtggaggcgctgctgcggggaacgcgcgtgctgctgtaccagggcatccgtgacctcagggacggcgtggtgtccacggaggcgtggatgcgggagctgaagtgggacggcctggccgtcttcctcgacgccgactgcgccgtgtggcgcatcggcgaggagctcgccgggtatgtgcagcgctccggcccgctctcccacgtcgtcgtctacggcgccgggcacctcttgccggcggacaacggccacgcggcgcaggagatggtcaaggattgggtgttgcaggcggggctattcggccgccacggcggcatgaagcgcgcaggctgactccgcactcccccggggggggggggggggcgcaacctgtggcctcatctctcgcggtgtcaaactctaatctgatttgagaatcgagcagagtaaatcgaggaatacaattcccgggaaatacaagcatttgagtttataatggttcttctggtgtggttgaattcatcgtggtaaacttccctggtttcattgggattatttcctccagaaggtagcttatccgggattgtttttgttcagtccaagatcagagggcaataccgaaggatcactttgtaccaaactaccaatgcagtattcagtaacaaggacttaaaagcaattcgcaaatctcagaaacacgaagctcctcatttcgaccagaaaaaggcccattttgctctcttgtactctggagcagggtttacgaaaacgaaaaaaaagccaaattcatcgcgcgggcggacggcggggggaggagcggtgcgcgggctcccccgccggccgccgcccactaggcagaggaacggtggccgggggaaaggagtggcgactggcggagtggagttgggcggcccgtccgtccctgccgccgccgccaacgcggcgctcaccatcacatgatgtcgggcgcccaagacccagcggcgggggccgccgccgccgctgctggagccatgcaggacagcttcttcctcggctcggccgccgccgccatgttctccggtgccgggtcgtcgtcgtcgggcgcgggaacatccgcgggagggggcggcggcggtgtgccccttctacgaccaccccaacccgccggcgccatgcccgtgccctctctgccaagcctggggctccctggctggcctcgatgaccgcctctccccatctggcgccggctgcatcgagaagagaggagaattgaagaaataaaagaaaagagaaaaaagacaagaaataagagaggatgatgatgtggcgttctgacatgcggggtctacatgggttccacgccaactcagctgccacatcagacaaaaccagggtgaaaagcaccaagggacctaaaataaatggttttgtaagttgaaggatgtcatatatctggtactatctggtactatggtactatgattagaggacgattttgtaactggacaacaagttaagggaccttcggtgtactttttccccttgccaagaaggcatcaaaacagctcaggccatctttaacttaggcccatttcctcacaccccaaaaggcccatccagataatggctcagatgctcagttcatctcatctttcctcgtacacacgaaaaatctgcacgcctctttgcaaatttcaacccttcttttcgaatgcaatttcatgttcagatcccacctacaagagctcatttacaaagaacaatcaccggcaacttttattccacgtgcatggctcccaacaaattctgctcttaacatacaaaatgtgtacacgtactactacatacttgtacagccaactgaactcctgcaattacatcatattacaggataatttcgaccaattttttttatgttctctccctcttcttcaccatctcaacttggccgggaaatactgcgagagaattcagagagaaaaagaagatcatttcttcaggttttaggacaaaaagaagtctgtttcaagcttcagtattcgctgcaaaatcgatcataccttttcgatgagtgacatgtagtagggcttcaccttctcaacgtctatcctctcattgctcttgctgtacaggtcgtatttgctgcagaagaaaaccattcatgttcagtacattttcatactatatacattaagatgcagggtgatcaatctggtggcttacttgaacacacgcagccatttgaggttctccttgtcctcatcgttcatcagatgcatgtaggctccatgcttgtgcagggctgaatcatggacaaagatagcaaaatttagctaaaacttacttaaaacttgtaattctgacaaaattgaaaaaaagaagactgtcgcgcgcacttacggtagaatgaatgatatctgatgatgaacaagcctgcagaaggaagagtggtcttgttctccttggcaacctgagatgaacaagaacaagaaacacatcaacatttcagagaaaactacaacctcagtactagaactgaagatttctctgctccatggtatgcaattggtgatgaatcgacacgatgaaccgtgtgttttaccaggtacatgtagtcgtcatggccccaggacatgagaacattgtcaaggccacagccctcggagtaggccccaaacttggtgttgagctttgggttcaggtagtcagggttctccttgaagtactgcacattttcagacaaaatattttcagtttcagtcttagaccactagctcactgcttgatccatctacgcttttgatttgtcttgaacagtttgctagatgattcattggttaccttgaagtggacgttgcattcgtcgaatgcgcagccgacggggaaggtgtcacctgaaaggtcaaagacattcagattcagagatggatggatgttcagctattgttcctagctgaatctgaagaagtttcagtgagatggcaataagctgtttgcttctgttgtttgtttcttaccgacgactgaccactgtgggagctccccaaagctgggatgcagcagcaccttgcccagatctgaaaaagaaaagagaacatgttacacgtcacaagtgtgccccactgtattgccatttcatttctttcttcctttagccgagtaattccaaagaggttgttacgaaccgtcactgatactgtatcactccatcatatctaattattcatctttatttatcgtatggcctacctgctagtgactggatgagtcctagatatatactattattactaccttagagcaagtttaatagtatagcccactactagctccaattcatctatagctaatctaatagccaattcattcaatagttgcttactatactattaatatatggtatcacctgtcatacacacattgcgtcttgaagtccgtgctgcagctggctacagatctgtagcccactactcttctctctcatcgtttatctcattaaaatatatttatagctggctaatagcctgctattgtacctgctcttacaccaacaaatcctacccggtgtatcgtgtgaggcctgcctatcagttcattgcggcgacgcggtggatgtgcaattacagtgacggtttttgtggcggttataaaatagtttaatttaccgtggatgaggccagtgaggtggagccagtcctcgtcggggaaatccttgcggatggcctcggcggtctggaggaggtgctcgatctgcggcatgtcgaggtccgggtcgctgtcgtcgatgaactcgttgagcagctcgatgcactcccagatccccatctccgtcttgtccaccctaccgtactcctcccgcatccgcctcacctgcaatgttacaatgcaccaaaataatggtaaatctcatatattaaagctcccgttcttttttacttgtcgtttaggatattatgagtgtatttttttaaaaaaagattattagatacagaatttgcacttacgaaatcatatgtctggttgatgtggttgacccggtagaactcctccaccgtctccttcctctcagactcggcctcataattcctggagatttaaaacatcaccatattattccggttaattccttttttttaagaaatatcttttactaccaccgttgaaaaagatttcaatttctagattatgaccataaggtttttatttttcgaacacaggtagtgttttatttgtccacgtgttggactttttaaagaaacatcaaattgaagtacagaattcctgaagaagcgaaaatgataacgtgcaaaaaaggaataggcaaaaggccatgttaatgcagccacagatgccacgtgggacattcactgtgcatagacacgcagaaacctttgaaatcgtacaagaaaagataagtctttattttattttatttgaccagtaagtagcttgccactttggtcagcaaaattgagtttacgtttaagtagtcaaattcatcttcttcttgtccagttttatctgaaaaaaaaacaaaacctgggtttggacgtttcaacaaaaactaaaccaaacggctaatcatggaaagacaacttgaagtaatgggacaaacatgtattgtggcttgagagagaggtatgtacgatttgaatgcacaaccacaagtttcaagaatggccacacatctctttcatttcgagttgtgcccatgttctagtttactaatttcgtacgaaaatatcatgtctgtcttgtcagcctgctcgcattgtcctaaaaataagccaatcattctaatataacaaatctaaatataacgttgtactaaaatatatcatatcttaatacgatgttggcttattttagagggagcaagtaataccaacctctgtttttgcaaaggagaaaaaagaagacattccatatgcaaaatatatgattatttgcacatgtccacttgaaaaaaaacttgctgcccactctgttttttgcaaagagaaacaataaccttcaccatatttaaaaaaatactacatgattaattaaattccctaatccactagaaatattttaaatattttttcttctgaggggataatatttttaaccatagttgacactctgttttgctctgtttttgcatgatgctctgtttttttcctatgcaggaatatgtagctgacctgaaggcgttgccgaaggcgttggagtccggcacgacgaagccgccgtcgagcacgagctccgccgcgttgtcgccgccgccgccgccggcgaccttccggtcggcgatagcatctgcaagcgaaccatgtcagaacttagaaccttaattagttccacgatccatccatccatccaggaacattgctgaaccttttcttcctcacggactggaatcaagaaatcaagagagagagagaaaaggatcatgagctcaccaaggtgaggctgctcaatggtgatggtcatctcgatctaatcactctttagacagatcgatggtagccacaggggtgctaattaactccggtcttagttcttaaacacccaccccaagcctctatgtatctcaacgccaagaacagaggtgcatgcaggtcgaggagcacggcaatggcgtattggcgttgctttctgctgctgcctgagctgaggaggaggaagaagaagggcgaggtggatttatagcccggggaagctggaggtggggccggggcgtcagcgagagagagactatgaacgggtttatcctaggcgagcgagcgagtgactcagccatggcgtggagctacggctgtggatgacagcgacacctcacgcccgcagcagtgggtgctccgtccatctgctcctactcttccatcgccgtattataagtcgttttaatctttcatagttataaatctatttaaatttaattaaatttataaaaagtagtaatatctactatgtcaaaccagttacattaaatataacattgaatatattttaataatatgcttttattaaaaatattgctattcttacagacttatccaagtctttaacttaaaaagtcaaaatataatatagaacggataaagcatctaagaatagctgaatgacagaatgatttacgataattatttaagagtagaacgaatgataaataattgaagagtagaacgaatgataaatattgtaaagtcaaaaatgaatttagaatagtttctaagagattcatatatagtttatttttttgaaaaaaagtttcgttttagtttcctttcttcttttaggtttctgttttgggggaggtttggctgtctagatatagaaatgaagttgttggaggataaaaagttgtttcttctctaccttttgcatttgtttaaggtagccactctctcccaaacaccccctaagactatgggtttcctcatttggaccgtcggtgttatcttgtattacctcagctggtgtgtatatacatatatgctctttttcgagatggtatacctaaaaggacaaagtatttgtaatacccctagttatcttataaaataatataaatagaagataatagtattcttttttagaaaatataacagcagtataatattctcagaaaattagagtctaaatccaagtcatatatcgagaaaaaaatagacaaatctaaaacataaatagtaatttagctattcaattttgtaataattttctcactttatatgttgattttagacttcaattttggtgagatgggggatggccaacatgcatactctacattctttttagtatagacaatgtctgaaaataatatatatatatatatatatatatatatatatatatatatatatatatgcacacacacacgaggagatgtccacatctaatttagagtaaagtgtacgggtggtccttaaacttgtagggatatgtcatctaggtccctaaactctcgaaatgaatatccaagtctcatttaaattttaactgataaatgggacccattgaaaatttttcatttttcttttttttcttctcttttttccctttcttctcctttctttgtgaagaatgagaagaaaacgaaagaaaaagaaaagaagaaaaaaaaagtaaaggacacgtctccatgtgttgaatatgacacaattctacaagtttaaggaccgccaatgcactttactctctaatttaatactaaatcattaggacatagataaagggagactaatttcacccgctgtaacagtgtaccacaccattctgatatttctcctcggaaattaatcaagtaatagcattaacatctcaaattggctgtcacaccctgaaaattcaaaatatataaattgttgtttaaatggaatttctagaatttattttaaaagtcttgaaaagaaaatctatgtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaacctctcttctctctctcctcggcccagccggcccagtcccctgccgcgcgcgcgcccgctgcgctgacaggtgggggtccac

SEQ ID NO: 16534 - DNA, 9239 bp, Oryza sativa
agggagcaaggcagcaagcccgtggtgtgtttcactgtggagacccaggacattatgctgacaagtgtccgaagccccgtcgcgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactttctttgcaacatagcccctcggtcagaatagaaattaagggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaaaagattcctatagtccgagagtatcctgatgtgttcccagaggatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcagcttaaaggtgccactgttttctccaagatagatcttcgatcagggtatcatcagttgagaatcaaagaggaggatatacctaagacagcttttaccactaggtatgggttgttcgaatgtactgttatgtcttttggacttaccaatgcccctgctttcttcatgaatttgatgaataaggtgtttatggaatacctagacaagttcgtggtggtctttattgatgatattcttatctactctcgaaccaaagaagagcatgaagaacatcttcgccttgcattggaaaagctacgagaacatcaactgtatgctaagtttagcaagtgtgaattttggttgtccgaagtgaaattccttggtcacgtcatctcagccggaggagttgccgtcgatcctagtaacgtggaatccgtaaccaactggaaacaaccaaagacagtttcagagatccgcagttttctaggcctcgcaggatattatcggaggtttatagagaatttttccaagattgctaagcccatgacacgactgcttcagaaagatgtaaagtacaagtggtcggaagaatgtgagcggagttttcaagagttgaaaagtcgcttaatatcagctcctattttgattttgcctgatccaaagaagggtttccaagtgtattgcgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaattggtatggattttattactggtttacccagaacgtcatcaggccatgactctatttgggtaatagtcgacagacttaccaaagtggctcattttattccggtaaagacaacctattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctttagatttcggtggaagttgggataagaatctaccctatgcagaattttcgtacaacaacagttatcaagctagtctacagatggctccttacgaagcactgtatggtcggaagtgccgcactccgcttttgtgggatcaaacgggagaacgtcaggttttcgggacagatatcctaagggaagcagaagaaaaggtaaagatcattcaggaaagattgcgagtggctcaatctcgtcataagagttatgccgacaatcgccgcagagatttgagttttgaagaaggagattatgtgtatcttcgtgtcacgcctctacgaggagttcatcgttttcagaccaaaggaaaattggcaccgcgttttgtgggaccttataagattgtcagtagaagaggagaggttgcttatcagttagagttacctcaatctttggcaggagtccataatgtgttccatgtgtcgcaattgaagaagtgtttaagggtacctaccgaagaagctaatcttgaatagatagaagtccaagaggatttgacctatgtggagaaaccgatccgtatcttggaaacaagtgagagaaggaccaggaatcgagttatctgattttgcaaagtccagtggagtaatcactcggaagaagaatcaacttgggaacgagaagatgaattgaagtcagctcatccgtatctgtttgtcagttcttccgaatctcgaggacgagattctgtttaaggggggtaggtttgtcacaccctgaaaattcaaaatatataaattgttgtttaaatggaatttctagaatttattttaaaagtcttgaaaagaaaatctatgtttaattaataaattccaatataaaaagtggccagataaaatttcattaaatactttgcttaattctataattcctagatttttctaggatttatttgagctaaggaagtatttttaataaatggaattgcatttaagaaataatttaaattgaaaaagttttaaaaagtcttcttttggctttgggccgaaagtcggcccaaaacctctcttctctctctcctcggcccagccggcccagtccgctgccgcgcgcgcgcccgctgccgctgacaggtggggtccacctgtcaggttcgtcttccccgagccgccgccgctgccgaaaccctagttcgcgccgccgccgtttcccttccaaatccggccgcctctttccttctccggccgaattggttgaggggaaacaatctccgggatctcctctacctttttctctttggaatcatcggctaaatcgctttggaaagcgttggaatcaagttcgattcggatcgggttccctctttccaagccgcgagtttccttcgccgttgccgtcgccgtgggccttcgccgccgcctccgagcccctttaaaaggatccccgtgctcttctctttccgccgccaccctcgccttcgcctctcgtcgccggaagagctctagcgccgtgtgccctagctttgccgtcgccgccgccgctccagccgtgcgccgccgccgttccagccgtcgccgtcgctcgggaaggccgccgtcgtcatcgccaagtcgccgccgtcctcgtccgccccttcgcagccgtcggaacccgccggagcttcgtcgccgtcgacaacccgaaggtagccgccgctccttcctcgtcgccgtcgtcgtccgttgcctctccgccgtcgttttggtcgccggtgtgttcgccgtgccgtccgctacccgttggtgccctccgtgtgcgtcctcgcgtcgccgttcgccggcgagcatgcgccgcccgagccgtccccgcccgccgagccgccgccgccgtcggtgacgtcaccgctgacgtcatcaggatcctctcccgtgagccgccgtggacccgatcaatctcggccgtccgatttggatcggatcaatctcggccgtccgttcgtgtgaaccgccgcccgtgcgccggtccacccaaaccctagttgctgacgcaataatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgcttctttttgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttattacaatttgactagttgagctttatttatattggttcaactagatattaggtataattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcatagtaaaagatgctataactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatgcaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattggttgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatttttttttaatggttctcattaaaaatttattccagtgttattagtactgtacatctattactgtactaatggctcatttaccagcaaaagttttacaatgttgtatttaatcttgctgcaataaaataaatttagtatgtcgattttataattttcttttatttcttttgaaaccagttattcaaaattacaaaatttgtgaccttgtctccaactatttcaaattatctcgcaaagcttggtttactttatttacttcccttctactttgatttctaaactttattcaaattaatccaaaaacttgtgctattaattggataaaggtcttaactctctcctttcacttgtctttagatgccgcgttacaagcctgagtacctgtttggtgttgagggttttgtccaggagttgcgtacgatgtcctttgtcattggatttgggactgcccttttttatgcccagattcgtcatgatcgtcatgaagaaaagtgccgagtcaaagtcaccttgaacagcaatagtgaagaggtcccctcagtgatgtttgaagctggaggaagaaactacatccatgcatgtcaggaagtggcaaggatcgccataggagagctccgtgatcgctacagtgatcggttggccgatactgagtatcgctaccatcctcgtcaaccacagggaagtgaccgtggcagttaccttgagactgaaggaattgagaatgatgctactacaaggcatttggttgagatgctgtgggctatggatgaaagtcgtgcggagactgtgttagcagctcaagatcgtgaagatcggaatcgtggtaagatttgcaagctagaagacaaggtggatcgcttggagaaggaattagccgcattgaagggagaagcaccgccgcagaaggccaggattcgtctcaccgcaaggaagagagctttgtttgtccctcgttatcaattggcgccaaagatccgcgtggtggagaaagaagttgccccagcaaatcctcccgtcatcatcataagtagtgatgaagaagaagaacccaagcgcaacaattccaagtttgagtgggtagctatcaaagatgaggaagatgagccgaacgagccttcaatcgacctcctatgctcggaagaactagagtgacttgttaagtcgttgtcttagatcgttgtgttagtttgcttgttttaagtttgtttgtgtgtgtgggtcttgcatgttatttacatcagtggtgggatgtaagtgcatgcgtttgtttgcttctgagtgttaggaagttggtgagtttagtggtgtgagagtcttcagtttgtaataatgaaactcagttaagatcaataaaagttaaggtaattctctgtcctaagtagtttcccccgttttctcttcttatcctgtcatgccagatggtgaacactcgcagcaatgggaatggtctcaacaacctcaacaacaacaaccctaacaacaacaatggagagaatcccactctggcccaagttcttgctcaacagacacagcttatgaacatgatgatgcagcaatttcagaatcagcaaaaccaagggataatcatgcacctccacagaacaagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaagaagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagcccatgccacagggaggttcttcgtctgttgttcgtccgcaacgtcagttcttcaacaacaatgctggcaacaacatccgtaatcaagctccacgtcctgttgcagctccagcacagcaacaacctgccaagagggagcaaggcagcaagcccgtggtgtgtttcaactgtggagacccaggacattatgctgacaagtgtccgaagccccgtcgcgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttgatt

SEQ ID NO: 16535 - DNA, 9751 bp, Oryza sativa
attacttaactgttttatcaaattctcaaatgtttgctaaatgctgcttttgcaaatgcaaccctactatgcatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattggttgagaggaactatctacctctgtaatgacattttattcacttattaattagagtaatatttgtactctattatcaatttgttattgtgtgcctcggctgattcctggacgagggttcacacacatgtaagcgtttggaattttggatagaaattccgggcgtgacattggcctccatctacaataaatatctttgaaatatagtaattgatagtttcttctgtcggtttagtttccttctttttttaaataaaaagaagaacttttaagcatcgataaatctccaaaactgctgccatgcctgctaacggcgacaattggcaacgccaggccgtgcagctgcagctacgccttctgcccaggggcgggcccagctataattcaagggtattcagatgtatacccaagaattttggacaaaaaataggtatatatactctatagttcatatatgtatgcaaaaagataaagaaaaagagttaaactacttatttgggccttgttttaccatttctgctgtattgggcctaaattctccactcccctctccctttgaactcggccagcccatttccaaacaaaattcccctcctcccaattcccaaaatccccaatttcaccctaaccctaattttgagacagccggtgcgcctggagggcttgcagcacgggcggcggcgcgcgttccggcgcgggcggcgggcgcggcgtgcggcggcgggcgcggcgtgcggcggcgggcgcggcgtgcagcagagtgcgcggcgtgcggtggcggcgtcgcagcgagccggagaccgcagtaccgcagggcaggcgccaggcgggcagcacgccatcagcaaggaagcaagccaggcagccagaggggcaggggcgggccgcgggcggacggccggcttggcgcaccggcggagggcggaggcgcgtagccgcggccgcgcggcggcgcaacgccggcagcggctgagcggcgcgtcggcgtgaggcgtcgccgggcgccgactccaaagtccagcgccgcgtgctgtgggcggttagttcgtggctgggtgccgaccgccgagccgccttcccctattccccagttcccttcccgccttcccccgccgacgaccgaggctgcgactgcgaagacgccgacgggcgacggccacgctgccaccacattgccagtatgccacagtgagtcagtgagtatgaagcacaaattttgaatattgcaatgaagattttaggattgggtaccgcaattgattgatttagtatacttgcttgggtgcttagttgcaattcattgctcaaatgctcaatttcagaatttaaacatgaagaagaggaagggtcctgctgttgatttgaagtcctttttggagaaatctgctgcaaagaaggcaaatcgaagccaaactcctggtgagggcaatttgaatccgattgatagtaatttaaatccttcttgcaatgagagtcagatgcaattagtcatttatcaaggtcatcatcatgagaatgagagtggtagtccagcaagtagtagcacaataccaattgatccagcgattagtgatatgccaggatcaaatgatgaatctcaatctagtgatgaagacaacgatggtggcttgtatgacatagagcatgatcctggactgaggactcctatctcaaggtatgatgtcaatgaccaagattcagttagaagggcatacattgcattggggccatgccgaccaaagatgaagaaagatgatttcccgcaacatagttgtggaggtatgcgccgcttcttaccaaaatggtttgatgagttcaagtggcttgagtatagtgtgaatcgggatgccgcatattgctttgtttgctatttgttcaaagaaagcaatcatggtggagatgcttttgtcaatggagggtttagaaattggaacatgaaaggtagattccataagcattgtggcgccgttaatagtgctcattgtgaagctgaagagaaatacattttgttcatgaaacctaaatcatcaattcatgagtcctttgcatcaaatagtgcgcaagttaaggccgagtatgaagctcgcttgttatggtcgcttaagtgcataagatatatattgcggcaggggttggcttttcgtggtcatgatgagtcaaggaattcagagaataaaggaaatttcagggaacttttgcaatggttggcagggaactttgaagaggttaataaggtggttctaggaaatgctcctatcaattgtcaaatgatagatcacgagattcagaaacaactcattcgctcatgtgctcatgaaacaactaaatttatcatagaggaacttggtgatgagtgttttgcaattcttgctgatgaatctagtgatgcctaccaacaagagcaattggctctttgcttgcggtttgttaataaagcaggacaaccggttgagcggtttcttggccttgtccatgttgaagataccacttccttgactcttaaagaggcaatcaagtccttgcttatgcaataccaattgccattgtccaaggtacgtggacaaggatatgatggtgctagtaacatgaagggtcatgttaatgggttgaagaaactaattatggaagattctccttctgcttattatgttcactgctttgcccatcagcttcaactaacccttgtagcggttgctaaggagaacactgattgtgcatggttttttgggcaacttgcatatttgttgaatgtctttggaatgtcatgtaaaaagattcgcatgcttcgcatagctcaagctgagtatatgattgaggcatttaaattgggtgaaattgaaactggccagggtttgaatcaagagatgggcttagcaaggccaggtgaggatcatgtttcatttaacatgttatatttggtactcaatcatgttatattttgtactcactactactttaaaatatggtggcaggtgatacacgttgggggtctcactacaaaactgtaatgcatgtgatgtctctatatccatcaatcaagaaagttctcttcagaattggcaaagagtgtacaggggttgaggctataggagctcaaactatgctagaagtatttcaatctttcgagtttgttttcttgctccacttgatgaatgacatatttggatacaccgctgacttttgccaagctttgcaaaagagggagcaagatgtagtgaatgcgatggatcttcttgcgttcacaaaggtagaactagatgttttgagagaagatgatggatggcgagaattccatgggaaggtcacttctttttgtgtgaagcacaaagttaaagttgttgacatggatgggaagtataagcctatacaaagatcaaggaagttctttaaagatgccattaattaccatcggtttcatgctgatatgtttttgggtgtcattgatagacaacttcaagagttgaataacaggtttgatgaggtaaacacagaactccttagatgtatggcatcattcaatccatccaaaggattttcagcttttaatgttgagagcttagttaagcttgctgagttttatcctcatgattttgatttcgaagaaatgaaccagctttcttttcaactcaaccgctatattagtgatgtgaccaaagatgagaaattcactaatttgaaaggtctagcagaactatccatgatgcttgtcaaaacagagagggttcgtcggtatgaacttgtttatagacttctcaaattggttctagttctccctgttgcaactgctggtgttgagagggtcttttcttcaatgaactacatcaaaaacaagttgagaaccaagatgggacagaaatacttgaatgattgtttggttacattcattgaaagggaattctttttgcaagctaaggacaaggacatcatcgattattttcaaaatatcaagcgtcgaaaagttaatctctaaattgtaagatttcttcccaatttatcattttctatcatttttatattccatatgttggcactttgatatgtttatcaattagtatttctatatgttaaacaatttcacgtgatgatcaattctatcaatgtgtgcacttatgctcaattttatgttatatacactatatattatataattattagtgtgtgatactatacaagccaattattaggtttttaggtgtatgaacaaaatttttttctttccccatttcgaatacacaagttcaaaatcctgggcccgccactgcttctgcccttatctgcttgatgaatactagttgaattgatcacaccaccatttaattccagcatgcgtggagacgctagctagctgctgatttcgcttctgctggatgtttttgatggttttgttgacgtgtggtgtggagttgtgcggtggacgaatcgctggggggatttcgtggtcaggtgttgcgatgcacctggcgcagcgtcagtctcatcatgcatgggatgttgatttggatgatgtctaaaaataccataattaagagtaggtaaattgtggcgagaaacataagtaagacttgaaaatagtttggtcataagtatgacatatggtgatgtttaaaactcatgtagatgaggatgaagataaagatcaagtgttttacgcaaaacgaggtggtactaacatattgtatgattaattgagtattagttattatgaaccttgaaaaatattttaatctgacattttagagcaacttccatatagaaagttttcgcacgaaatgtatcatttagcagtttgaaaaacgtgccacgaatatctaaaattttcatacaactttagttggaaagaaaataacagggctctgctctaagattgagagtatgatatgtaggatctaaaactaagaaaatgtgacatgacacaaccgtgacaacgaaacaaacacacggctaaagcatgacgtggcaaaatgaggaaataaaccaaacaccccctcaatatgtcggttgcaatcagccgctttggctcaccggaaaaaacatactcaattagcttatcattacttaaatattaactattattacaaattacaaattatatttattaatgaactatattataatttaatattgccgcgccaagtaaaaattcatagcatggtaaggtttttgctgcgccagtccaattggtgccaaatgttgtgtgttattctgctatctcactggaatggtcaaaaaactttagaattggaaattataagttttaggtgtttatttttcatattaaaaagtaatccggttaaaaataataataaatccttatattgttcccctgctaggcacactcatcatttgagacatggacgggtatcccatttgcatccgtgaacttatctttcagcccatgtcattagcataagataccacaagtttgtaatgagatgataataccatgcatatatacagacacaatacggctgcaagttgggggtacttgagagctgttgtcaacctaattgttgatgaggaattatatctttaatttcttgccgactacatgagtgcatatatgatttgtgtatttttaccacatgaatgcgtgtttagttagtgtaaagttggcaaagtacaatatatataactagacaaaagctttgactgattgttgtgttatgcattgtacacatactaacgaattttgctgcgcaatatcggagctagattttaaaagaatttaatttgattataactcttggatacaacggtatttcgtatcacccgtcgatgacaggacttctgtggtgacttcgtaaatctaaaaatatattgatctaatttttgaaggtacttataaaagtaggatatgtgtgtaagttaatcagggtatatgtgcacattttatatgagcgtctgcctatataccgcgtttcggagaaaaaaaactacagtaggatttgatatgcacagatctttagctcctgtatttcatctatgcaattgtgatagtaaagccaacagacaagaatacaaaaggatgatgatattagaaatccaaatcttatgaatccaagttggcaactagctatacatattgggggccggggtacagctaataaaacagctgcgtttgctgatcacttcagcaagcctgtatttctttcagggatggatgcgcgtaggctttgtcgtgtgctaacagggtcagaattggattgtttatatatacatcgccttgagaaatatatggcgtgtgcagtgtgtattgactcaaggaaaaacaatcaaatatatgtggttcgttgtttgagatgataagtgttgatctttcgaatgaaaaatgtaagtcgctttattagtagctagtttagtttcgtttcagaaatggatactttgtattgaaagtatcaataatgcagaagatctacaggaatgtttattaacaggcaaatattcaccatctgattaggaaataactacctagatcaatcattgggttttactagtagcagagatcaagaataagggtgtgtttagttcacatcaaaattagaagtttgattgaaattggaacgatatgacagaaaagttagaagtttgtgtgtgtagaaaagttttgatgtgatgaaaaagttaaaagtttgaagaaaaaatatggaactagactcggcctaaagcagaaagaatatgacacacctaattaataaggggtgactgaagaataggatgattcctagctaaatatagttatattttgaaacaaatgaaataataggtggctggtgagaaagtagtactctagagggctcaagtgtgaaacccataatcaaaattactggaaattatatacatgctgtgatcccgggaacataagtgtatgtacgtcactaagaagttttatattttagataaatttttaatcccagatatattttagagggaggggagtaattttgaccacaaatataaacagctcagatgtatcaaaataatcaagtttatcttttaaaaagtattatgataagagtaaatttttgcgagatcctcgtccaaaagggaaggaaccaagatccatgattgtagccaatagacacatatatacccaagattcatatatatgttaatgccctcagagaatatacatttgttagacaattgttactatcacaattacaattattcacaactccaaatatctagctagctgctccactggaggcaggcatgcgctcaggacaattagccaaagtacaagcaaacaagcgatggtagtacaaaataagtgacaagttgaggatcagccagcaccagcagggtcccgcgagatggattcttcccaacaactccggtgaatgactggaccgtgacaaagatgagtgcaggacacgaacactgcacgtgttttattgtgatatgctgtcaggatctggggatctcagtttttttctagtagtaatgcactgatgcatgatgtggtagatcaccattatactgtactcgctccgttttatattataaattatttaacttttttctctagtcaaactttattatgtttgatcaagtttataaaaaaattaatttcattaaatttgacattggatattgaatatattttaataatatgtttgttttgtgtactatatttttttttataaatttgatcaatttttttttaaaaaattaactagaaaaaaagtcaaacgacttataatataaaacagatagtagtaacatgaatccgtttatctactactatctctatcctaaaatattcagatataagttaaaagttgttaaagatggaaggagtactagctggagtagcaaacttggtcaacaaagatgtttatgtgatgttgattattcttttgctccctctgattttctgcaacctgaacatcgtacatgtaatgtggtgtatgcatgtgctaggtgaggagtcaaggtgacaatatttttttgtttgtctggagcaagtaatttgtttgacaatgtagatgcatggatttcaagagagctatcatagttaatgctatcatcaactgagttcaggaaagggactagcaagtaaaaaaatgggatggagactaagtagttctttgatcgctctaaaactgctgttcagtccctttccttaacttgtgtgttaatatggagaattttagtcctttggttcgtggagagatattatgcgaaaatgagccagttgttaaaagtaaaaaaaaaaaaggaaacttataaaactcggagctataactgggatcacatatttccgtcaaatctatgtatgctgcgatcatgaactgtaatgtttaaataaaaagagaattctgggggacttgaacattccactaaagatcaaggtctttacgtggtttcttcacaagaaagtaattctaacgaaagataacctggctaaaagaatattggggggataaacattgttctttctactatgcgcaagagacaatccaacatcttttttttagtgtcatgtcgctcagtttgtttggagatgtgtgtttttttgcttttaatatccctccaccccgtaacgccaaaaacattttcggtaattagcttagaggggtatctaggtccattaagaagatgattataattggagctagtgttgtatgttagtcaatttggcgttgtcgtaatgataaagtttttaatgataaacaattatctaaccccatgcagattatcttcatgtctccacttctggtctatgatgctaccataggaggagcaggatactatgcacaatgatgctacactcttggaatcggtagccaaggatctcttattccactatgggtggcgtagtttcattagaaatgctagctatttttttttgtgtagtttaaagctagtcaataataaaggaggagttggggatttgtcccatcaccttatttctcattttgatttacttttatcttacctttttattattattaaacttatggctatgtgtcttatgacagaagccggagatgtaatccattttcattattaataaaaaagctagggtcatgttgaaaaactctactgagaaatcaatcccatcgcgacatgacaaaaggcaatttttaggtgcaacagtaaatgaagaaaaaaaaaagaaattttcacacaattatccatctatatctataactaatataaatattcgtatttttccggtcgtcacatctaattttcgtctgtttttcgtccatacacaatccgattcggttagcaatagctaaggaaaaaaattgcaaaaaaagaaaaagaatcggcggccgccgacgccaccgccgccgccggagggagaagagaggcggcggcggagggagcgccgatgccggacccgcccgcggtggccaccaccgccaacggatccaccctcggacgaagccgacgccgtcgtcgcggccgttgagaaggcgccgtcgccgtcgaggccaacggggagagggagtggggtccatccgcg

SEQ ID NO: 16536 - DNA, 2676 bp, Oryza sativa
  unsure (1)..(2676): unsure at all n locations
caatcggacggctccagctgctcccacgtcgggccgccggcctattggccaccgaatggaggacgtaaaatggacttcaatggagatgaaaacaggccagacacatagaataaaagggagggaatataacattttctatattcggcccaatcatagaaaggaggattttgattttttttccaattaaataattgttaaatgcttttttattattaaaaattagcaattaagctctgataattacaataaaattccaaagagtgtaactaatcatggaaaatttaataaaattaaatttaaccatgttattttatttttcacacttgctttacttgtaaattgatttttatacacctacctatttaaaaataccaaatattttaattaattacataatgtaaagttttcttaactttttctcaatttttttttctgtacacttcctgttgcaacgtacgggcacctttgcttattttaattaattacataatgtaaatttttcttaacttttttctcaattttttttgttctgtacacttcccgttgcaacgcacgggcacctttgctagtatatatatatatatatatgctctaattgggcactttttaggaacgttaacatccctccattgtttgattgaatgtattatcatgaccgtagatcctcttgagggtccatgttaaataaatcatgccacactttacgcccaagaaagatcatgccattgaaaatgatatggactcttatttaataaatcagaaattagtaattaataataaatatggtggcaaaaatatcaagcttagactgtcagtttagtattttattaatctatttttaaaattcgaaattaataattagctagttgtaactgacgtggactctcttttaacataagcaactacactttcaaaggaaaccaacacgttaaatataatattagagctttaatatttatagtgtcaatattcattaagaaggggtgaaacgatgatatgttcgcacgttatccgtaggacctctcaaagaaagaaattgaaggatatatgaaacgtttgaccattcgtcctagttaaatttttcgtgcaaatataaaaatatttatatcatgcttaaaaatatttgatgataaatcaagtcatattaattatataaatttttttaataagataaatggtcaaacgtttagtaaaaaagttaacggtgttatacattaaaatacggagggagtattaggtagagttgtcgtttttgctacggtatgtttcaggtgttagggcaccaacgttgcaccaacattattttcaataggtcccataatcagggtagttagtaagtttgtgccaaatccattatgtgttatggatagggtggtaaacaaggcgaggcactattgaaaataaaatcctctaacttcagtctctctagtgagtagaaacactacaaataatatgctttatttgcttgttgctagtaatagcacaaagatccgctttttgttattacctcttcccacgatgcttattacctaatagcaacggtgtatttattgcttgttaccgggttttctattacgggtgtgtttagttatttggttgtaaagtttttgatgtatacggatacacatttgaagtattaaacgtagactaataataaaacaaattacagattacgcctgtaaactacgagacgaatttattaagcctaattaatccgtcattagtaaatatttattgtagtatcacattgttaaattatagtgtaattaggctcaaaaaattcatctcgtaatttacatgcaaactatataattggttttttttccacatttaatgctctatgcatgtgtccaaacatttgatgtaatttttggccaaaatttttttaatctaaacaatgcctacattgtaattgcccatagataggccctgcacaaaaaccgagttatttcaccctgttagctgaaatgcagtgatcctgccacttggtcttgatgaaacaaacaagaacaatagtgaatgaacccagaagatcgagaatcattagaagacaaaaataaaaggaccacccatcatttctacgacccagcagatttgtcggattttacatcatcttgcaagttgcagttggaccactaaccgactaacacaagcagtgttttctgcacgatctgcaccgatttccccttccctgagccagccagtcactgatagatgactcccactctcctattgcttcacacgttagtgtttataatggttattagtaatgatagaggatgtaaaccttatttcgtgcgaattctcgaacgagctctacgcattcacggagcaccaccgccacctcatccgtgacaagtgttactctggtgactggaagcagcaattgagcgtcagataagtagatgtgcctgctgtaagagagaaacattagtaacattgaaccacaaattccttgatcaatagttttctgatcatatctgaagctctccgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16537 - DNA, 540 bp, Oryza sativa
tccgcgtcgtttgagaagcactcacttagttgtttttagaaaagggtccaaataaaaatcaattgcaaaaacaacagcctttccttgaagcctgcattaaacacctatttcccatggcttgctgagtactcccgtactcacccttgctctatataaataatcccccccccccagttgctgaagaagatgaagcggaaccggctgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgatattctgtcttcctgtgataccagcactgtttcctaggactggtatcgaataacaggttaatttggagcgtcacgggctagttccggtcaggactagttcggggcgtgacaagagatggtatcagagcataggcttgg

SEQ ID NO: 16538 - DNA, 20777 bp, Oryza sativa
  unsure (1)..(20777): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggatcattcaccgagacctgaaatcaaacaacatcctacttggggaggacatggaaccaaaaattgcagattttggattggcaaggctactagaagaaggtcatactaatactcggacaactagaattgttggaacattgtaagctcatgtgcataataaaaccttcactcatagagatattgaatgtgcaagcctaatgcttatcctctgcagcggttatatggcacctgagtacgcaatacacggaaatgtgtcaaccaagatcgatgttttaagttttggtgtgttggtccttgaaattgtaacagggagaaggaacctcaattctgacgatcatgatcgcgggaatctccttagtgatgtaagtgctcaataaggttgagcttgctcctgtacatatatacttttagtgcatttacatactgcaatattcatgatatcatacccgaaagtactctatatcaagttttagataacaaactaatttcaaatcgtctaacaggtctggaattgctggacaaaagggacggttacacaactaattgaccaatcacttgaagagcaattccgaagacaagcactgcgatgcattcatatcgggctgctgtgtgtccagtcagatcctgatgacaggcctcacatgtcatctgtcattttcatgttgagtagggaaaacatgaatcttcagccaccggcacaacctgcattcttctttgatggagactcaaactcatgttctcaaccctttgagcaacccgtgtataatcggcctaatgcaatctatgaagaggatatctccgtgaataggatgacagttactgacatataccccagataacccttccccctccccattcctaatcccccctttcccagtggcgcaattgtcaccattgtttgtcaacttcattgaaccatctgcgtatggtttgatctgcaccttagaaggcacatttaaatattctagttgttgtcattacattatattcttatatggccagttatcttatgttctttgcacactctgaactaatgttcctaaacatggcatatcatcaaacaccttgtctgcagtctgcagtaggtagagttctagatttgtagcatataaatgaacaactaaccatcgaaacaggtaatttggacacattaacaatataatgtatagcagtgtaaggccttgtttgggagagggagcaattattagaaatcgttgtttttccaacttttggcttagttaattttctaaagtatgtagtcgctggttctcatagtttgagcacagaatatggactatttaggcagctaagtgtatttgcattcccaaattttccattgcactctaggagtttgatggagtttattgtacattttattctgcattgtgtagaaaggaattttattcaacaagagcgaacggaatacacttaaaattcttaaccagaatctaaatacaatatcatccttattttctcagcacagtaatacggggctattcttcaatcccactttcattattgagcttctggtaagctaccttcggtcttcagtaaaatatgttcattgaagaagtcttgcttggtgggagtacgcagtttccaattcctatgaatgattgaacaaacgctaataagataacaattaacaacacgaaataaaagtatgcataagcgtgtgaactcactcggtgcctggttgacgatggaagcagcaccaccaaagtcacacgagccacttgccctgccggcagtctggtaatagtcattgaatgcataggtcgcatgcgccaccttggtgttaggatcaaagcaccgtccaccaggctggatggcactgcagtctgcgcagctactgcatgcatagtctagtgctgcctgtaaccgcatgtccccgacctctgcgttcgccacgcaccaactcgggttcgggtcacagatgcctaaatcccaacaaacaattcatatatagaacatgtaaaacataataagatggatatcacaatatgaattgaatgcacaattgcaaaagcttattgatcttaaaagatggccattgaatggaaactaacttggtgatggcttgtagacgatgtaagcagcaccggcaaagttgcacgcgctacttgccttgccattacgctggtagtagtcattgaatgcataagatgcatgtgcaaccatggtgtttggctcatagcacacttttccctgttggatagcactgcagtccgcgccgttactacacgcccagtccagtgctccctgtagccgtgcattcccaatagctgcatttgccacacaccagctctcctttgtgggacatgtaccaccaccatgaaagtcaacatcgtacaccttcgtcccatccggatagaacaggccgaagttgctctctatagatggcccacccttcttgttctcgttgaacaaagcgaatatgtacgcagaaacatcctccatattggaggccccgaacaagactcgcttggcaaggccattgttgtatgcttgagcgttagctttagttgccaccgagtccccatcagcattggcttctgtgacccctgagcggattctaccaccagaggggtggcctgattctgaaactctgatgggcacccgtcctcctgcttgggctaacgaggccctctcgttactaccagaaaccttgtttattgcatagtaaactgcatctagctcggcatcaaagagactgtaatatgtgacgccgctcaccggatcgaacacaccagcattgggacggaacgtggcgtactcgagggagattccggtagaaggatccgcatatgcaaagaatgggtagagatttaccataaagtacgagtcagtctgctgcaagaagtcgatcatggggctcatcaccgactgcgcgatgtcatcccggaaagcgcctgcggacggcgggaatgacacctcgactgagctgaacgtgatcggggtggacacccttatggcatcggcgaggcccagcctcgccagcgccgcgtgcacgttcctcatggccggcaccagctgctgggtcaggtgaggcgcctgatcgaacacctcgttccccacggccacgccgttgatcagcgtggccgggtagtagggcaccacgctgctctccacccacctctgtgcgtagctcggatcccagccggcggagcccagatcggtgttgggtagcgccaccatcaccttgatgccggtgttcgccagcgccctcagcaccgccgggtcggcgtcgaagatcctcaccatcgtgatgccgttcgccctgagaaggctcaccacggattgcgggtccatcagattgtccgcgtccctcccgtagcacacgcccaactcgcccgcatctgctgtgtgcaaattaagaacaaacaaacgacgtcgttgtgattgttaattacgaaagtgagattaattacctttcagccttaatttgtagtttgtacatctctgatcgagttaattacctgcatgggagagaaagagcaacggtaatgcggtggctaagagaacgcggaggaggtgatgagtgagcgccatctctagtcctgtttggcgccgtggcagactgaggatagtcgaattccactgtgtgactgtgtgagcagtaaatttataacgagcagtatatatggccgtcgtttaggagctagcgcgatacaaggaaaataatagtacctcccttccaaattagttgtcgctttaactttttacttgtaatactattcatcttatttaaaaaactagtgcaaatataaaaaatataagtcttacttaaaaagtactattgagcaagtcataaacaaaataaataataatttcatactttttttaataaaacgaatgatcaaaatgttacaaacaaaaactcacaacgataagtattttgggacgaaggtagtacaattttgatatacatgtgttgccacattttcacgtaaaataagttgaatttgtcattgttcgatcaatcatctatgttcgtgtatcccggcatatgctttgatatgccgccttcattgatttttctcggttgactatcttgtgccgcactgccgcctacgaccctgcgtctagcctgtctggttgcacgtgcaccacttgagattttcttcttgatgataagaatgccagagtactgggttttttttggtgaatatattaatgtatggttgtgagtttggttgcattttattaataacttcatcagtttcaatatataagtatatctaggatttcagttttgttcaataatataagcatttgtaccactatttacactacattttatcacataaattattttccattcaatatttttccccatcttaatcccaaccatcctcccacacctaagtctctaaccctctcttttttgttgagaggcaccaaaatcttttctcctcaattttaatctctgtgaaataatttagaaatacttatattttagactagaaagagtatagcatctagcgtatcatagtattagcattccaggtcacggatcccaatgcctgaaaatctaaagtcttgtgtgtaatgggcctcttttcatccaaggggatatttctagccgaacaaatattgattatggcccatcgaacagaaaatcccatgtataaggtgagtaatcttagagatatgttggcctgcattgagcggaataagttcacttaaggtcccttaacttgtcaacgaatgccgaatcggcggaggccggtgagaggggatggggtggggagggaggagcgtcaccggccaggcctcttcgcgcactggccaccgctgctgagcccgcgggtgtcacggtccgctagtgagcgcacgcaaagggggacgagcaatggtgggtgcgtgatggaaaggcggcagaggtagaggtagcggcgcttgttggtggcagtatcccggaagccgacctcgccttcctcaacctccacggtcacccgtcgccaccaccaccttcctccgccgtcacccacactgattcccgcctcccctcggcctccccgcaatcctcttagcacctcccgttggtctcccccccgcccctaacgccatcgtcatctgatttccgtcaccgggaaaggacgagcgcccggtgccacggtcctccactactccaccagcctcgtcggtgtgccgctcgctagcctcctccacatatgttgtcgtggatgcttgacttgccaattgggacaaggactggtgcggtgaacgtggttgtggctggcggggaaggaacacggcggtggctctcggccgctcctacgcccacaagctcgccgaggttgaacgcttccccgaatgcctccaccgacgctcagatcctttccgccggccgccactcctccccaatgccgccgaccgtcgctcttccccaacgcttgagactggcgcggatcttcttccaccctctctatctcttccctcaaattctccccactgctaccaccgacagcattccttggaaccacccgtgctccaaccccagcgccgctacagccaatgccacttcccagcgcccctattggggaaggattgcgaccttgcaccattcaacccctattggctccggaggaggtagggcctctaggggcctgccgccaacgccctgcggagcccatctccacagggagggccctgatcgaacgcctaggaagctgaccgagcctgaagagggcagtcggctccgagaagttcggagccaaccaaagggcctcggggatctcggagcccagtcaaggcccccggagccccagagccggttcaagggcctcggaggtccaggagccagctcaagtgttccggggctcttgccatggctccgggcccggagcctagggaggacaccgggaatgagtatggggtgccataaaagcgcactactcatctcccatccaccaccgatgttacggcacgactagcgatgtgaaggccgatgctagctattacccgagtaaaggctagcatcatgctagcgccataccgctccccttgatgggcaccgccaactctcggcctggtgaatggaccctcggaccattcgtcggcccacctctcagccacctcggggtagctacggagataggggtagggttgtaatttcctttacatacaacctagtataaatatgtaaatgttaccctcggaaggggggatagaagctagacagacacttattgcacacttgtgagttctgttccaacagccccctcctcttccgcccatagccagtggagccatgccccctcatgtcacccataggctatagctgccagagccgcgccctcgaagccaccctcccccctccccctacctaaccaggctgagatagagaaggagaaggggatgatatagagaaaaggggatgaggtggaggaagttggggcccactgacacgtgggtcccactatttttagtatgtattatttgactgacatgtgggcccatatattttattttatctttaaaattgttaaatttcacttcatatatgccatgtcatacgaagactaagtcaaattagccatgtaggcgtcacgtcaactaaaatcgccatctaaaccatcatgggacctatattacaccggttttaatagttaagagacccgctgtatttggttttttggttgaaggatgaaaatcgaattcattgacaaattaagtaacctcaaatgtacttattccttcattccgatgctccatgtaatgcacgtgggcttgtacaaaaattgtgcaaacttttcatgattcttacattgtccgtacagtagcacaatcctcctttcagagtgggagccactaatcagcagcgcaagaagttccatatcctggaccgatcgaagctctctctatgacaggttctacactgacgcggtcgactcgtcggacgcgacgccgggtttagcgccgccgttcctggcgaagaacgccggcttggagggcacctggagggagaccgtctcgctgtcgagcatcatcaccaccgacgacatcaccggccgatccgcggggttttcctgcacgcacaggagcgctacgtggacgcacttccgcacgtcgctcgccgagacgtacctgctcatggccgggtctaccatctcatccacggttccggccatccaacgctcccatatctgcatcatttttgtagtgcagcatcacacatagatcagccaaactgcactgtaatctgcagagtgcaggttatcagatgttcagagatatgaactactatgttgtatgttcaccgtgttcaggagatcttcagattggtgagagttgttgtagaagtcgttgttcttccttcccgtcacgatctccagcaccatgacgccgaagctgaacgcgtctgacttgacggagtagttgccacgcatcatgtactcaggtgccatgtacccactgcaacagcaaagataatttgaagtcatgattagtcactacttaattactggatgactgaacaactactacagtttatgttgttactaactatgtgtcgacgacacggttcgtgacagcctgggtctgatcttgaccgaaaattctcgcgaggccaaagtttgagatcttggggttcatgttcgcgtctagcaagatgttgctcgccttcagatcacggtggactaccttgagctgagagtcttcgtggaggtattgcaggcctcgagcgacgccgtttatgatcctgtacctcttttcccagtcaagcttctcgcgtttctcagtgtctgacaatgatcaaagagaaggtgttaattaatagatcaatgcgatgatatgacatcaatctttgcagagaaaacagaggagagaattggtaatgtagactcaattagtagtagtattgttaccaaagaggatcaggtcaaggctccggttaggaacgaactcgtagacaagcagcctctcgtgttgatccaggcagacgcctacaaagcttacgaggttcttgtgcctcagcttggcgaccagagcaagctcattcttcagctcttgaactccctgtgttgagctctttgacagcctcttcactgcgatttcgttgccgtctggaagaacaccctgtgaaaagattcaaaatatgctaattaaattagttttggtttgtaattcagagacttgttttttttttccctttttcagtaccttgtacaccgctccaaatccaccttcaccaagcttgttgctctctgcaaaatccccagttgcagctcgcagagtagaaatgtccatgagcatggagtctacgctgtcaacgtcatctgcttcagcgtaatagttggcatctgcataaacgtcagcatcacaacaattggataagttttttttttttgcattgtcagctgaaatgattaaaatggagaattttgtaggacgtacttgtctgctttgcttttgttattactggacgcttcctcctccagacacagaagcaaacgacaaggtttacggctgctattatagggagcagtattataagaaccaggcgcggaaccttgtactttgtctctgcgaattgaccaattcacaaatttccaaggttatcatgttaaaacatgtcgaattgtatggacagattccgtactactgtactgtactactccccttatttcatgctgcaagtcgtttaattttttcttagtcaaattcctttaaatttaacaaaatatataaaaaaaatatattaatattttcaatatagaacaaacatattactaaaatatattcaatgttaatgttgctaaatttttctacaaacgtgatcaaacctaaataatcattttagataatagaaatgacttacaacctacaagtactcagaaaaaaattaaatgacttaaaatatagctttttcttggaaataatttttgccgggttttcttggaaataataaacgtgtagttgactaattgtgcaataatgtcagtaatgccgcccgaaagtaatacacacttcgactcacctcgtcccggcgtggccgctgaaggcgtcgcgttgaccggcggcgccggagacggcgccgatgtcgccggtagccgcaccatcgtcgtgccattgaggaaaggcttggtctcgatccggaagctgcacctgacggagagggtcctccctccgatgtcgtccttgtacgaccaaagctcctgcgccacgatcttggcgaggcagctccggcacctcgccggcgacaggtccggcgtgcactgcgccaggctgtacaccttggggagcgccgcgtcgaagtcggcctcgccggccgcgtaccgccgcgtcgagttgtacgccgcgtagtcggcggtggcgttgacgagcgccgccacgaggcggttgtaccgcccctgctccgacgtgaccttgttctcgttgttcaccgtgtacgcgtcgatcctcgccgggtcttcgccgccggcgccgccggagaggaagttgatggcggagtagctgaccatgcaccggtcgtagtaggtggcggcctccctggagttgccgcacgcgttgggcaggtcggcgaaggcctgggtgaggcagccgaggcaggagctggcgctgacgtcgccgcggcagagcgcggcggcggtgacctgctccgggacggcgccaacgtccacggcggtggcgtagaggtccggcgacgacgaggcgttaccggggagcgtggcggcgatgagctggaggttggcgaagaacctgctcttgggcgtgaaggtgccgaagtcctgcccgcacaccggccatggctcgccggcagcgcggggcgcgagcagcgcgacggcgacggcgacggacaggatgagacggcgatccatcggggtatttccggcgtgcgcaaagaggagctcaatccatgttcgttcccacggggatggactatagtagtgagtaatctccgtccaacacggcagagagacagagacgaccatacaagtcgtccctgattcttgaaccaactttgtcgcttaacaatggatacgattgcatccagctagtcgagatatagaaaatccatgtctccttgcacacactagtacaaccaagataccggtttagcagtgaatttgaatatagcgtagggagtatctctgctcaaagtttttgaattgagcaaattttatagtttttaagaggtgccatgagatacccaaacttttaagtacaaatttagtatctagtcgtaccagagataccaaattttgggtcttccgaatggacgcgtgagttctagctgcctaactggtgcagccgcgcatgccccctatctcgcctctcctcagcgctaacaacgctgattagtgttgatgtcattaattagcgatactgataattgttagtattagttttttatttaactctgatttggaaaacttttaaccagatttgaaactttcaacccagatttgaaaactttcaattcagataaaaaaatttcgacccagatttgaaaactttcaattcagatttaaaaactttcaacttagatttgaaaactttcaagtcaagattttttaaaaacttttaactcagataatgaaaaaattcaagtcaagatttgaacaccttcaatttatttttttcaaaaaaaacaacttagattttgaaactttcaaatctagatttgaaaaaattcaagtcaagatttgaaaactttcaactcggatttaaaaacttttaactaaagatttgaaaattttcaattcaaatttaaaaccttttgtctaaaaattcaaaacatttaactcaaatttgaaaactttcatatctaaattaaaaaaaattcaactcaattttttacctttaataatttttaactcaaattcaaaattttcaactaaaattgaagatgaaagatttcaacttctaaaattaaaaaatcacgaaaaaggaaaaaataaaaaaaaagcggacgttagattttttatgggaaaaatatacggatgtggacactgtccgcacgcatacgcgccagcgctaggccttataggcctgaaacgcgcgccgccaacgcgcaagcgcgaattagctatcgcgccaaattttatattagaaaacgagatttgctccggtccaacaaaaagtatctcgagatgccggtacctcactgtaccaaattatttccgatcgttggatctaactggacaggatggatattgttagatccaacgatcagaaacgatttggtatcacgaggtatcggtacctcgagatactttctgttagaccggagcaaatcttttagaaaacatagtgtctcccgatactttcataaaaactgtataatcactcttttgaatttgtttgaaattagcaattaattgttgaaatcagggaaaacgtattcaaatttcaaggtgaacacgcttcattcgggccaccaactgaccaacctcctctatcatcgattcatcgtagcggaaagaagtgacagtagtgcgcaggcggctatggaaaaggaggcgatggagtcgcaaaagccaaagaccaaagactagtcgatgacttcaccggccttgggattcacaggcttccagttgcaacttgcatggcagcgataatcacgcccaatgtgcaatgcaattcgcaataatccaagtattgcaacttgtaatcaagtggcaatgttgcatcgcatcagtagcgaattaattatccacaaatttgcaaactttgcaagtttgtaggcgactggccaagtggccaggcatgctaattggactcgtcaaggtattcggctcaccagtggtcatccaagaccgtgacatgaatgggcatatggccatgaaaaagaaaagaaaaatcaagctccaaacttaccactagcaaattagcaatatggagctatatggagtctgtttagcatagctctaactctaactttaacttttctgaaattgaagcccagtcaaacagtttcacctccattcaaaaataagagtggagtcagctgaagcgcttttacaaaacgaactagacgggtgaagccggcttcatcctgtttcacaactccacttcagaatcaatttttagagttacatttagttgttgtagccctatcgaacaagtccatagaggataaaaatggattgcttccatttattcagttttaagaaaggattttaaacatatgctcaaagctcgtgttttacattcgtttgagaattccagggcaacatatatataattattttacagttgactaaaaataattcgaattttcagtacaaaattatagtagaaaaaagtatatgataaataataaaacaagcaaaaaactacacttcacaatttatttgaaatcccatgatgacttttatgatccaaactagctagaaaaaaatgaatgtttatactaaaaattctttcagaactatttgccgggcgaatcacatgttaatgactagatttagctaaaccagatcaatcacagttatagccgtgttgcccacaggatggaggagaggaagctgattctctacccaaaaagaatgcaggttctgctggtggttgaagcttcatattttccttggtcaacatgaaaataatagatgacatgtgtggcctgtcatcggggtctggctggacacaaagtagtccaatgtggatgcatcgtaatgcttggctttcagagtacccattgagcgactggtaaatcatttttgtagcagtcccttttgtccagcaattccaaacctgttaggcatgttgacaaacttaagagattattactttcacgtaaaaatcatcaatatagcagtgttcacaatacactaaaagtagaaccatattggtgtgagctaaggttattaagcacttacatcactaacgagatcatgatcgtcagaatgccagttccttctcctcgtgataatttcgaggaccagcacaccaaagctaaaaatgtcgatcttggttgacacatttccatctattgcgtactctggtgccatataaccactgcagagggtaagcattacacttggaaacgtacatccaattaatatgtgctattaatgaaggtattattatacttatgagcttacaatgttccaacaactctagttgtcttagaatgagtatgaccttcgcctagcagccttgctaatccaaagtccgcaatctttggttccatatcatctccaactagaatgttgtttgattttagatcccggtgaatgatcctcaagcttgaatcctcgtgaagatacaatattcctttggcaattcccagaatgatgttgtactgttgatcccagtttagggcattccctctactgggatctattgggacaaatcttcaacttaatcataattacccacattcaatagaattcagaaagtggcaaagtgcaaattctggtcttagttatgtgatttgtttgctggaaatgctacagaacatatttagtgatactgaggatatttacttattgagtatatatgtttgtcatttgtgaacagatgaatgagaaggcaaaattaccaaatagaaagttgtccaggctcctgttcttgaggtattcgtaaacaagcagagtctgctcctgatgcaagcaaaatccctgtagcctaacaaggttcttgtgctgaagctcagccaacaacttgatctcattgtatagctggtccaatccatgaccagttcctaaaagtttcttcactgctacttcttgtccatctgagagcactccctgaacatattgtttttcacagggagcaagcaatataatccatcttttggaaagtaatgcacaatccatttgaaaattttctctttgtatttttgcgtgctaacttaccttgtatacagcaccaaaaccaccctcgccaagcttattattcggcgagaaattctcggttgcctcttgcagtgcagaaagatcaaaaatcatgcattgtgctctcgttattttcttcaatgctgttgccatatgacaagaattatgtgagggaacagtacatttttcagctactgaacggagattatatatgctactcacggtggacagcgtctgtaaccttggtcctcctcctgaagcgaacaaatgcgaaaactgaaagtatcaacaataccacaaccgacgaagcgacgccagcagcgattcctgctgtactaattttcttccctgcacacaccaaaacatggatttcaatttgcaaaaccttgatttcattgttaagtaggaaaaatgaagaacagcaggtcatacctgacccaggctctggagaaagaacaggagcttcggctgttggtggtggcgccgagacctgcagcatcgcccggcctcggtagaatggctgcacactatacatcagtctgcaccacaccgaattgacacgaacccagctaaggcttttgccgaggtacgcttgttttgcatagaagaggaggtccttaaggcaatcgttgcactgcgcgggcgtcaggtccggcacgcactgcgcgaacccgtagatgttggggtcgaactcctcctcacccgtcacgaaatacttcttggtggtcgagttccccgtcgtcgaggtcacggcgtggtcgaccatggcggcgaggatcttcgtgacggcggcgttgaaccagccaaccgccggcacatcgacgctcgccgaggcttgctcgggataccaactgttcgtcacgagctattagtttatctgatttttgcgagaaaagaatggaaggatggattgtgcgtacatcatctgtgagacctgccactgatccggactgaggaaatccatgaacctatagcgggagaagcgagctacgcaagcgtcctcgtacatggcgacgccgctgtttccaggacaatctttcttcccgtcgacgaacgctgccgcgacgcacgcgctgcaagcggaggcgttcacgtcgccgcggcatagcgccatcgcaaagaccttgtcgggatccgcgccgacggtggcgacagcgaagccggccggagccacggagacattgggggagagcgccgcggcgaggacgttcaggttcgcctcgaaagtgctgttggccacgtacgtgttgccgactccttcgtcgcagtcagcgatcccagccggcgtggccgacggcggcaagaggacgaggacaacggcgacgatgccatagccgacgtgcatcgccgcagcagagaggggagatgctcacacaaaagatgtggacttgcgccaggcaacggatctgctctgctcgcccactcggtgcgacgcatcattaggcacgttgtgctgagtttgagcgcgcaattggagtcaaaaatggctgccgcatgcacaatttcttgatttttttttccagcgttcaacatttgccagtgttctaagtcgaacataatgcgtggaataaagcaacagcttgtatcgccagcggcacgttcttgtcacactctttgactactgagacatgatcctctactcccagtatattaaaagaaagatatctgctccggtccaataaacaatggatctcctcgtatacctttttcttccaaattcgatgcaaatagttgtgaaaaaatctgaaaaaaattgacaatgtagagtataatgatacctactagtccaccaaaattcatgttcaaattcgatctacaaatcgagaaacaaaaaagacaaatttagatataaacagtacgctactattcatacgctgaatttgtcttttttatatctcgacgtgtgagttgagtttggtcttaagattttgtgaagttttatatatgtgttgtatgaatgttgtcaaatttttccagaatttttcataaccgtttagatggtttttgagcaaacgagggaacatcccctcgagggattagaatagtttcccctgacaatgtctatcctgtccaatctaacgatttggtaccgtgagataccgatacttcaagatactttttactggaccgaagcaaatctctaatagaaattaatctagtaacttattttccagatggagggaatactttcatctcatcctcttatgcatgtactgcatggaaaatcaagttgacagaccaagtctgcttggggagtttaagattttaagaaacagctggtaagaagctagctagtgagaatctggagaagcaagaaaacatatctagagaagctaggaaacatagcttctgacttctattttattttctgaattctacaactacggattctcagaatctgggtgaaaatataaactgtttgagggagtttctagcagctggagattctacgagaagctgcagttgccagaagctcccctaaataggcatgttctaaactaggattggcttagctatttcctcgattttcattagcattttttcatctgctgcgaaaactttcttttatagaagttgctttgaaaaaaaatcaaataaattagtttgcttaaattttaataatcaatatttagtttggctaaaggattggcttggctatttcctcgtttccaatgccattcctctagacccgatgatctcccccgacccttttctcctagacataaacctttattgaacgagcaattttacggtctttgagaaggtaccatgaagtaccactttttctattgtaaatttggtacctcttagtacctaggtactatgaggtatcaaaggtactatgagatattaaattttacactaaatttttgatacctgatggtacctcttcaagaaccgtagaattgtttctgttgacgactctgaatccgatttcataataggctgtgtttagttctcctccaactacccctaacttccaactttccattacatcacatcacatccaaaactttctaacacacataaagcttccaacttttcccaaacttttaactttttttagtaactaaacacagcgatagtttctctggaattcaaaaagtaattaatgtgattgatggttttgtcgtcgccgcctttcagacctcaccccgcgcgcgcgtgcgcacttacgggctacgtacggcggccgatggtgccaactgaacggtgcaaatggaaaacacaccatctccaagcaccaagctagccatcgtaatgcgaataccttcatggtttacgcacaaaccggtccaacccgtcaaccaaaccatcccgatcccctttttgcggctgtacagttgtacgtggggaggccatatgtgtggatcctgtgcataatcaccccgttgaatccacccccttcgtttctcgaaagaaatttgaaaatatactttattttttcatatattgcatttatatacctggctgtgactaatttacaagaatagacccaatccacggaacggttgcgcgggagcgaggacgagcagccggtcccgcaggccggggatgcggtaccacgccggtcccgcgggcgtggtgagcgcggcaacgctcccgcatgccagatgtgtgggaccggcgctcccacatgccgcccccatctcggtttcccgaattggatccgatatcctctgcacgaaaaacggagcagactattaacatataattaattaagtattagttattttttttttcaaaaatgaattaatatgatttttttaaacaactttcgtatagaaactttttataaaaaatacaccgtttaggagtttgaaaagcgtgcgcgcggatgagttggaaaaattaggggaagaacacatctctaagaacacgcgacctgttcggttccgcgcgttggaaccgcgcgacagcgtcggtcccgcgccgccattctgcggcaccgccgcgttcactcatcctaccatgggctccatggctcccgtgcatcggctccgcggtaccgactcggtcccgcaggccagttgtgcgggaccggctcggtcgcgcatctcggttccgcgcgaccggctcgggttccgctcccgcatccccagtctgcggttcgtcctcgctcccgcgcatccgttcagcggattgggtatatttttgtaaattaatcgcagccaggtatataaatgcaaaatatgaaaaaataaagtatattttcaaatttctttcttcgtttctctccctcttccttcacggctgcgcgtgacgtgcggcgtatagtacgagtctccgccgttagaggccgtgattcccattccccgcacgcgccgccacgcgacgagtccactcgtggcccgcgcgcgtccctgtcaccccctgtgcgctcgacgagccgcatccataacccgtcggttcaatctgatggaggccggcgtcccgcgcacttgcgttttcccgcaaacgcgatcgctctgttcgtttgctccagtatggctgcgttgctgctcctatgctctgcttctctctcgtgtacagaggagcaaagcggtaaacggtctaatccgtgaagtcagtggtacgtctacggccgtcgactccaataagcaccgaatagtgagtaaacaacaatcttagctgcgagaaacagccaacgacttgaatggtcggacgaccaaaagtttactctcattaacaaaaccgagctcgatacaagtacaagtgtacagaccacccgttcatccgttccaccgtgcagtcacgatggcggctagccgtgtcgccctgtccgtgccagtcgccgccgccgtcgcgctgctgctgctcgcgctcccccgcgccgcggtgtcgtacccgtgggggttgtgcaacgacacggccggcgaattcccggcgaggaggagcagctaccttgccagtatcaacctcatcgccgccaccctccccggcaacgcctcggcctcgccggacctgttcgccaccgccgagggcgtcggcgcgccgccggaccaggtctccgccctcgcgctctgccgcggcgacgccaacgcctccacctgcctcgcctgcctcacccaggccttcctcgacctccccaacgcctgcgcctaccacaaggtcgccgccatcttctacgactcctgcctgctcgcctactccaacgccaccatcgccgccggcgacttctcctccgagaagatcccgatttacgggttctacagcaacgcgaacgccacgacggagcaggcacggttcaaccgcctcgtggcagcgctggtgaacgccaccgccgactacgcggcgcgcaactccacgcggcggcggtacgcgtccggggaggccgacttcaacgcggagttccccaaggtgtacagctgggcgcagtgcactccggacctgacgccggcgagctgccggagttgcctcgcgcagatcatagggacatatattgggttttttgagaacagggtcggaggattcgtccgcgcggtctggtgcagcttccagtacagtaccacgccctttctcgacggaccgatgcttgtaaggttacaaggaacgtcaggtgcctcgccggcgccgtcgccggcggccgtggtgcccgcagttaaccagacgccgccggcggcgacgccgacgcttgaaggaggtgagtcaaagcgccttggccttaaatggtacttactccattttatattacaagttgctttcactttttttctagaaaaacttagtaatgtctacaactctaaattagtttgattaaatctaacatgaatatattttgatgatatgtttgttttgtgttaaaaatattattattttttccgtataaacttaatcaaactttaaaaatttcaatagaaaaaatcaaaataacttataaaattaaacggagagagtagattataattgagttacttttcttgaaaaatttagattaaggccctgtttgtttcagtttaagattattgtaatctaaattattgagtcagatattataagctggattataataagcagacatagaataagttgatagctgtttatttctctggattattagctggttgttaggtggtagccatctaataatctaaaaaaagcacctttaaagtagattactagattatagattgtaataatctatcataataagttatctgtttaataattcaaattataataatcttaagctgaaacaaacattgcctaaatataattttgtgacactacttagcctgacattttacttctaaaaaaaaataatccagggaggaagtacagcgtccctggattggttcttataattctgctgcctacaatagcagcaataaacgttgtggttggcctctgtttctggaggaggaggaggcgaccagtaacagaagcaaagcgaacatgtatgttctgcaaaattctccagtttactatacacttcaagcgaccttagatgaacaatagcttatccatttttttttttgtctttggtagatgccaattactccactgaagcagaggacattgagaatttagattcgatgctcatcgacatctccattttgcgatctgcaactgggg

SEQ ID NO: 16539 - DNA, 12480 bp, Oryza sativa
ctcattattaagcttactgttttgtttcatgttcatagggtgtgctcccggacggctacgagatagcagtgaagagactgtcgaagagctcaacgcaaggggtggaagaactgaagaacgagctggctctggttgcgaagctgaagcacaagaaccttgtcagcctcgtcggcgtctgcttggagcaacaggagcggctgctcgtatacgagtttgttccaaaccggagcctcgacctgatccttttcggtacaaactaagccatgtttaacctcagttttcctctgtttcttatgcaaagattggtaccatccattaacctgatcttttctgtgtgatcaatgtcagatactgagaaaagtgagcagctggactgggagaagaggtacaagatcataaacgggatcgctagaggtctgcaatacctccacgaagattctcagctcaaggtagtccaccgcgatctcaaggcgagcaacatcttgctagacgtgaatatgaaccccaagatttcagactttggcctcgcgagaattttcggtcgagatcagacccaggctgtcaccaagaatgtcatcggcacatagtaagtctatctaaactagcacatataatataattcatatttctagctatcatctagtagcaatttgctgactgtaaaattaccgtgctgttccagtggatacatggctcctgagtacctgacacgtgggaactactctgtcaagtcagacgtattcagcttcggcgtcatggtccttgaaatcgtgacaggtaggaagaacaaccacagctacaactcccaacaatctgaagatctcttgaccatggtgagttatctgaatatcttatcaccatcatccttgatccttctcgagagaagcacatcgagttgcattttgactcatgggttttactgcaaaaatggtgcagatctgggagcaatgggtggccgggacggtgctggagatggtcgatccgagcatgaacagcttcttctcggagagcgacgtgatgagatgcatccacattgggctcctctgcgtgcagggtgacccggcgaaccggccggtgatgtcgtcggtggtgctgatgctcggcacggacaccgtcgaactccatgcccccgcgaagccgacgctcttcgccaggaaaggcggcggcgacgaatccggcgtcgcgtccggcggcatgtcaatcgtgtcattggaggagcagtcgtagagacggtagtccagtgttgcttattatcagagcggtagagccagaggcctgaagaggccagtgcagaatcctacgagagaagattgtgctacactgtgctaccgtacccatgtgtagcggcaatttagaaatggctgccagatcttcatcggagtgatcatgaaaagatcaagcgataatgaaattgtgtcaaattacgatcaatatgagagtaaactttagatctttttcaactgatggcgaaatgataaacgaaattgtgtcttttcgctttaactgaaactacatctacttattacataagttattggctaaaaaaaccaagtacgacataatgaaagaaaaatgatgatgagcatatgacataacgacaccaataaaaggaaataattaacttattcaaagtttaagtctattgctaaatcttcatctaaaattgagacgattgactctaaattttggaatgcagcgggtaaaacttccgtgttctcgtcacacatttatagttggcccacaacagacggtaaattaattccagaagtttaaattgaagcaagcaaaaactttgagcttattcatattaaacttgcaatcttctatgttatacaagtttacactacacctacacttggatattttttaagacaatactacatacattttgctagtgtgtagttgagttcttatagaaagtcaagcccattggtttcttttggttttgcgcaagcgggttgtgggcattatctccttatcctggctccatggaagatgtgattggagcttcttccggtgttagcttccagtggcttcgtctttcatgctggtgactaaggagtactccagatccacttgtgaggaggtcgtgccgatcgtcatctacatctccggtgagtaaagttgtaagattagttaggttgcgcctgttgccattctttttttcgaacggtcaggccgttgccaacgttttatattaagaagatatcctattttaaggagaaaacatgatcaaaccttacagtgctcttacagtgctcagttaattagggaaaattgagcgaaaaccacaactacaacaccacaccaacagctaacctatcctaagttaccatgacagagttcgacacacggcatcaaacaagcttgccatttgagatgacactgcagcctacacatgttatcgttgccaagcttgccacccaagcgacacaacagcttcaacttcattgcgatgctaccccaacggcaaaataaacaaacagaaacgacatccacgaaggacatcatcccaagctaccaaggaaccactcctacacacagctagcatcaacaatccaataaagaaattgcaatgtgtcatcgttgccaagctttgtcgccccagcaaagcagctccgactctacccacaacagtaaccagataagagtgatgaacacccaatgtagcaaggaacgaagccaaggtagtgaaggcctcgtcaaacaccctaggctggaagagcttcggagacattgcaggagtccaccaaaagctaccgttgtgcgcagagggttcttggtgttatgaggggtcaatgccaggacgacgcctccaaggaggggaacggcgccaaatggcgtcaccgtcgtcatgccagcccatggccatggcaaggctttcgccagtgatcccctatcaaaaccccacacaaccatcctgcacaacgacaatcaccggaccaccacgccatcccttcaacgcccaagctcagtctaccaccccgcaggtcaagctggcaatagagaggacaaattcttcactgcctaaccgcttcctgcgtgctgccgtaagccactgaggtcaccattggcggccagccaccaccgctgacaacccggtcaccaccactggcttcctcctcgtgcagcacctccaccgcctcacgccgcctgccatcgggccatggctgcgtgtgcggccaacaccacctcgcactggccgccggcctcgccttcctcctacgtgccatcccaagcaccgccgggcgggggcacgaggcagagcaggagccggcgccgtcgccgcagcggccccaacccacgccgaccggggcacacgcatcgcacctttcaccgcccgattcacctccgtcgcgccgcccaccgcgccggtcgaatgtgctggttggccgggaggccagatccggccacagaggcaccggatccaccgccccaagctgaactgcagtctccacctccggccgtgccatcgtcggccttctccgtcctcctcgcgctggggtcagttcttccgagctgtttgggcctcgccgccgccttcctggctcgccgccggccagctccggcagcagtgaggtggaggaggggaatgagggtgtggcggcgtggcggctagggttttgcccccgagccgcccgcacgagagagacgcggggacactttgaccgtgtactttaacttgaaactggatatcgcttgttgccatccttatctctagcaagtaaattttgcaaggttttagtccatcgttgtgaaccttcaacaataggagaagttgtgggagaatgccagcgataggtcaaccgtcgggggggagcaaaaatcggacgctcccctcccccacatgcgcgtgatacgtgacgcctgggccctaccacggtctctgaccccacctgtcacgtgtctgcaccaaaaatatttcaccttgtttactcacaatatttcactatgtatagatctaatgttgctgtgaattaaaacattcttttgcaacaaatcacccacatattttggaaactctctattaagggaattcgtttcattttttgtttcacaaaaaatgtttcacctagtgtactcacaatgtacatagatctaatgttgcaatgaattgaaacattcttttgcaacaaatcactcacatattttggaaaccctctatgaagggaattcgtttcattttttggtctaccaaaaatgtttcacttagtgtatttataatgtttcactatgtatggatcaaatgttgcagtgaattgaaacattcttttgctatttgctgaaacattgtttttatataaggtgaaacaacacccgatttaaacgattgaaacatttccgatctacttagtgaaacaattccgatatacctagtggaacatcgtgcaacatttaaaaataattcaataataagctaaatgttttttttgttggaatatatctatgtgtggtcttgttttgaagatttaactgcaacgaatctaatgatgcaatcggatcatgatttggataaataatttaagagaataaatagtttaaagtgtttttacacgtatgcgtcgtgctgatgtcagcgcctgatttccccaaatcatcgggtgattttcccaaatcatcgggtgtccgattctaaggtggtgtttagatctagggacttaactttagtctctatatttaaacactaatttagagtaataaatatagactacttacaaaactaattatataaatgaaagctaatttgcgagacaaattttttaagcctaattaatccataattagagaatgtttactgtagcatcacatagtctaatcatggattaattaggctcaatagattcgtctcgcgaattagtccaagattatagatatgttttattaatagtctacgtttaatatttataattaattttcaaacatctaatgtgatagggacttaaaagttttagtcccatccaaatagggtctaagtttcttccttcgctgtgttctgtccgatttaccatggatgcctcaacttccattcagtggagacctcgttcgggttttctccttggctctaccttcaataggttgccatgaatttgtcgtctccaccgccgtcgatgtagtcgcatcggctgtctagtggatgaagtagataaaggacttgattgctaattccttttagcatattttgtctatgcccagctttgatgaggggtttctccgtaaaactggatgcgctcccagtttgttgtcatcaatctattaattaatttattaatttgcccatcttttagctcacttgctttcttctgtgttttttcaataatgtgtcgtggtcagtaccggcggctgcaggaaaggtaaccattaattatgatttggcaaggtcatatgcatgcatgcgtgctgacctgccacacgggtgttgcttatcctgtgactcgttaatgacaaggacgtgccccaaatggctttgcaaattattgctttccttttcgccactacgcgagtacgccagggtaaaaaaacatacgtaggcagtgttccttacattaggttggaactaatctttcaaacacgtgaaacgggacagtgaattaacgtacaattagttaagtattagtttagaaaactttaaaaaatagttaatataatttttgaaagcaaattttctattgaaattattttctactttctccgtttcataatgtaagtcattctagcactttttattttccacataaatattttttattgaaattattgatgttaatggatttagatataaatgttagaatgtctcagattgtgaaacggaggagagagtagaagacataccgtttggtggttcaggaaatgggtgcgctaaaatgagagagcagaggttggaagacagaacaaacaacatagccgtagtgtgatttgcagtatggtggacaagatttcagtactactaagtaaactgtgcagccggccagtcatgtttgactccaatttcgagctcaaacctgacggaatctgccatttgacaagcgatgtgttgcaattcgcacagagttgacagttgatggcgcaaggctgctcacatgaggccattttttatttttttgggcgtaaataatgccgttagttgagggaaagaatcactacccgcatcttctgccacgatgctcgccgccggctatggcgtcctcgccgtcgccgccgccgtcgtcctcacgctgccctcggccgtgcgtgccgcgccctcgaacatctgcgacatgggcgtcgcgacgtacgctgccaacagcacgttcgaggcgaacctggaccgcctcggcgcggagctccccgccaacgtctccgcggcgcgcgccaccggcggctacgcggtcgccaccgtcggcgcggcgcccgacctggtctacgcgctcgcgctctgccgcggcgacgtgaacgcctcggcctgcggcgcgtgcgtcgcggcggcgttcgccgacgggaagcggagctgccccgggatcaagggcgccaccgtctccgggcccggggacggctgcgtgctccgctactccggccagagcttcatgaatttcctcagcaccgagcaatggcaggtctcagagatactgtacggacaccatctatatcccattcccaccattgtttcttccaagcatattatcattggtagaattaatcactaatcagagaaactaatcactactagctcgttacaaacagttggtatcccgaccatgccacggacagcatcaaggtgccggacgttggctggttcaacgccgccgtcgcgaagatcctcgccgccctggtcgagcacacttgggccacgacgacgagcaacgcgaccgccaagaagtatttctccacgggtgaggaggaattcaaccccaagatctacggattcgtgcagtgcgtgccggacttgtcgccggagcagtgcaaggaatgcgttaggacgctccacgatcaggcgaaaatccactacatgggcaacagccttccgtgggctagtacttattcggtgtggtgcagtctgatgtatagcgttcggccgttcttcggtggccgggcgatgctgcagctctcgccgccgctgccgccggcggtcgatactccggttggtactcatgagcctggagcaggttcgactttatacttcgggttttttttttttttagagttccaacttctaaatttagctttagaagttaggtttagagtagagttgtggagcggtctaaacttagttttacctctctattttactttgtgagaacattccacccagctcccctcctattttaggtggagctgacacagccaaacaggcccttcttgtttttccatgaaaattatttgtcctaattcattgaagttcatgatttggtttctgcagggaagaaaaagagcgtagcaggactcgctgcaggcctcgcttgttcagttggggtactcttgatcctttcagttcttgtgttcgttcgtttcaggagaaggaccaaggctgccgagactgaccaccgtgagtagcattagcatatagtctctgttcagtagctgaaatttgctgttacctgatatgatcttgtcaaatgtcaacagctttaaagaagataacgagagcacagtgcatgatttttgatctgcctacactgcaagaggcgaccgagaacttctcggagaacaataagcttggtgagggtggttttggtactgtatacaaggtaagttagcttgtaaaattacaagacaacagtttgaaatgtactgtgaactagtaatctgtagagtatttgtctgaaaatcaatgtgttcagggagtactctcagatggacaagaagttgcagtgaagaaacttttaggaacaactgggcatggattggatcaactacataacgaggtcctgctattggcagagcttcagcacaagaaccttgttaggctacagggattttgcttgcatcaagagcagacactgctggtttacgaatacatcaagaacgggagcctggacaacattctattcggtaattttccttcccaatcaacgcttcagaaacacaccgataactctgatttttgaatagaatttttcagaaacattctgttcggtaattgtcttgggaaacattctagtatttggtaattttacttcatgccaagtatgtaaaacaaaaaatagaataaattgagcaatgcacatcttcaaattagtgtgaagtactgaatatgtactgtactgtactgtaccatttctggcaaacaagttaaaaagctaagaacaagatgtgcatccacttccttaactctactatagatgcgcgattatgattaagttgcgctattttgtccttatagataccaccaaaggaaattcactcaattgggagcaacagtacaacatcattcttggaattgctaagggtatactgtatcttcacgaggattcaagcttgaggatcattcaccgtgatctgaaatcaaataacattctacttggtgaggacatggaaccaaaaattgcagattttggattggcaaggctgctaggagaaggtcatactcattctaggacaaccagagttgttggaacattgtaagctcgtgcattataaagccttcattgatggtaaatattgatatatctatgtttccaagcctaatggttatatatattttttttgcagcggttatatggcacccgagtacgtagcagacggaaatgtgtcaaccaagatagacatttttagctttggtgtgttggtccttgaaattgtgatgaggagaaggaactccgattctggtgatcatgataatgtgaatctcctgactgatgtaagtgcttaacaatactgacctttctccggtatgcatttgtatacaatgtttaagtttcagaccggtaatcggtctatttcatataacaaactaacatcaacgtgtctaataggtctggaatagctggacaaaagggacaatttcacaattcattgaccaatcgcttgatgggtactctcgaagccaagccatgcgatgcatccacattgggctattgtgtgtccagccggaccctggtgagaggcctcatatatcatctgtcattttcatgttaaccagggaaaacatggagcttcagccaccagcacaacctgcattcttctttgggacagaatcggcttcctcttctacatcatgtgggcaacgcagctatgtgtatgaccgctatggttttgctagcgtttctgtaaatgatgttacactcaccgagccatatcctagatgactggtcttactaggaggtcacaatgcgaatgggtaaaagtcagagtaccgtactgtgtccatacacacgtcttaactttgtccaaggaatctaatattgtcgcgaaaaggtggggataatctccagttgctcggagcgtaacactaatgagtgggccctgtagacatcttcccccgccttgtcactaaccacgagacacgtgtctgggtaaaagacagtggaacgacatccagctacgctcaaccccgtcagctcctccagtgggcccagtaaagtcctgtaaaggccccaccggcggtcagcatgcaatgggattaaccatacctaattcctgtttgtatgccccctcctacaagagggatggcaaccagaggcggagttaggattatgtgaagagtagggcctaatcattagagtatgaacttcttgaacgaattttaataggaaaattagtaaattccttggtattttttttgccaggtgtggggcccaagcccaagctgccccacacctggctccgcccctgatggcaactatgtattccccccagactataaggggagggctaaagccattgtaaacggggatcacattctgaaaatctactaagttcagaaactctcatcatctctagaatagataaacccaattctttataaacattgcaacaagggatctagacaaacacataggagtagggtgttacggttctgagtggcccaaacctgtataagcccctcgactcttgattgattcccaaactcttttgtaaacattgcagtaatggatctagtcaaacccacaggagtagggtattactcttccgagcggctagagcctgtataaacccctggactcttgtttgattctcgcgttcctaacctcagatccacacactagcactttgtccgaatcacaaaggagtgcctttcctccccgccagaggagctcgggctccgacaagtatgatacaaccttgatcaaataaagagccattagtttggttcttaaacctaagtggattggaacaaccatatcgattaataaacattagcaaaccaaatattgggagaatgaaaaaaaggtaagagagaaggcattgagagagtagagagctaccaataagaccaagtgtatatgcgaaaggggttgtactctaggcattagttacggtgctcaagtagcacctccaactctccaagggagcgaattccaatcttaaataaaagaaaaaaaatattatggggtttccctcgctgtttccaataaaaagaaaaagaccaatgtgttatcatctagaatgatgtttccattatactcagtttaaataatatgtagtccgttgcatgaatgataattattgtcaataatgaatttcaggcttaaataaaagaaaacaaatattgtggggtctccctcgccttttccggtaaaaaaaagagaccaatccgttagcatcttgaaagagtacctcagcactagtgccgcaaccgttgaatattctctagaatggcacaattgcttacctgtatcggtgactgactgagtgtgcataagggaaaatgatgataaccacagcacatcggcctcggccacaataggttgtgctgatcaagcgaaatgggtagctccaaaatgaaaagcaaatcctatcaaatgcatgggccatttattccatgatagaacttgatgaattatttttaatgtaattcctcaaaatgttattgaaagatattggaaggtagtaaggtggtgtttacatccagggacttaacttaagtccctgtctttagacactaatttagactattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgagttttattaatagtctacatttaatatttataattaattttcaaacatccgatatgatagggacttaaaagttttagtcccatctaaacagggcctaaggtaacaaattttacataataaattttggtgtctctttatgactcttaatgaacgtaaaccacccatacagatctgatgcatgaaaatgccttggatacatgagtgcgggtgaattacatgtttctcatatgccgaaggagtttgatgtacaatatgtctctggaatgtgtatttgcggtatttccttcaacaggggtgaactatttatttaaaattccctacatgaaataaaattaatgttacccttatttttctttgcagaataatgtggactacaggagttattctttgattcatcctcattgcccagctgcttccggtttattacagtttgttctgttcaagtgttgtttggtgggagcaagcagtttccaatctatgtaaactattgaacaaacaccaataaggtaaccatttaccatttgagacaaaagattgcaatttttcttagagaaattctatattattagaggtgggagacattaattaaatatactaaatttgaaatgagcatggactcacttggttgctatttgacaatagtagcggtgtgtcacggcccgaactagacccgaccggaactagcccgtgacgctccaaattaacctgttattcgataccagtcccaggaaacagtgctggtatcacagggagacagaatattacagcaacagaggtatctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctagaagaactcctcatcagccggttccgcttcatcttcttcagcaactgggggggattatttatatagagcaagggtgagtacgggagtactcagcaagccatgggaaataggtgtttaatgcaggcttcaaggaaaggctgttgtttttgcaattgatttttatttggacccttttctaaaaacaactaagtgagtgcttctcaaacgacgcggatgagacagtgcgtctcgtccggtcggagtatgtgcaatgtatcagtctttaga

SEQ ID NO: 16540 - DNA, 40518 bp, Oryza sativa
  unsure (1)..(40518): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctcttacgctccaggaatggatcagtcagaacatcaccaccggcttgccgtcatcgccgccgactggtgtcttcgcctatacggttgtttggtcacaccaccgttgttgggcgtctacgacttcaccgaccggccgcctcgtccgccgccgactggtgtttccgcctgcacggctggtctattatgccgccgttgttgggtgtctacgtcttcaccgaccggccgcctcgcccgccgccaactggtgtttccgcctgcacggctggcctattatgccgccgttgttgggcgtctacgtcttcaccgaccggccgcctcgcccgccgccgactggtgtttccgcctgcacggctggcctattatgccgccgttgttgggcgtctacgtcttcaccgaccggccgcctcgcccgccgccgactggtgtttccgcctgcacggctggcctattatgccgccgttgttgggcgtctacgtcttcaccgaccggccgcctcgtccgccaccgactagtgtcaccgcctgcacggctggcctgttatgacgccaactgatgctatcttcttcacggctggctacatcgccgtcaccgctaataggcatcatcatcttcgacgcaagctgtctacgtctactgctgactagtgccctcacctctacgtctggtttagacagctaccactactgatgaacatcatcgtcttccgtcgccgactggttatgctgtcgccgactggtgcttttatcttcacaactgcgcgtcttcaccaccggtttgcttctgttaccgccgacttgtgttcacttcattacagcaatacaactttgtcatcatggtggagcgacttcatctttattatcttcggcaccggcaaactctattggtgctacttcgcaagttttgctacttcaccaaccacgacgtctttgtgaacctcgacatctcggcatgcgatgccgtgttattttactacaacaagtggctcttcaatattcaggatttctacttggacatcttcaacacatatcttcaatcaagcaatgactattcgacgacaagaagctacagtctcgactctatgttcagttgtttcccaactaatcaaagagtcgggggctacacaaatacaaggctcaaaatttgacaaattttatgtcaagctaaagaaatcaattcatcaacccacgagtcaaatccaggagtcattatcttcatctttgcttcagaacagacattctacttcaacaacatcaaatattttgatttagacgagttggacaacagcatcaactctcctccaagtgaagcatctacaacagctataacattaatttgatggattattgtcactgacatcatcaccagcacctttgcttcatcggccctgacatctccgctgttgctaatggatgattatgtcttcaccgacttattatttcaccttcacggttgacctactatgcaaatgttgatgagcgtctttgtcattatcattggttgctacactgctattgactggatcaccgacatcgttatcttcatcatgtcggttgcgtttgtcgtcgtcaactattttcttcatcttcatgattgatggatttcgtcatcgcctttgatcttcattgttagttgatctgtctgtcgctgactggtttcttcgcctccatggttatgcaacttcattacctttgattggtgtcactgtttttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactagggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaatgtgctgtttgggtttttaagcaattgattggatacaatatcattgcttttcgccacgtaagtgtgcatttttattgaccaatattatggcttaggctgattatatattgtggtcattttctaggcggttggtaaaacctttatgagtttatttactcggattttacaccacatatgccatatatttccgggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacatactcggcggattcaaatccccaaacaggagtagggtattacctctcattgagagggcctgaacctgtctaaatcatttgtctccgcatccatccacttttaggtctcgtgcgctacccccttttattattgccgaattcatgtttcgacactaccctaaccatattttttttcaaattagaatagtaaacgataatttcagataaaattaagaaacttgattgaatattactgaataaagatacatatatagcaaatataaatcggaatgaatacaaccacaaatatttatcgaaacatgaaaaccacttatactgtgcttccaaaatcaatatataaactagatcttttatcaaaagaatatgctaaatttatgctaaatataatatgttgttgtaaattaaactctttgtttttttagaaatttaaaagtatttagcattataattagagtaaatttcacaaaattacatgttttatagttcaagttgtagaaaactacacacattttgacacttggcacttaagtacatatattttgatagtttagtttcacaaaaccacactatcgatgaatggattcacccatgagataacgtggttgttccatcaaggatgagaacgtggcatcctattaatttcgtgcgatggctggcaataggatgccatgtcctcatcctaagtgaaacagtcacgttatctcgcgggtgaatccattcattgacagtgtggttttgtgaaactacactaccaaaatatatgtacttaagtgccaagtgtcaaagtgtgtgtggttttctgcaacttggactacaaaacgtgcagttttatgaaatttactcttataattatgaagttgtatccatattagaatctcaatttcaagtgttatgtgttttactctaaaattaataattaataaatgtaattgatatggaccatttttacaagaataagctattaaattaataaagaatcaatctatttaatacactattaaatatttagtatcaataatattaatatagtctatggtttggaacaagaaaaatgcttgtccggtggtatttcgtagaacaactaatgtttttagaaacacagtacaaacatagatgtttataacacacgcacactcaccccggtaaacaaacatcctgcctctatgagcatctccgaaagatttatctatcatatattgaaattgacgaaatcaccacgggtgtctcgttgtcgatgtgaagtacatcacctaatactaaagaataatttaccgtaaatgtgagcacccgtgtcaaatctacgacttgaacccaggtaagcaggttccaccacaaggaagctaatcagttcagttacgttcactttgacattaaaggtaggttgtagaactgataatctgtcaatggtgaaatatagattcttccaaaaaaatgatctatgctaaatggatggatttatttgaggcaaatgatttgttgctggcctcggtttcttcgagcatgtgttagtgacacactcccgcacggacgtgcttatgatgcgttatgcctgtatatgtggctttcacctaatgatgataaacaagcgcaatgataagctgaagcagtacataattatgccccctaccccgctaatggcatatatgtgctttccttcataactcagttaggtatcaagttcttcattctctactctgtcgtgccatgacttttgttgctttaatttctagcttgctataaattcctgcacctcagtcctgtcccaaccatcaaattcgtcttgatcaaactatcagagcacatatggcactcactcacctcctctgctccctcctccttgccaccgcattgctgctgctctccatctcccgtacaggtaaccatggcaaacgtagaaacgctttcgattattttggactagtagtattatttagatatgcttaagtatgtgcagctttgtaccaacagaaccggtgtttcttagctttccactgcactgtcagtggcagagcgaccgctcggctagcccgggcagtccggctcgccggcgaaaactccattaaattttaatattgatggataaatcaatgagaaaataacaaatactagttaggccctctttaattgaaagaaaattcataggaattttagaggattttattcttataggaatttttcctacaaagccttttgaatcaaagaaatgaaccctatgaaatcctatgaaattcctattaaatacctcttcccatacaagttttggaggaattttaataagagatagaacctcatggaagaaatcctttgagtctttatctctccttaaattcctgtgtttttcctgtggtccaatcaaacagtcattccgtttttcctgtgttttgcaatcctctgttttacactttcattcctgtcagaatcctatgtttttcttattcctccgttttttcatttctgtgattcaaaggggcacttatattgaagtttgcctgggctcaaaaatctatctttctgactccaccactgactgcagaggctggcgaggtgggcgtgtgctacgggagggacgcggacgatttgatggatccaccggccgtggtgaatcttctgaaggagaacggcatcacgaaggtgaggatctacgacgccgacccgacggtgctgagatcgctgtccaacacaggcatcaaggtgatggtggcactacccaacaaggaccttgcttctgcaggccacgatcagggaagtgcgctagactgggtgaaaacaaacattgttccgtactataaccagggcacacaaatcaatggtgtggctgtggggaatgaggtgttcaggcaagcacccaacttgacccctcagctgttaccggcgatgaagaatgtgcagacggcgctagcgagactgggccttgccgacatcataaaggtatcaacacccattaattttgatgcggtcaatgtgtcatggccatcatccaagggtgtgtttcaagacagcatcgcccagtcggtaatgagtcccatgatcgatttcttgcaacagaccaactcatatctcatggtcaatttctacccatatattgcctgggctaactctaaaggccagatctcccgcgattacgctacatttggccccaacgccggtgtagtcgatccgtggagccacatcacatactatagtctctttgatgcccagctcgatgctgtttactacgctataaatcaggtttctggtgatagtgtgagggcctcaatggcccaaacaagatgggggcacccgacaccaagggtgcccgtcaaatgttcggaatgtgggcatccctccggtggtcagttccgcaagttgaccacacaagctgatgccgaagtggatgtggctacaaaagctaacgcccaagcattcaacaatggtattatcagacgcgctctgtttggagcctctggtatgcctgatgtctctgtgtacatcttcgctcttttcaacgagaacaagaaggctggagcatctgtagaacgcaacttcggcctgttctaccctaacggtacaaaggtttacgaggttgattttcatggtggtggtatttgtcccaccaaggcgagctggtgcgtggcaaatttagctgtggggaattcccggctgcaggcggcgttggattgggcttgtagtaacggcgcagactgcagcgctatccaacagggcaaaccttgcttcgagccaaacacaatggttgcgcatgcgtctttcgcattcaatgactactaccagcggatgggccaagccaatgggacatgcgactttgctggcgctgcttatattgtcttccaaccatcagaaagttagttcctacgaccacatatttcttaaaatgcaattttgtttagttctcacaaccatttgataaatctgcctcactgtttatctactaaattgcaggcatttgcgacccaaatccaagttggtgtatcgcgaaccctgcagttggggacatgcggctacaggcagccctagattatgcatgcggcagctgtgcagactgcagcgccatccagcccggtgcacggtgtttcgagcctaacactaaggtggcgcacgcatcctacgcattcaacgactattaccagcgtgttggccgagtcagtggctcgtgtgacttcggtggtgctggttccattacctaccaggcaccaggtgagttcaagctcaacagatattctcatcttgtttgtttcagatattgctttcaaaaattattgcccatgcatttcttctcccatatataatttttcgaagcaaacatagctaattaattgatccatcttctttcgtggcttacaaccacgtgccattttaatctccattgtatgttttgttttgaaactaaatgccattaacaatgcgttcgaaaccttcaagtgctaataatgtacattttgcgtaaaaaaaatacacacttgtttttgtacactacgtgatgattcaactagttaaatggtgatcttaggtgtttgttgaattattttcagagattggaaactgcgtccttccgccaatgcttgaactggacaaagcgtactgaagaccgagggctaagctagctaccatcagttcgcgatagtggggatggatatcgaagaacaagtccacatcgtttggcaaaaataaaatgatatgtttgtagcagtttttccagtcgggtctattgaaataagtaaatataccgttcattcctgttggatgaaattcctcagttacataccctgagcaatttatcatgtatgtgcatatgatcagactcctaagcagaactgaaaacatgaagaagtatttatttatttatttttagagaggatcaatgcactctaccatttccataaccgctgcaaaggtttgaatttttttttaaaaaaggaaaactgcacgagattgtgtttttcattaaatatagaagtacaaaattacaaccccaaggaataaaggaaaatagaaagcactctatacacaatacatggttgggtacgtaagagctcgcgtaagcactttgcacctgccagcgcccacgtcctcgcttcctctttaatttaaaataaaagcatcgccaactgaaacatacccaattcttttcggcatcatatataggtgccatcctattccaccttctaaggcaattcgagcactagaggagaaaggaactagacatcacaactcctgaacatctggaacagtttaagaactcctgaaacacaaaacgaccaacttattattacagaaggttcaacaggcataagtgcaaagcctgaaccagctccaaatcaaaacaacaaaacagttaacagagaaaagtccccccaagacaatattgtggagaattatgggtaccacatactcacatggctaggctatccgactggttatagggaatagatcatgtatatagaatatatataaagactaggactcgggtataacatttacttgtctatcaaggaacggtttgtagtcctggtttgttaagtttgtagattaggtataggagatctaaactataagggatatggtctctatcttataagactactccttcgcctatataaggagggcatgacgcctctttgggggcagattcataaccagatcgttagatctatattacacctggtggattcaaatccctaaaccggagtagggtataacctctcatcgagagggcctgaacctgtctaaattcttgtctctgtatccatcaacttttagatcccgtgcgctaccctgtttatattactgaattctagtttcgacgagtattaaacttgctcaaacgataagttgtttggctctcccctgctaggcttgatgtagatagctactctctctatcatataaaaaaacctaagggattgttcagattgttatcatttcaaaggcataccattttttagagttgtcaaatatttgcatccatttagttttattttaccaaactctaataactacatataaatgctgtcaaaacttggcaatattgttaaattgttgaaattttgatattgtcaaaatttggtaagatttattttagctataatctgaacatgccttaagattggatggaacatatttaatgtgctaggatatagcacatccaattctagattggttttttttatgggacggaggcaggcgccttaggccatgcaatatatgatgcatgatgcaagtagaaaaaaaaatgttgaaagatgggacgaaccaactaattaattatagataagaatgctggatgtgaggagccttacacgccaccatcgaaagctccccatggttgaccacttgacctactaataaacttcgttctaattgcaggtgttggcgtgttgctgattgaacgagaggaaggcatcaatagcgtgggggtggtggagtcctctacatagtacctaaactctagcgaaagataatctactgtaagaattactgacaaaaagctgagtctggtaaagatagaattgctgatatatactccctccgtcccaaaatataagggattttgagttttgattgtaacgtttgaccactcgtcttattcaatttttttttgcaagtataaaaaacgaaaagttatgcttaaaatactgtagataataaagtaagtcacaaataaaataaataataatttcaaaaaaaattgaataagacgagtggtcaaacgctgcaaagaaaaacgcaaaatcccttatattatgggacgaagggagtagatgttttaacgtctatacctacacattatggccttgtttaattcccaaaaattttttttacctaaaaacatcacatcaaatctttgaacacatacataaagcattaaatatagataaataaaaagactaattgcatagtttgtatggaaatcgcgagacaaatcttttgagcctaattagttcatgattagccataagtgctatagtaacctatatgtgctaatgacggattaattaggcttaataaattgatatctcacggtttccacgcgagttatgaaattagttttttcattcgtatccgaaaacccctaccgacatccgatcaaacgtccaatgtgacacctacaaattttcttttcgcgaactaaacagtcctatatattaagagtgtaagatggacctttcccagctgatgtatatgttggtaaaaatagtccaacatatagttccacccactttttttttcaaattattgtgcataagtattacgcaaatatgggtatgattccaacaatattttaatgaggtccaagatttatcaccagtctttgtccgttttggcgtctgttaatgtacgtgggtgtgggattgtgtgtatgcatcttgtgtgtaaagaaaaaaattgagggcaaaagcaagtaatatgtggggttaagaaacaccaaaacaacttccaggctgttttatcaatagttgagataagagagtgatttatttactaggaccgttgaaattcgaacttgccaaaactttaaattttggtttagtctttttttttctaaaaatttatgttgagatgtatattagcacaaacccattataattttcttttgtttcgggtagcggcaggagggatatgctgcagaaggataaatataacatatacagagaccatgtttgtttcttttttttttcagaagttgccaaggtcatttcgaaaaaaaaaaggataaatccgccgaagcgatattgtgataggtggaaaggctgaaagctatgttgccgtcccctaatctgttgagagatgccaattagtctacgttgatcaccaatagtataagtggtcagtagattatactctctccatattttaatgtatgacgctgttgactttgtaaccaatatttgaccattcgtcttattcaaattttttatgcaaatacaaaaatacttatgtcatgcttaaagcacatttgatgataaatcaagtcacaataaaataaatgataattacataaattttttgaataagacgaaatgtcgaacgtttgttaaaaagtcaacgggggagtattagttgccatgtgttgggaaagcgatcaagaggaaataattcaaatggctgcccggttgagactcgacgaagtaggggaaggattttaggtgcataaatgtgagattgtgactctgaagacaccttagcatatcaacatctccactccatcactcttgaaaaagaaaaatgacaaataaatcaattaatcatgttgtgtttatccaccattgtcgactggaagtggttcctctgatgtaaagtcaaagggacatatatcactaacatatagtgcccatcctatcctagagtccatccttatgggcatatatatcaagagacataggttactctattgtaccgataaatatgtttgttaaccgttccaccaaagagtatccaatgcaataggagtagttgagatgctattgctgaagtatttatgctgcaacttagcttctgttttgtcggcacattagctgggtgttagtcaaagatgtagggtatatctcgaattaatacttttttagtcacgtttagtaccgaacgccatgaatcttttaagacttagccaattcgtcttccatctcctcagctttccaagttcttcgctttcctttgcaccattccgtattcaaagatccactgccctttctctttaactgacgggaagacacaaggaagccatcttgacagctctaagatcggacctgctggctgctgctgtgatttttgggtgagagcttgttgattcaaattggaattgttatgattcgagtaggaagttcatggttctaatacaaattttagatactcgagttccaagttagaggcttttgcatagaaacgtttggatattttagttcaaagttatgatttttgtgtgataagtttggggactcgaactgaaagttcaagacaacgagtagaaatattcgaggattttgagtcaaagtttcgatgtccagcttgaaaagtgtgtttttcttttctttcttgctccagatggaccagatgtagggatctccaaagaagcaatcagccctcttgatttacgctgcctcttgccacggtgtgcactgtgcagttgcagagtagagcatggcattcagtcacctcctccacgccctcctcgtggccgcggcgttgccgctgctccttctcccccgtgctgcaggtaacgtgcttctggctttcctgccaatgcagctgatcggcaacgccaaacgatggagtaattccttgctcgtcaatgcagatgctggcgagatcggggtgtgctacgggagggacgcgaacaacctgatcgacccaccggcggcggtgagccttctgaaggcgaacggcatctccgcggtgaggatcttcgacgcggaccagacggtgctggacgcgatggcgaacaccggcatcaaggtgatggtggcgatacccaacgccgatctggccgccgccggccaggatctgcgcagcgcgaccgactgggtgacgaacaacgtggtgccgtatcgcagccggggcacgctgatcaacggcgtcgccgtcgggaacgaggtgttcaggcagagacccgaactgaccgggatgctcgtctcggccatgcgaaacttgcacaaggcgctggagaacctgaacctggcgaacgacgtaaaggtgtccacgccgatcgccttcgatgcgctcaagcagtcgtcccctccatctgcgggggagtttaaagatgagatcgcgcaatcggtgatgaagcccatgattgacttcttgaaacagaccggctcgtacttcatggtcaatctctacccgtacttcgcatacgtggctcagcctgacaaaatctctctggagttcgcgacgttccgccctaacgctggtgtgcttgatggcaataccggcatcaggtacttcagcctctttgatgctcagctcgacgctgtttatgctgcgataaacagggtttctggtggtagcttaacggtctcaatggctcgacgagatggaatccttagtgtgcaagcttcagaatcagggcacccctctggaggtacatttcccctattttccatgctagctgcagccgatacggactcgatagccacgatagccgatgcccaagcgtacaacaatgggcttatcagacgtgtagtatccggagcctccggtatgcgtgacgtctccgcctacatcttctctcttttcaatgaaaacgagaagcctgggccagccatagagagaaactttggcttgttctacccaaatggtcagaaggtgtatgaggttgactttaggggcggtggcggtggcggagcttgccccacaaagacaagttggtgtgtggcaagaacagatgttgggagtgcagcattgcagtcagcattggactttgcgtgcggtaacggcgcggactgcagcgctatccggcagggcagtgtgtgtttcgaaccaaacaccttggttgcacacgcgtcgtacgcattcaacgactactaccaacgcaagggccaggccagcggcacttgcaacttctctggcgccgcttccatcgtattcaagccatcgccaagtaatgttttgctctcaatctttaagatcaatgaggctttcgcaaatgtgcattcatatcttgattccatctcattgtttatttgtcctgtgaattgtttcccgagatataggcatatgtgatccgaacccaagttggtgcgttgcgaaatcggaggtcggggacgcacaactacaaaatgcactagactatgcatgtggtagctgcgcggactgcagcgccattcaaccaggtgcacggtgctttgatcctgacactaaggtagcacacgcgacctatgcattcaacgatttttaccagaccaccggccgggctagtggatcgtgtgactttgccggtgctgcttctattgtcaaccagcaaccaagtgagttttctctcattttactgtgcatgatatatatgccctactgctactaatgtacatattccctaagaaaaattgcacacttctgtttcaagtagtaagtggttatcttattagtgcttgttcaataatttacagaaataggaaactgcgtgctcccaccaaacaatgctgggacagaacaaactgcaattgaagatcaatcgactgcaaacttaccagcaacagcttggcagtgaggatggattaaagaatcacttcatatttttctgcagagaaaaaaataatggtaccattaataattagttgggattgaagagacgaataaatgtaccgttcactcctgttgaatgaaaccctgctgttagtattcaaatgattgaaccaagggatgctctcctcaggcgactctgaggcgacctagctgcgccggcggccactccggcctcggcgtccacaccccgccgctgctggccacctcgaccgcagcggaaagctcctagcgccgacggcaagtctggcccctcgcagccactctcgtcgccgtgacatcgtcttcttgtcatccactatgccgaccaaccaaagagaacctcccaggcttcttcacaggtcacagctcccctcaccgcgcgtctccagcgacttcactcagcccccccatcgctctccctccccagccgcgcccgttccccccttttggctcgactcgccgctgccaccgccccccagatccagccgtgccatgtcgccagatgcagtttcggaggtccctgagaccccggatccgggggctgggacaccagatccgcgccgcctccaactgtttgccgatgtggtgaagcagcccgccttaaaaccccgtttgaaatcgcatttaacagtgcccgtcaagagcaactactacctcgccaaccagtctccaggccaagatcgacagcaagcatcctacgaagctacaaagcgagggagtacggcgaggagactctcccctgtccagtcgaccagcggcaccattaacactcgagacggaggttggacgccggtcagaaggcgcttctggtggaggcaaaaggaagctcttgctcccgagtcaaagagcaattcaaagcgacgcgacggccattcacttgactccaacaaccggccggcaccatccccctcgctctaagcttttcaagcaaaaactcagggccgttgtttcatttgccttgctcgcaatcaccgcgcagctcaatgcagagaccctgtgcgatgcttcaactgcgcacgctccgggcataaggcccgcaattgcagcgcgcgggtgcccacgctgcgttgcgccgtcacgcgacgctcgcctcttccatatccgccgtcgcacccgtcgcaacggccgtcgtgccccagttccagcttgcctttacgcccccctcgacaccactctaggccaccaacaccaccatgcaaccttcctccgcctccgcgccccaccaccaaagcagcaatggctctcctgggtgacccaagaacgcgccccctcgacgacgactgcatcatcctgtcttcgtttgttctccaggaagaacgtcgtgaatgggagaccacggcggcagtcacctgggcaatgcgagcaccagcggccatgacagccaaagacgtggagaacgccatcaaggaggagtttcgtcttcactctggcgacgttgaggtcacccaccaccaccccgaagcctacctcatcaagttctcccggcgcagccactgtgccgatgctctttggaagggcttcgtcaaacggcgagggattgaagtccacttcatcaagtggagatgtctaaaggacgcgatgggcgcggctctcatgtttcgtgtcaagctcttcctggacggcgtcccccgacatgcctggcagccggaaatcgtcgacaagatcgtcgcgcggcgttgcggtgtggagaaaatcgagactaacttggttcacccaagccacacgcgctacattagcttgtgggcttggacctccaacccgagcctcatcccttgacgtgtttggctcaccttcaccaggcgcacgcaggacgctgacgccgactcggtggtggtcacggagtcgccaccggaccactggcagtacggggccaagtacccggtgctcatctacgtcgaggagatccatgactacaccacggcaacgattgacctctccaaccctgacgcggcgtgtgagccgaccaagcgccagctgtcggcttggcaccttggcgtggttgatggcgagcagccgcccccacgcgccttcgatggaccgcaccctctgccgccgcgcactcaagacagggaggaagacgaacgccgcaatgatgaatgcggctgcgatcgcacgcgtggtgtcgaccgtgaccgcgagcgcggaaatagtcgccgaaatgaagggaggcggtacaatgacgaccacccggacgagctgcgaggccagggctggagacgccatgatcgcgatgacgaccgtgacggccgcgacggcggcgacacgcgtggtggcaacagttcaaggcgcgcggggctgaacggcgtgcgacaccgcacgtgctcgccaaggagaagggactccgtaggcgggaactgctatggcagacgacaccatgaaggggcacgcgatccggtggaagcagctgaacctctggcgccggtgtccgaggctaaacgtgctgaccgcgaggtaagtaagctgaaggttctttaccacttcaagttaacctcgttgcaatggaaggtgaaggcactcacagagaaaaatgtccgcgacatcaatgacatatcctttgactttgcctcactcttcggcaagctcaaactgggggcaggggggatgaaggctggtccaaagggcactctaccaagacggagcacaccattcctgcgagccgagctttttggcgcatcaagcaagctgcccagcggccgccgtccatccgtgaggtcgacgacgccctccgtcgatgggaagaaaatggggaagcggccctcgtcgttccatcaccgctggcatcacgaggtgcttctccaaccgtcgttggcgacaacttgccgctcacggtagacaaaggtgaattctccgatccggcttcggcatatttggctcttgtaaatgcagcggcacagggcgataaggaacatggagacatggttgcggctgcggtgcatggtgctgatgcggtgcacgatactgttgctgtggcacatgatgccgctgcggcgcgtgatgaagcggctgttgtggcagccgctgcagcactggcggatgatgtggaacgcggcacggcggcatgcggcactgcagtgcatgatgtggaacgcggcactgctgccgcgcacgacgtcgcggtggatgctgccgcggcgcacgacgtagcgatggaggctgccgcggcgcacgacgtcgctgtggcggacgacgacaccgcagacaaggagcaggatgaggcggctgcagcggcaacggcggttgctgttgcgcacgacgttgctatggtgcacgacgacaccacgtccaaggcgcaggttgaggtggctgcagcggcagctatggcgaccgctacggttcaggatgatgaggccgtcgcggacaagggagaggcgccggtggaggacgcagaggacgaagcggcaagtggcgacatgacaactatgccgcacgatagagtggccgtggtgacccgctctgctgttttgctgccgggcgacatggaccacgctgcgctagatgacatggctgtggtgattccccctgccgcgatgctactgcaagacggggagcaggctcctaccaccccaacatctccagttgtgccgtccacgccgaccatcagagctgctgtcgacggcgccatgagcgtgctgttcaagccattggaaccagcgcttctcaccattccactcgaagaacaacaggtgcaacagaatgaagtgcaggccgaggatggtgccaggcggagcgccagactcgccatgaaacctctcgccggcatcccgatggtcgtaaaggcacaaatcaatgtctgtcgccaaatgggtttccttccagtaggaggagtcctcactaaccaaacacttgctgactacaaggcgatgttcaacacgcccctaccgcaggatgcgatcgacgcactcaacaccctcttcaacctcaacaacgaacacatgcaagaaagagatgaagcgatggcagcctacttggggccggtggacgcagaggctgtcatgggtgaggtggtcagggcaacctagacccatgccaagaagcatggatcgtccgtcctgaagtgtcttttgtttccctcatgtgcgaaaactacaaatgcctaccgacgctggttaattctgcaaatgtcgtcttaatcccgaaaaaagaaggtgcagagtgcatcgcggactaccgaccgatcagcctcatccacggagtagtaaagctcatctctaagaccctggccaacaggctacagcctttcatgaactccgtcgtcagccatgctcagagtgctttcattaaaaagagaagcatccatgacaacttcatgtacgtccgtaacctggcgagaaaattccaccagacgagaaagcccagtctcctgctcaagctcgacattacaaaggcattcgacacagtccgttgggactacctacttgatcttatgcagcagaaaggcttccctacgagatggagagattggataacaaatattctcaggagttcttcttcgcgggtgcttctcaatggagcccctggccctcctataagacatgggcgtgggctcagacaaggcgatcctctatcccccctcctattcgtcttggccattgaccccctacaccttctcctcgaaaaagcgacaagcgaggggctgctaactaaactcaacggacgagctgcgcggctaagaacctccttatacgccgatgacgctgcgatcttcatctacccctcggtccaggacatgaccaacctcgcgcaaatcctgacccactttggtgagatcatgggtcttaacacaaacttggccaagagccaaattgtgccaattcgctgcgaaaacataaatttgcagaacatcaccgaaatcttcccagcacaagtcacccatttcccgatgaaatacttgggtctcccactcgctctctccaagctcaaaaaggtgcacgttcaaccccttcttgacaagtgtcgaaaaaaatggctccatggcaaggcaaacttttgaacgcagctggtcgcatggccctcacgaaatcagtgctgacagcccaaccaatctatcatatgacggcactaaagctaccggatggcactctggaagccatcgataaaaccagacgaaaattcctatgggctggaggagaagacatctcagggggaaaatgcaaggttaattgggaaagcatgtgtagacccaaagagttgggagggcttggcgtcctggacctcttcaagtttgcaagagcccttagactgcgatggctttggtttgaatggactgcgccagaaaggccttggacaggcaccattgtcccttgcgatcagctagacaaagacctcttcgcagcagcaaccactataactattggagatgggaggacggcgaacttctggcactcccactggattgaaggcaaatcgccaaaaagcatcgctccggcaattttcgccgcttcaaaaaggaagaacagaacagttcgagaagctctgacttccaattcctggatcagagacattaacctcctacatctcacatccggtgaccaccttcggcaatacattgagctgtggaccctcattcacaacagagccccctgggacaacagcgtgacaccatcacctggaaactaactctcatcggggagtacaccacgaaatcagcgtacagacttcagttcttgggggcagcaaaatcctttttcaacgagacgatctggaaatgttgggcgccgccaaaatgcaagttcttcgcatggttggttatgcaaaaccaggtgtggacggctgatcgactccaaaaacgaggctggagaaaccaacagtattgcccactttgccacactacattggaaacggcagtccatctcctcgctcactgcagattctcccaacgcatctggctggatatccaaagatggactggtcttaatctcaacattcacaactgggacagatgtgcctccgtggaggattggtggtatctactcatgcacagtcggcaaaatccgaccaaggccgtcaagaccctaatcatcctcatctcctgggaactatggtgcacgaatcttttgacacaatggcagcccgccaacggcggtggtcaacaaaataaaaggagaagtggctacgtgggtccttgcaggggcatctagtctgagtgcgtttactactctgggaggaatcccgtagagtcccccccctctatctgttgtagggccatgtaaatatcagtcatgtttttttactttcctgctctatcaatatatacgaggcaaagcttttgccttcttttcaaaaaaaaaaaaaccctgctgttgcacatttcagagaatgaaagaaatacatgtacgccacactcgtgcagcaatggaccgaaaacacacagctgccgcagcttgtcatcttataagctacaacctaaatttgagttttcagacaaaatttcgagttactctagatgtttttctttattcatcgcttcctgtttttaggccgttggcttgtaaaccgatgaaagtaggagtataaaagtctgctctaaaatcatttctggttattccgttcatttttctcagcttttaaacctacattgtctgcaattgagcggagctcgacatctacgaggacgatggcgcattgggaaccggatcctctgacttagagtaaccaaagtcagagggacatccaatgccgctgcaccgttcgttttccatcagacggacctgagcgattgcagcagaaagaccagctagatctcagcccacgtggctcacaagcaggcttgctctcgcctcttggccgcctcactcgccacagatgccgctgccggcggcagcctgcaccttccgaaggagagaattgtaaccaaggagccagttctcccccattgcaaactgctctagctctgctggtcaaccatgccaccttttaggtgaaaccccctccgcagctgtggaagaatttgttgtcgtgaaagatgtagcgagtgagcgagcgatccttgaacaccttaacaacaacaataataagcaaaatcgcaaatcgggatggcattgtataatcttactcaattcaaaattctaaattcatattgattgtacagaacagaagagcgagcaaacgtatatggactagcctaggacaaaatctgtatacatatgttcagcctcagtctcacatgttcaattcagtaacaccaacacattctaataccaagaacaggagcaggccagcagcctcaaatgtttagctttcttttgcatacatattgattggcatcaatttcacattctcatattcacacaatagtgagtctcaaattgacacaaatattcaatcatcatattcagtgttgaatcacaatctcaattcatatatcaatttagattctcaatctcatcttctcgagctgctgctgtaaccctcatctggaaggcagaggtggtcatgttagtgtcagcaacctgaagaacaccaagccagttgctgaacaactcagtcctcatgagaatgtaactctcgctcctaagcgttctagacttattaaccaaaggtatttggggccagattgggccgtgtaatgtgggcctcgtacctgttgattagctggcaatagttggtaagggagagagagagaggaatacaaatactgtaagacttgtaagatacaactatcctagagatcaatctatcggaggcgaattggcagcggcggcgatacggtctcgttgatcgtatcgaacaattcctctgtgttcttgtgttcttgcgtgaatagctcacagttagcctcctccagagactgcaacatcgcctccctcccgtagtgctgtggctcatggtagtgcactgctgtagatggggcctaagggcttgacaaggcggccgccagccatggggcaaggtgagaaaagagaggagaaaagaggcatcgtgaagtctttgagtgctcgactggtggttgtgcacatgtgggccgaactttgttgccgtgggccgagctgatcgagcccgttcgtttcggctgagctcgctagcttccatccgatgcggatcgagcggaccaatgcggcggatctagttccggcgcattggcgcaatgcgggcactgcgaaagatccagcgtccaccggccggcatgatctccgttgctcgggcctcaggtggccaggtgccactgccacagatcgcttagtcctcgtgacctcgcccatgtccgttggccatcggcagcgatcagcacatcatcatcgagaagacgagaacgccaaggccagactcaattgccacgaagatggactactccatggtgacatcgtggccgccggcgacggcagcttgcacggagaggaagagggtgagcaaggcggcgccgatggaggaggagggaggtggcggtggcgtgttcagcgagatgtgaggcaccatacgcgtgaaattgactgtagacgaagatgtgggtgtttggggattgatggacgatgggagtggaaaccattttaggctaaacccgttctaccatccagtgcaaatccatggatatatcgaacccattttgggccacaaaagttgcaaccaaatctaaatcacttgcatctctcaagtatgagtctaattcgattatcgtccctcaatcgcaaaaaaggaatatacaacatctctcaattactaatatcggttcattttgtgtctcaaaacagtttggatggtggtttagtccttcgtagttggttgcgggctcacatgttagttctgatgagaaagaaataatagagatggagctagccgaggcaagagtaggacgatgatggataagggatccttgcctgccctcattggcgcctagcgctggagctatgacgcgaggattctgctggcgtatgatgtggccaccatcgctgtccgtagaatccatcaaaccaccaaagcctcggtggcatcgcttcctaccatcctcctcccataggcatagcttcatatattttgatcgatctgtcggaattcatacggttctgagttattgtcttcttttgaggtttaattcaaaaaattgccaagaataggatcaacattttagcattgatattgagttattaaccacctgttcttggctggctgctaattcatcttgcaggtcgagttcagcgccaggcgattagcctgctaccgacacgacgtggcccatgacgatggtggccaagaaggggaggcgcatcacgggaggaatacggcgacacattggtcatggcggcccacctccgttgtcaccttaccgtggatgggatggcgaactcgccggctccctcccctctatcctctcctctcctatgctcacttccgttgtcaccttcccgtagatgggttggcaagctcgagctcgccgaccaccactaccgttgattcctcgtcaggagaaataggaaaagaggagagagacagagagggtagggaaggggatgacctatttcactgacagtggggtctatcatattttttagttcttttttgtttgaagtgccacatagacgctacatcaatccaagatctccgtgaatactgcatagggactcgatttacggtagtttcagaagataggaggtgctctatacccggctctactattaagggacgtgaataaaactcacgcataatgaagggaccaaaagtggaccttctccttttctcgtccactcaaacctcttcgatataatccacgtacaacctcagcccagtcaaattcatccaaagccaactcaaaaggagaatcaacacaaaaaagaataccattcccacccaacggacttgtaggcctagcagcagggcaagaggagggatccagtgtttgccacagcttgcggcctaggctgcgttttcactggttatccctgcgcatgcttcccaaactattaaacggtatgttttttaaaaaaaattatattagaaagttgctttaaaaattcatattaatcgatttttcaaacttaaaatacttaatactcaattaatcacacgctaatgattcaccttgatttacgtatcttttcaatcttctcttttcctctcaactcaaactcgatcactgtaatttagtgtgcaacaggatgcccattatatcatggagcggacgcccatttttatcttgggagctgcccgttaccacttttaccagataaacgacaggatcttgcaccttgatctggcctagttggcctatggcgaaattcctgcttcaccacctgcgttgtgagccgatagaactattatggctgactcccacggctcgccgtgggtaagcatgtacctcttccatattttttaaggagagtaaaatttcgcatactatagacctgttaggtttcttttgtacagcttcaaatccaagaccttttgaagctttgatctaactctatgattacattggtaatatttgaataaatcatttttttattaaattgatgatatttgaataaatcattttgtttcattttagatgaaattcaaaattttaaatcactataccttagcatacaaatttcaaatctatcgtgaatatgagatctgaaactgtgccgaacatgaccatcaaatatctatatgagaaagctcccacatctatcaaaagatctctgctagttgattagaaaaataatattattgtgactattagattatattaaaaatccaacatgggtcttggtttccttgtgtggttgaaatataatttcttattagaggaaccgtctcgtagacgacattattgtgacatactgctacggaatttgtggatgaatatatatgttaaatattatataaacaataaatgttaaaataatgcaaaaatgaagtgaggaaaataatttgacatacttatatgttgaggtctataatattatattctaggtgatatatcttacatgagatttaagatatataatagtaatttctagtagatgataatgtagcatacttgtacactgagttttaccttctaataattattaataggtaccatctatattgaagaagttttatttggtgtttcataaatattaatagtatacttgacttgtctaggctttttccacacgagggctgtggagtcttctgtaatattttccaagtcaagtcgttggctttgtccaaattaacgatggcctgcacgcagcacaagggtcaggacgacgatatagtatatcagacacaagtgggcacaagaggagcaggaggctaaataacagaggcacacatgcatgcatagctactagaatccatacgcgaccatcaatgttgtagagcgacaagttgtttggcgttctccccagctaggaatatatattgatacatataggccggtcaatatgcgtggaatgcatgtagaaaaatgttgaaaatcggtggacagaccaaaccgacaaataagttaggaatgcaggatgtgactgcccttgacaccccatcatcagaagctcctttgtttgacctattaaaccacatcaatctcaaacggtgttatcgtgtagcatgttataaacttcgtcttgctcttttctcattaagatttagattttatctcggcttgtattaacacgctattaaaactattaaccgatgtgttccgtgtaaaaactttctctatagaagttgctttaaaatatcaaatttatcaatttatcaagtttctaatagttcaaacataattaatcatgtgctaatggttttcttgatcattttatgtacgccaacttaatcttcatcttcatcagtttcgcctatggacgtgtcatgttatcttccaactgaaaatctataattaattgatcaatttaccattataaaaatatatgtggtgtagctgggagttagaacggtgatccatctagatgtaatggtccaaatcgatagtagagtgatccatatacaaatttttatgatgttaggcaacatacctaggccaagtctaattcccaactttttcttcaaacttttaacttttcatcacatcaaaactttcctacacacataaacctacaacttttttcttcaaacttttaattttagtctaacttctaattttggcgtggaactaaacacaaccctattatagttgaaacttgtgtcaaattttaggatgatccatggcccatggtgtcacctagatatctccgcctaaatatcgcagaaaaaaagcacgaaattaagaaaaggaaaaactaaaaagggtaatatatatatatatatatatatatatatacacacacacacacacacacataaaagggtgaagtgacatataccataggaaaaagtatgtaaatgttttttcttttctttttttttcattattaaaatgggggtttataagagaatctctaaatatataataaatgatgtgagtgtggagataatctttttgcatactgatatctcccctcggtcggcaggcttggtatcaatcttgggaggggaaaaatgacaaattatcagttcagttgtggctatcaccattgtctggcaatcatatatgttatccaaagagtattatacttcaatagttgagatgttatccaaagagtattattcttcgcgcctgctgctggcgcagccgcaacttggttctgttctgtcggcacatgacacgagctgagctagtgttcctgaaactgaaagatgtgagggtatatcatctcagaattctttcgactctgcattggtgtgatcttccattaattttacatcaagttttttttttctctattccagaacgtatggtaaaccctctttgcttgctataaattcccgtcatcgcgtccctgaatcctcgcattcaacgaacaacgactactcttgactccactcaggagcagagcatggcagtcaatcacaaactcagcgccctcctcgtggccacggcgttgccgctgctccttctctccactgcaggtaatacgacgatttggaaacaaattttagctatacttctggcttccggtgaatgcagatgggcagcaacttcagcgatgttgattttcttgctcgtcaatgcagatgcgggcgagattggggtgtgctacgggagggatgcgagcaatctgatcgatccgccggaagtggtgaagcttctgaacgcgaacagcatcacgatggtgaggatctatgacactgacccgacggtgctcaacgctctcgctaacacaggcatcaaggtgatggtgatgctacctaacaaggatcttgcttccgctggtgcggatgtggggagcgcaaccaactgggtgaagaacaacgtggtgccgtacctcaaccagggcacgctgatcaatggcgtggccgtgggaaacgaggtgttcaaacaacaacctgaactgactggtatgcttgtctcggccatgcaaaatgtgcaaatggcgttagcgaacctgaacctggcggatggcataaaggtgtcgacgccgattgcattcgatgcactcgatgtgtcgttcccgccatcagatgggaggttcaaggacagcatcgcgcagtcggtgatgaagcccatgatcgacttcttggtacggactggctcatacctcttggtaaatctttaccctatgtacgctgcggcggatccgtcgacccacatctctatcgagtacgcaacgttccgtcctaatagtggtgtgctcgacgaaaaaaccggcatcatgtatttcagcctctttgatgctgagctcgatgctgtttacgccgcaataagtaaagtttccggtggtagcttgagggcatcattggcccaaggagatcaaatgttagttcaagttgcagaaacagggcattcctctggaaatacatttggtgggccagtggtcgttgaagctgacgcggatttgaatgcaatagctacaatacccaatgccaaagcgtacaacaatggtcttatcagacgtgtgctctccggatccccaggtaagcacgacgtctctgcctacatcttctctcttttcaacgagaacttgaagcctgggccagccacggagggacactttggcctattctacccaaacggccagcaggtgtatgaggtcaactttcaaggtggtagaagtccctgtccaacgaatgcaagctggtgtgtggcgaacccgaatgttgataatgcggcattacagagagcgttggactgggcgtgcaataatggcgcagactgcagcgctatccagctgggcaaagcatgctatgagccgaacaccttagttgcacatgcatcttacgcattcaatgattactaccaacgcaagggccaggctagcggcacgtgcaacttcaatggtgtcgctttcatcgtctacaagccatcaccaagtaagtttttcaaatgtacattcatatatatatatatatatatatatatatatatatatatatatatatatatatatatatatatatatatatatattgcgatcatatcctcattatgtgtttattatttgaacttatttggcgagatataggcatctgcgatccgaacccaagttggtgcgttgcgaaagatagtgtcggggaagcacaactacagaatgcactagactacgcgtgcggtagttgtgccgactgcagcgccatacagcgcggtgcacagtgctttaatccggacaccaaagtggctcacgcaacctatgcattcaacgactattaccagacagccggtcgggccagtggctcgtgtgactttgccggtgccgcaaccattgtcacacaacaaccaagtgagttcattctcattttgtaatgtattagattggtacatttcataccactaaaaatgttcattaagaaaaaaatgcacacttttgtttcaagtagtaagtgattttttaaaggataaatagctatcttattggtgtctgttcaatttatgtacagagattggaaactgcctactcccaccaaacaacgcttgatcagaacaaactgtctaggaagaccaaaagctagcctagctagctaccaaaggcagtgaggatgggattaaagaataattccatattcttctacagagaaaataaggattaaactttttgtatttcccgttggaaattttaaataaataaatgtactgtttgctcctgttgaatgaaattccgcagttacttgtttcagaaaaaataaatgtacatcaaactccttcagcaacggaaaacacagcagtgcaaatgtactgatgtgtccaaggcgtttcccttcaacagtgttaagaaattagcaaaatttatcataggatacgcaaaaaaatgtaattggctgggtgacaccgtgaaacgtgacacggttgatggacactaaaaaaaacatgtaactggccgtaggacaccggtcacattattttattattttcggatcaaaagtggtgggatatttttctaaatgcccggattgaccttctctttccttcttttcccctccccactgacttcgtcgggaacgggcacagcggcctcagagacgcggcgaggtcgtcgcgacgtggtgcagcgacactggcggccagggcggtgtactagatcatgcggcggatcgaggccgaggagatccgcctcgacgccgcgacatggtggtgatgagcaccaagcaagagatcgaggagcagtgggggctctacgatgggttcgacctcaaggtggagtgcaagctctgcatccgtcacatctggtcgaaggtgaggagcgcagtgggggctcctgcacctgctcatcaaccccaacaaggccaagaagcctctccctcccatctggtcgaaggtgctcagtttcttcacgaacccgcacaagccgatgatcctggcgctgtcgcggcaagacccaaaaaagaacatcaccacgctgctcaaggcgtacggcgagaaccgccatctccgggagcgttccaggcgaaatcttggaaggggaaaagaatgaaagggaaggagaaaaataaggaaagggaaggggcaatctaatcatttagaaaaatatctcacctttttttatctgaaaataataaaataatgtgaccggtgtcctacggccaattacatgttttgttaagtgtccatgagccatgtcaagttttcgcggtgtctcccgccaattgcacgttttttgcgtgtcctgtgacaaattttgctgaagaaattaaggcttagttcgaatgtgcattatacttggagaaaatccaagaaatgctatagataagcgtacaattccaagaaatgccatcgacaagtgcgagttccatgaaataccatcgtacaagcgatttcgttcccgaaatatcatcgccgttaaggttccgccatccctcgctgttaagtacactgttcatcctataacacttaacggagggttaataaccaaaccgtaaaggcaatggcatttctgggacaaagtatcttgtatggttacatttcatggaacttacacttgtgaatggtatttcttggaattgtgtgcttgttattggcatttcctggattttctcttataatcgagcttttggtttgcactcaaaacgaggcaaccattaacatatgaaaattgagtattaattattaaaaaaataaaatttggtttatttaataaaatttgaggggctctgattatgggcgctcctacccaaccaatatagcttctagccgctacgagtctatgatctcaccgccattatctatttgcatgtctatgctatattatagtcaccatggttacattgtggtatccccatctctatttaagagagttgtcgggttacagagtccgactctaacttcatcccctaacacctattacaactctaagtccaaccgtaactaaatatgactagtatattgggcacattctaagaatagtgccaataacttgattgagcaaattttatatttaaaccgaacgtgccctggcgtgctaaagaatattcaacggttgaggcactgttgctgaggtaccaaatcattcttcgtggacagacactcgtgaggacaattaatggtataatattgcacacaattgttgcactaagccactaatgatgattggaaattaatctgttgagtcttccccttgacccgaggaaaaagatgcatggctgatgacctgttggcttgcgtaaaggcacgggcacgtaccgcacttccaactctagtggaaaatgatctgttgcgtcaattgttcacgccacgagttttacttatatgcatatacacgtatatttatccaacaatgtttttcaggtttatatatgtggtttaaattatatattttttctagaaaaaagaggaagaaaatgatacagtgcactactgcagtagaattggaaatattgttattagttagtattagttgtcacttgaccggtattcgggcttttccacacgagtaggcaagatgtggaaactagcaattaataatgacaagtttcttggtccaacaagtcgccgcgtgcatatataatttgtcccgagcgaggggaagtcctgcacgcagcaacgtgagggtcgatacaacgtacaagttggacaattaggagttcattaggactgggaaggtacaggagcacctatgtgcacatcaattttttttgaaacactgatgtgtggggccgaggggctcacttatgtgtgggcccgaggagctcacatgtcagtgaacagtactgcagactacctgcatcctgtgcacatccctcacttgtttgtttggtctgacggatcttctgattcttgcatgtgttgtttgctttgaatcgtggcttcctattgtccatatcacatcgagctaagactcctccagatctaagatttttgggcgtggtatccgtagcttcacaaatccatttattcgataacatttggataaattattttgttcttattttaaattaaattttaaattaccataatttaatatatacaaacatcaaatctatcaagaatcaaagatctggagctgtggtggctctttctgggagtccagtcatcacatgattctacatttatatcctagaaaaaaaataattttatagaatctttgaaataaatgattgatttgtaccgatttctttgaaattcatatatgaaatgggcaattcaagaaaaatattagaggaaattaagtattttcttcttcttatatcttgaatttatgtatttttcatgtgcgccaattaaaagcttgtcttgaaattttcttatgttttgatccaataagcatgatattacatccctacatttttttactattcatgtattttcacaattctacgtttcaaaggatcagatctatagagtctacctataccaagttggatgataacatataaaatcattcaaatttcccaccgtgcaatcaagaacgagcgactggggataaaaatcagatgcactgctcggcactagacgggtcgagtagtgcatctgtgacatccaaacaggaaacaggacgtgtgtgatttcctgataggcccatctgctcctacacttcactcctggcattctagctcattaattaagcagttctagccgattatggcctactcgatccttttgtcagaaaaaaatagtcaaacttttatgttgcaagtgcacgattacttaacaacctatctgcaactggtccgactcatcttcatcaatcgtcaccactggaacggcgcccagagggtggtgagcgaggcaggagatcgagcgagggggctaacctccatttggccttcctgtcgatcgatgatggtctcctcacctccaacgacgggaagaacgcagcatccgtaccgtgcaaaacgaatgcggcggcgacctgcttcgtgttccttagcgaatgcaatcggagtggcagcgtaaaagaaaaatgatacgatatctttgcgcaaattgtaacttactttttttaagggattaagattaatttaaactggaagaaagtcgtgtggattcactagattagcttgataaacatggtttgatttttctggttttcgtcttcagttttgtgggttttctttagttttcgtgttttttaaaaaaggttacgctttcgttagaaggttgtttggttctctacctaaccaaatcatcattagtaggaccaaatcaactgtcgatgcctgtccagacactattaaaaatgatttttcatggtgtcaatctataattttcgctggcggtcgtacgtgaaaaccacaagcaaaaccgtaactagggggtcgggggctacggaccgctagcgaaaaccgattttccctggcggccacgctaagaggtccgccataaaaataacactatttttcgaggcggatctcttatgtttccgccagcaaaaacacaattttcactagcgctaggtaaagaggaccgctaaaaaaaattttatgccaataaaatccaccgcccccatcgacaccaaactcgcctctcttctcccttggtctctccgcctctctcacttctccctcgatcggtctctccttctcccttctccaccaacgccggctgtcgtcaccaccaacgctgctggatgccatctcattcaccgccgccgcatcgggagcggatccggcgccgccgtgcctcaggaggatggatccgacgccgcctggcccaagagggtggatccgccgctgccaggcctcgggagcggcgcggggaaggggacggtagcggtggcagctgttctcggcggatccggcgcctcctccctccccaccggggccgtgaggcggcgatgacgagaggcgggcggcggcacggatctgacggggggaggatgcgggcggtggtggcggcgatggcgacgggaggtgtgtggctgggtcgcgggctaccgtcaggagagctttggcgcaaggctgggtatggatctgttctctccctccctccctcttcttgatcaggcggcagaagggaggtagccgctggtggcgacaacaacagagcggtggctgctcgaccattcccctcccctccctctcccagatctggctggaggggaggtggccggcaaagttcccctggcgagctcgtccatggcacacggcggctagggttcttggatttgaatttggggggaaaaatgcttgggagctaggattgctatatgtgaaattttttttgtgcatgttcttctagacgatgcagatgctttgatttgtatttcatgatatgtgtaaataatgtttgatttgtggaaatgatgatttgtatttcatgtttgaatttggtaatgagcagccatatgcatatgcatgtggttttgtgtcacatgaggttcatgtgtttgagaaattgcaaacaaaatgggatttagggtgggtgatattggggattggggatttgtgattggatctggattttcattttttttactccaaaaaatgttttcactggctggtatcttaatattgccattagcgaaatcctattttttatggcggctgtcttaacgtggccactagtgaaatcctattttcgctagtggctgtcttagcttggccgccagcgaaaatcaattttcgctggcggccgagtgcccgccagcacaaatgaataattttcactagcctttgatcactggcggtatagccggccactagcgaaaacctattttggccgacagtaaaaacagttttagaagtagtgagagcacccgataggttttacctgaagaaaagtagaagcactaacacggtgtcttgcaaggagaaatccagtgcccgtcggcaccaggcataaagcaaagacttacgcctagagcttccatagcctaccaaccacaacaaccactgcacacagccataacgagaggaggaaggcattatcattgcccaacaggtcacacatacccaaccccataaacgcacacccataaagcaaatgcgaacaccgtctcgaacgaatgcacatgagccaccactatcgtcagaaaccatgacgaaggagactagtgttatcgttgtctagctcgtcacccgacgcagcaattctgacttcacctcgtccccccaccataccatactatggatgtggccacactatagcgactcccgcaattagacgtcaatagctgccaaacaccaccaagaagctccgagctagccaagccctcctctccccaagagaatatcaaaggattggaacgggtcggcgacaggagctcctaaaggaaggaaggtacaactagctggagatggcttgacgtccaaccaacacactcctgagctgacgtctcaagccagcaccaaacaactatcaaacggccgaagccgaccagatccaaccacacctccatgtacaacttcaaccaactacgctgtcgttgccacccaaaaccaccaaacccaaaactccatttgatttgacctcaggaggccaaattgacaccactggcactccctcacctcgccattactcccagtcccacctaggggccttaggcttccaccttgtgaccaatcgtcagcctttctaccaccacgcgcatggctctagcttccatgggtagctttacgtgaacctgcgctcgctcagcctctacgtcggcgccacctacatcaaccggccacatgccaccagccactcccgtgctggcgcagctactacgccaccactgcctgcattggcgccacctgcgtcttcccactccaccgctatctggcccaccgcctaccgacgtcgatgtccaggcggtggaggggtggagcccaacagtctaggcgacaagcctgatcaccccccacaaggagttgggggccactcttccataagagaatttatgccattaattcaaagtttcaatcagccttgatttcgtttcaatcaatttttttttcggccgctggtgttgtaataggtgctcgactcgtctgggctatttcccacacgggtagacaaactgccaaaaatagcaattaatggtaaggttgtggaatcatctatagtagtcaagttgttggctttgtcccgaatcctgaggagggggtggggaagcaaccatacaagtggggagcaagaggcacacatgcatatgataactttttaagttaatgatgcatatataacttgctgtgttctttttctactttcctagctcatctctctcgttttccgtgcgcacgtttttcaaactgctaaacgatacattttttataaaaaaaaatctataagaaagttgcttttaaaaaaaccatattaatcttttcttaaaaattagtaaatacttaattaatcgtaagaaagtgtgtcgctctgttttatgtgcgtaggaggtaagtttccaacctcacctcttcatcgaagcattagagcaggtacaatagcagactataagccagctataaacatataccgaggagataaaagaatagagagataagcagcgggctatatgtttgtagctagctgcagcacgggctccaatacacagtgtgtgtatgatatgtgggatcagatactaataatgtagtatatatttatagataactattttataagtcggctattaaattgattatatatgatttgaagctaggttggctatactattaaacttgctcttagtaaagcgaccagtactagtactaattgcttgcaggttctgcccagcttggacaggccggtcaatgcgcatgcaatgcaaatgcttgtagaaaaatgttgaaagtttgtaaaaaaaatgttgaaaattgatggactgatcgaatccacgagggatgaatttggttggatggattagatcggaaatagcccattaagttttgcacgtgttaatttgtcttgtgttcaagagttcagatggaatggacaagggaaaaaaaaaaggctcccgtgaagacctctattaatgcttatattgtgggaatatagggaataattgatcagtgataattagtatgttttgtttttaagaaatgcttatattgtgggaatatagggaataattgatcagtgataattagtatgttttgtttttaagaacttcctatgttccaagttttttttggtttgcttaattcaaacttcttttaagttcgatgaaaataaataaatatactgcttgctcatctcagaatgctggcatgcgactcaccagtcaccacggtgcgcgtgagaccagagtatccagacacctcctccagtactgctctgtctcccatgcaggtaacctactgcagcagcacaaacatgtcagaacccaccaaaatatgtttttcctgtttgtattccgtctatatcaaaataacttttatctattttcttactcattcgttaaagactttattttaagcaattaatgcattgagatctgataaagtcaagacaaatgccttgagacttgataaagttaaaataaatgcattcaaacttgataaatatgagaagaaatgcatcaagatttgataacgtaaggaacattctactcttagaatttgtatttgtatgtataacataggtaaaagataaaattattttccccgcaaaaaaaagataaaattattttgtgatagagatagcattccctctacttgataatatttatcgttttggacaagattattgtcaaactttaaacactttgactataaataacatctaaaatatttgtcttagaaaatatgaagactatatatatatatatatattagtcttaaaaaatacttcaataaaatgatatatttattaatatttctatatatatacatattaaaaaatagtgatcaaagttggtttttttttggagatcatatccttgtccaaacatcgataaatacaatattatcagcccggacagagtagttgcttaaatctctctgtaaggggccgaagctatgcttatatgtgtttttaagaaaatgtgtcaaccttgacaaacacttaagtatgaagctaatgcagctgagcggcaaactatttcttacttctcattgcaggtgcgggcgaggttggggtgtgctacaggagggacatgaacaatttgattgaaccactggccgtggtgaatcttctcaacgcaaacgacatcacaatggtgaggatcgatctacggcaccaactcgatggtgttgaatgcattttccaatacaagcatcaaagtcatggtagcaatacccaacaatgatctggcttctgttggccaagatctgggtagctcgacaaacttggtaaagaacaatgtggtgctgtacctcaaccagggcacactgatcaatggtgtggccatggggaatgaggtgttcatccaacaaccaaacttgactgggatgcttgtgccagccatgcaaaatgtgcagatggcattggtgaacctgaacctggcaaaagacatacatgtgtccacactgattgcgttcaatgcactcgatgtgtcgtttccgccatctgatgggagattttaaaactaacattgtgcaatcggtgatgaagaccatgatcgacttcttgatacaaaccggttcatacctacctcttggtcaatctctttcctttctacgctgcagcagatccatctagcatctctattgagtacgcgacgttccatgacaatggtggtgtgcttgacaaaaatacctacaagacgtacttcaacctctttgacaccgacctcgacattgtttacgccgcgataaacaaagtttctggtgtgtctgtcctcgatgtgaaagctacggaatcgaggtacccctggggtatgaagatacccccgttagccgatgcaaacgttgactcattggcaaagatagccaacgcccaggcgtaaaataatggccttgttaaacgtgtaatgtcgagtgcccctggtatgcatgatgtatctatttacatcctctctcttttcaacgagaacttgaagaaagggtcagacacaaagggcaacttcagcctattctatccaaatgggatgaagatgtacaacgtcgacttcgatggtggcaattcctgtcccacgaaggcgagttggtgtgtggccaaagcaggtgttgggcacatggtgttgtaggcggcattagactatgcatgtagtaagggtgcggattgcagcactatccaggtgggcaaaacatgttaccagccaaacacattggtcgcacatgcgtcttatgcattcaacgactactaccagcgcaagggccaagctaatcgtacttgttacttcgaaagcaccgctttgattgtccacaagccatcatcgagtaattttccactcccaatctttaagatcaatgaggtttttggaattttgtatcatcatcgtgattacatccaactgcatatttttttatggattgtttgctgagatatatgtaggcatatgtgacccaaacctgagttggtgcattgcgaaaccagaggttggggacacgcggctgcaaaaaacactagactatgcatgtagtacctacgtggattgcagcactatccaacatggtggacagtgttttgatcctgacaccaaggcggcgcctcgacctatgcattcaatgactattaccagacagttggtcgagagagtggttcatgtgattttagtggcaccgtgtagcgcccattccgtcgtggcgcctagcgggaaaattatctcttaaaaaccctaattgcgaaatttgtttctttgcttgttgtctagtgcccgtgccatctcaagatctcaaatccccgatctatcgtcgagttcaattccgaatccaaacccttccaaatcaaattcctccgcaaaagtctagtttgcctcccccggggtcgatgggccgaatttct

SEQ ID NO: 16541 - DNA, 531 bp, Oryza sativa
atctccccctctcccccagccctctccccccggcgcgctccttctctctctctccctcctctccctccgccccgctccgcccgcgcgctgcacgcgcgagtgcgtgagccgcgccgagccgagccctcctccctcgctctgcccgcgcgtgcgcgagagccgcgtggtcgccgcccgtgccgcgcctgcgccgtctgcgccgcctggccccgctgccctgccgcgcagccgctcgaccccgcgagccagcgcgcgtgccgcgcctacgccgtccgcgccgcccgttgtttcccgcgcgcgcgtgccgtggtggccgaccgcctggtcgccgccgccgtcagcctctgccgcgcctgtcgctcgtgtccccgctccgctccacaccgccccgccgtcatcgccgtcgtcatcgcccggcccccgccactccgcgcgcaagctgccaagggacggaggcagagctcctcctccctctgccgcgtcgcccccgctccctcctccttttcccgaagaggcaaggggacaagcccc

SEQ ID NO: 16542 - DNA, 8155 bp, Oryza sativa
agggttcacggccttgtttaataatactgtgtagctctaggatcgtctttataaaatggctttgggcaactaagtgacttttaaatgctgcttttcagcaaaacttaacccctatattattaccccttgtacccccttgcattaatcatgcatctgtcggtgtggcttgctgagtactgtggttgtactcattcttgctcaatcttttcccccttcagtaagagaagctttggagaagaagtcttaggtggagtcttggcttataccccagttgagcgcctgtgaagatggagccgtaggcccgctagtccgctgctgtttatttttgattgtcaggcctgaagcgcctttgtaataatgtaattattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctctttttctccttcccctaatgctatttgcaaaaggtttacccttttcttccttcttcaaatttcaattagtactagttggtcagctttgtgaagaagaagacatcgtcagttgtttgccgaagctccggaagactgcaagatccgctagcgaagcaaaggaagcagtgaagccagctgtgaagcaggagtgaagatcttggaaaacccatcgcagaacctaagccaccctctagggtagagtcgtttgtcgtgtgtttccttgcttgtgtgtgtagcgcgtggtttgcatcagtggggtgtgatgtaaccatgctaggttgtttgcttaatcaacttgcagaataagtgaaacaaacagcacatcagcaagaagaattagttcctttaaggtcttgtccctagttctggtctattcttttcttgtatgcttcccctctcaacctctaccttgtgacagatggataatactggtaacaaaggctatgggaatgatggatccgatgactcaagaacccaagccaatgggaatgagagaagcaccaacgaaacctcaccagagctaatccaagttgtggttaaccaaaccaacatgttggcaacagcctttcaactattacagaattggagcagcccagcaggggcaaccaacgttcaagtgcctacagtccagcaacagtgcaagttatcagaatttctcaaaactgagcctccaatctttgccattgccgtcgatcctatggaagccagtgattggttgcgcacaatcgagaagaagctagggttgattcagtgcaccgaccaggagcgggttggcttcgcaactcatcagctggttggaccggcttcagagtggtgggatagctacgaggcatcacggccagaaggacataccatcacctggaacgagttttcctctgtattcaggagatcacatgttcccgcaggaatgatcacactaagaaaacgagaatttcgctacctgaagcaaggagatttgaccgtcacagagtacctgcacgagttctatcgtttggctcgctatgcaccagaagatgtggaaacggatgaagacaaacaagagaagtttctccaggggttaaaagatgagcttgcagtgcaactactcctagaggattatgaagattttgagaaacttgtggacaaagccatgcaactcgaaagtgagcataatcggatgacgaactgcaagagaaggattgtcaacatcccagtaattccatgtggtaaccaaagacagcgcactgagccacttcagatcaccggatcttctgttgtgcatcaagagttcctgccccaagaagacggacgcaatgcagacaacaacactagcaatactaatgatgatgataccaccaacaaccatggttcttgccccattagtgaccactcgaataaagcgtgcaatgtcagtagcattcaccaagatgtcaacgatagtatcaatgttggaacccagaatgacaaccttagcaattttgacactgagaaagactccaatggtgatagcaactatggtaccactgatgccaatgttagcaaggatttccaaccaccaattccaactccaagtcagaacgatcgtcctcagacggatagctcagcaaagaagacgttgatttgctacaattgcaaagaaccagggcattactcgagggactgcctgcaaccaaggcaaaatcgacctccacattaccgccaatttacacgaagcagacattccaattgtattgtggtcactggagcaaacgccgtacccgtaaggcctcgtgttaatcagaacccatagcagaaacaatgcaccaatgctcctcctgctgcacctgactcggcaataaatcatagcaaccattctctgcaccgacagcctcagcaaagaattgtcgtcgatggaagaaattgtgtctctccccgatctactccaggccgagccaagggccatcaacctccggagggcgataccaagcagaagaccgtcatccgcttcaaacagcaatcaaaaggaagcttctcctgtgaatgatagcattatgcagtcctatcacatcatcacagaaccaatcaaggatgcagtcactagaacaatgcccgctttatctctccaaaatcaaaatgagcagccacgcttgtggttttcagttcgctacctatcattgtgcagtcgaaagtttgcagcaatcatgtaattcataaatataatcatgtctgtaaacagtgagcttgctatgtttagagatgattcatgttgaggatacaatgtaccgatgataagcaccttccctttttgtttaaggcagtgccttgtattcgtgtgataagggagaaatgtgtaatacagacaagttctaagaggattcttttgaaagatgcggatatgtgatcatgtgtataattgtttactgacaaaggagacctagggtctcgtgtcagaggaactatattctaacctcgagttaataaccaacctgtggatggaaaagaaaaacaattaaactgtgttgggttaaaaagccaacgagacagtagttgaggataggagtttggatacgccttttacagatcaagataaggattgttggatgaaacccataagggtacctgccatgcctctacattgataagttcggatatacctgcaaacagttaagaagatccaggagacatcaatgtttgagaacatagtagtcgatggttggtaattagtctatcaagtatcagaagagggtcaaaggtgatatggcagaagaacaatttggatgctccccatctcgaggaagcactaaggatgatcatcggcaattaaaccctagtggtatagatacaaatagcaggcaatgtatttccctgaaggtagtcagtacagctttttgacgaaccacatcaaggtttcaccgaaaggcagcaagccaaaggacctcatcgtccccagaagcgtccgcaatccacattaaagaataccacctgttagagataggccgaaagatgattgataaaagagattggcaaagatgttctctagcatgaaagaagtaggccgaaaggtgattgataaacagaaacatgttctgcatcgctcaagggagacccctaattgtaattgccccgcaacagtcaccttgtcattaagtaagcaagatgacctaggtaaaagtgtttttatgaaggcaaagagtgaaatcttcaactcggtatcagatgctacacggagtgaaaagtgcaagcaccggttaccaggcaatgccatgacttgggaagatgatccaatgggaaagaacacatcaaggttaaaggtgtaaaggaatacgttgaatgctaactgaggacaacctgaagataataaggggaagtaaactgaatgtaaagaaagtgaatccgagttgcttgttcgtgagggctattcccagttatgaatcaagtgatatgttcgaagataatctacagaggtcagattaaaagcacatctaacaacgaagcctcagatttgacagggtaatgattagacaataacaaatccagcaataaagccattggagaagacgtcaaagtatgtcaagtgggataaattggttctcttgggaagcataacttatagttagagtggtcgacccttgcatcgaatagctgaagtacctagcaccggagaccaggaaagctaatatgagacagttgatggcaagttagaagtgaatgacaagcatgatattcttatgatgacaaacatagtatcctagtaatgacaagctagtgttgacgcatgacgtgaagtggtaacttgtctgaggttgactccgaagatatgaatcatgagaagttctggaacggaagcatcactgaactaccgcaacctagtctgagtcagccaaaaggtgcaccctggtccaagttaggtgaagagaagattccatccgcaacaggaggtcaagccaagcagttccgagtggtaaagttttgctggaagtttgtcaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagtcttcttttcccccccttcctctcttgggccggctcggcccaactccccctctctctctctcctctccccccccgcggcccatcggcctcccccgcgcgcgcgccgctgacaggcgggcccgcccgccgccctcgctgacgggtggggcccacctgtcatcgccttcctcccgccgctcccgccgctcgcccgtgccctagcgccgccgccgccgccgaatccgccgcatcccgccgtccccgcgcgccataatgaggggggaatcattccccgcgattccctctcccgattcccccgcttttccctctctctctccctcggattcgttcggagttaatcccgcaagtttcgccggcgtcttcaagggcggccgagatctccgcgcccgtttcctccctctccggccgcgctctcctcctcccggtgctatataagcgtcccccgtgctcttctcctccgtttccgccactcgccgcctctcctccccgtcggaatcgagcccgcaccgtcgcaccttctctccgccgtcgccgccgagctccggttcgccgccgtcgtcgctccggacctcctccccactcggcgtcacctccatcggcttcgccgcgtccccgtcgacctcggccacccctccgcttcgctcgccgactgccggagcaccgtcgccctcgtcgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccacgggtgcggctgacgcgtgggacccacggcgccgaccgccgccagccgcgtgctcccggtccaccgtggaccgagaggctgacgcgtgggccccactcccgtggacccggtccgcgcgccctctctctcggctgacgcaataaatgagtttttaattaaaatttaaatgaagaaattcgcaaatatccatttaaagagcatataaacttcaaatggccataacttggccatttgaactcggaattggaccgttcaagtctctaatttttccttaagaagtaaagaacccatttttgtgctttgtttctgttgttgtatggagtttattagagtaaaagcctttttcttttccgttggtcgtgtagacgctgcagcttcggaagatccgctcttcgtggaagtcgaagccgtcggttgggaaagcgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccatactattattgttattgttattattaccttgttcaccctagaataaacaaaaccccaactagtggacactctatttatggttccactagtatgaatttaggtagatgcttcgctgattaataggacaacattaggtggttttataactttagactttgggaattctcatatcatttggacactatggaatggttggcttatgttggaattggacacacacctccccctcttttcaaaacccccaaaatggtttaggctgggctcgaggtgcgtggttgggttttgttagtcgtacctcgggtactataaggattaagcttgggcctctgttgcaaagcactaccgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctacctgtcccgggtatcccggccgtaggtgggattgggtcggtactcttgtctatggctaggatgggttggaaactatgtcacgtctttcgtccgtataccgtggtggtatgtggcacgtggtcacacgtgaggaagatgtgtcttgtgggtaaagatgtacacctctgatcagagtaaatctattcgaatagccgagccctcggatatgggcaagcctagcaatgtacccaagtcagtgtttcaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaatgctgcttttcagcaaaacttaacccctatattattaccccttgtacccccttgcattaatcatgcatctgtcggtgtggcttgctgagtactgtggttgtactcattcttgctcaatcttttcccccttcagtaagagaagctttggagaagaagtcttaggtggagtcttggcttataccccagttgagcgcctgtgaagatggagccgtaggcccgctagtccgctgctgtttatttttgattgtcaggcctgaagcgcctttgtaataatgtaattattatcgatataataaagatgtgtcttttatatcatgtttgtgtggtgtaccccggcttttcctgggacggggattaatacactagcgttcgggaaaaggcaattttcccggtcgcgacatgccgccgccttgcgccccgcgccgccgctgccacgctgtcgccgcgccgcacgcccgcctgccgccgtgcaaccgtcccgtcgccgcgccgcgcgcccgtcccgtcgcgccgctgtcccgccgctccgcgcgccctcgcgcccgtcaccgaccgtcccgtcgccgcgccgcgcgcccgtcatgtcgccgctgccgccccgtcccgtcgcctcgcgccccgctcgccgcctcgcatcccgcgccgctgccgcgccgcgttgtcgtcgcgtcgccgtcgccgtcacacctagccgcgccgagccccgcgcgccgcc

SEQ ID NO: 16543 - DNA, 17263 bp, Oryza sativa
  unsure (1)..(17263): unsure at all n locations
gttcccgtgccgccgcgctgccgttcccgcgccgccgtgccgtcgctcatgtgccaccgtgccgccgcttctgtgccgccgtcgtcgtcgccgctgctgccgtcggtgagccgccctccttccccctcgcgtccaccgccgccaccgctcgggtaggagggagagccgagagagagagagagccgagagaaggagaggaagaagaaaagaaaccgagcgagggagaagccgaggaagagagaaaggagccgggagggagagaagaaagggaaaaagaaagagaggagagaaagaaaagaaaaggaaaagagagaaaaagagaaaaagaaaagggagaagagaaaagaaaagaaaaaggaaagggagaaaaaggaaaaggaaataaataggaaattagagggagtttggggaagtttagaaaatttaaaataattagaatttaattatagattaattatagtcgtagaattgcaaaatttaatataaattatggattattcttggtaatttctataagaaatcaattcgcggtagtaatttagatgtaattaataactaaacaaatagatgaattcttacagattattatagattatttttgggtaatccctataagtaatcgattcacggtagaaattcggatttaatcgctaggaattttagacgtatattatatttaatcgtttagtcatagactaaattaaattgtataatatttctaggatttcgtccaatatttagctcgtaatagaaatttctaacctattatatacaatgctcggggagagtaaattattgacaacgaaataattatacccgcaaagtagtttaaatcgaaattgggtttgccgtagtttgcagatagtaaagttaataaaaaggaatcgactttatttggatttatttggatttttatttgaattctaaccgaattcaaatcaatttttgcacgtaactatagagcccgagggagttgcggatccaagcgaaggccaagacccgcaagactttgagcaaggcaagtcatcactattccttgaacatgttgatcctaattgcgaaattgttttgtttacaaataaaattgcatgcaatgatgaacatcctacttgtgattatgccatgccttgattattgtttacccttaaaatccttgtacccatgattacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacaatgggacagccgttgaggtagggccgagaggcgtaccctacatcggtgtcgccattggtaggactgccatgagtgtgttagagagagaacttaacttgaaccataatttaatatgcgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatatgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggaggggatattgcatgatgaattttatgctgttggagccacttcctgagaggcgggaaggtggacgtcctcagaaaaccatgacgaatcaatggcgggaagctatccttgggatcacaatggatggtggacagaaccgtcgttgtttaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagcctcggaggatccctatgcctactatcaggagggagatgaagacgatggcgtccagtaggtcttagtacggtcgttgcctgtggcaatggcatgccgctgcctgaattccgctgccttatctatttctgcttttggatgtattccggacctctcggtccgatgatttaagactatgcctgcgggcctatgatgtaataattcgtattagacactcgtgtatgtgcacttgatattccagctatgaattcgtgtgtaccaaactacttgatccagggaaatggtactgtttacacgattgattcctgttataaaaacaggggtccacagcgcgccgcctcccgccggctgtgccggcgtggctgccttcgggcgcaccgtgcgcctgccgtgtggggcccggccgtcagccgcccgcgtcctcgggtgcggctgacgcgtgggacccacggcgccggccggtgtgagcccgggtgcgcccggtctatcgtggaccgtgaggctgccgcgtgggccccactcccgtggacccggtccgcgcgcccttcccctcggctgacgcaataaaccttttttttaattaaaatttaagtgaagaaattcgcaaatattcatttaaagagcatataaacttcaaatggccataacttggccatttgaactcggaattggaccgttcaagtctctaatttttccttaataagtcaagaacccatttttgtgctttgttacagcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggtttgattattgtggaattggtttcacacctccccctctattcaaaaccctcaaaatggttttaggctgggctcagggtgcatggttttgatagtagcacctcggccatataaggaccggtctgcgggcctctgttgcaaagcactaccgtacttccacatgtctagtgggtaaggcttagtttgtggctcagtctggttataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctacctgtcccgggtatcccggccgtaggtgggattgggtcggtactcttgtctatggctaggatgggttggaaactatgtcacgtctttcgtccgtataccgtggtggtatgtggcacgtggtcacacgtgaggaagatgtgtcttgtgggtaaagatgtacacctctgatcagagtaaatctattcgaatagccgagccctcggatggagatggacgaagtcgggggtcgatggacatctctaggacaaatgaagtctacacgagctgcggcccggtagtcgagatgtcatggcacagggccggtgtcctgctgctaggggctcagtcctgcctacctgtcccgggggtcccggccgtaggtggggttgggtcggtactcttgtctatggctaggatgggttggaaactttatcacgtcttccgtccgtataccgtggtggtatgtggcacgtggttacacgtgaggaagatgcgtcttgtgggtaaagatgtacacctctgatcagagtataatctattcgaatagccgcgccctcggttatgggcatgccgagcaatgtacccaagttagtgttttaaattcttaaaacctgcttaacaactaaaatgtggaatggttggcctgggttggcttgggacgagctgggacccagggtcgggttgccggttcggtctgaatcatcgtaggccttgggttaaggcaggttcgtgtgggttcacgaccttgtttaataatattgtatagctctgggatcgcgtttacaaaatagctttgagcaactaagtgtcttttaatgctgtttactgcaaaccctaaccctttatatcttaacccccttgtactcccttgcatttatcctgcacttgtgggtgtgtcttgttgagtatggtggttgtactcaatcttgctcaatttttcccaaacccagaagaggagcccctggaagataaaggctttggtgtctagctcgtgcctgctgtcaagcgcctgtggtcgtcgccctagtcttccgttgtttcccgtttgtctttgtgtgtgctgagccttcgctgcccatgtaataaattaactatttacgcttccgcttgataaactctgaaatgtatcaacttttggtgtaccttgcctcctgggacaaggaataatacacgcatgtaaggaacgcccattgggttaattccggtcgtgacaacttcctcaggagcgtaccgagccaacttgttgaacatacttaggtactcattgacactgctgttgccttgcttaagtctgttgaattcatctttcttcatgtcaatagtgctttcaggcacatgagctgcacggaaagccgtagcaaactcatcccaagcaatgttagtgggttcagggtgtgcattgcagtaattctcccaccaatctgcagcaagtcctcttagctgttgagaggcgtagagcgtcttctcaaccggagtacactgcactaagttgagttttctatcaacatctttcagccaatcgtcagcctcgacagtctcgacggtctgagagaactctggcggacgagacatcagaaaatctgtcagcttggatctattgttgctcatgtgagggtggccatttccatgcgcattatgctgaaaaccggctacggctgcggctaatccttgcaagatttgtgtctgaactgccatcaggtgctgcatgttgttttccacatgaggtggggaagggaggcgttcttctccagaattgtgactggcagggcggtgagagcggtgagactgttccatctctgcatcacgggaagctgtgcgatgcgagcggttgctgcggcggggttgctcaacttctgcgttgcgggaagcagtacggtgcgaacggttgctatggtgagactgctcattagctgactcatgattttcttctggctcaactctaccttcttcaaaaccgaagcaggctggtgcacgagctgcacggcggggacggctagccatctaaactcccagaagagggcggggtaagagtcagataagcacttaggagggcaaggagcaaagtaaatagcaactcagatagcacacacttggcataaactggatttttcaaatcataaaaacacctgatacaacgggtgtggacaagtcacagagctacgccgagcttgactgtgcgcacaccacctaggagaaccagactaccaaacaacacccacaacaacacacgcacgcactacctcgccacgactccaaaagagttggcggcggaacaaaagggcctaacacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtgggggagctgggtagtggaaacggaacacggtggaagaaccaacaacacgcttccgcgcagtgcggataaagcataggccacagcgggaggaagcaactggggtgtgtccgggggtgtaggaagggctaactgggtgtgggtagggggagtacactggcgagtacggcgcacgcgagctgggggagcgcgggccactgggagtgcgggcagagccacgggagctgtgggaggacaggtggctggcgtgacagagacggcctaagtcccaagagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgcgtggccagaaggaaggcgtggaagctgccgaaaggcggagcccccgagacggtggctgtagtcgtgggccaggcgacgaagcgcagtccaggagaggtcctggtacgcgatctggagagtgggcctggccacagtgaagtggtgtgggcgaaggccagctccgtgtatacctccacgggggtaaaggtacacagagagctcacagtgagggggaacacggtccatggagtaccccgtgtactcgggacacgagaagccaaggaaacgggcgaggtcacgaagctgagcgacgtggtgaccctcaccaaaaccgtgggaactgaatctggcgttcactgccatctacaattttgaaagagggaggaaaagatcagtaacaattttagaaacaaactattggaaataaagaaaacaaaagaaaccttagcttttcgtaagtagttttgaacttagtatccttagggtcgtcctaagcgtcgggtttcgccctagggccaagcctatgctctgataccatctcttgtcacgccccgaactagtcctgaccggaactagcccgtgacgctccaaattaacctgttattcgataccagtcctaggaaacagtgctggtatcacaggaagacagaatatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactcctcatcagccggttccgcttcatcttcttcagcaactgggggggggggattatttatatagagcaagggtgagtacgggagtactcagcaagccatgggaaataggtgtttaatgcaggcttcaaggaaaggctgttgtttttgcaattgatttttatttggacccttttctaaaaacaactaagtgagtgcttctcaaacgacgcggatgagacagtgcgtctcgtccggtcggagtatgtgcaatgtatcagtctttagaattgaatcaaggttggcacccggctaatagcttttcaaacggccacccgggccaacaacttttcaaacggccacccgggcctagctgatcccatcagctgctgatttttcaaacatcgaacccctttccacaacagcaatttcacaagcagtagtcaaacaaaactacgctaggaatcacctcacatccacccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcaaatccacatgtctctcggcatcaaggctcccctgataagctagttactcagccaggggtgtcccattccacccatgtggtcgtacttgacttatgtttggatgaaattccaaggaaacggtccttaagtgcaagagcgggaaaccgtactcccggtacgttccccggtccgcggttttggaaattcatttagttcgcaagcaccgacccaggtgtcgggttttccaagtcttttgtaaaacccaagttttacccaagatgttttttcagattttaagtttgaaggcgatcgtcgatactcgtgcagagtgcacgatttccgaggggcaactgggtggttacaagggaacatggtatgacaattaacagaggaaggatcaaatgcaacaagctaggtaggtccgccaatctgccttgcagacaggacaaacagattaagtgcgatcctatcaatgcataatatttttcaagcaacataattaagtttcaaatataggctaaagatgttcaaaggtggcttgccttgctcgagatctggagcttaatcctctaaatcctcgcactgcgggtcttcgggctccgaaactacacacgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaataaaagaaaagaaaagagggagggaatatagacttttctcgggcggctagggtgcggcccgagagaattggggcggtccggccgagctaaatgggccggccggcccaaggcggctcaaggtggcccaaggcgcgcgctcgcgcgggagggaggagagagagagccggtggaccgggctcaccacgcgtggtcccgggtgggacccgcttgtcggtgattcggttcaccgtgcggatcaagcacgcggcacgcgcgcgcgggcggggctgggacgcggtgcacgcgcgcggttcgcggaggaacggatgcggcgggcccacgcgcagcctcacggctcgcggtggaacgcgcgcacgggaggggctgaccggggtcagcccgacccgatctcggccgagctggcgccgacgtggcgcctacgtggctgccacgcgggccggcgggaggtagacgacgacgccggccggaacggacggcggacgacagcggcgagcggcggagcgaaccacggcgatacaggcgaaagcgagcacaccgggtggttgcacgagacgaggggagacgagccaacggctcggattcgccggaggatgcccgacggcggcgaattgcggcggcggcaaccagcggcgggagaagggggaaacggcgacgaggtcacgaggggccgattcccggcggcgagagcatctacacggctatgggaatccgatgctagcgtcggattgggcggagctacgccgagcgaggccggcgacgagcgggtgctacggagctcgggcggcgacggcggcgagcacacggcgagcgacggcaacggtcggggttgcgccggctagttacggggaggctactcgagctactaccgaaaactaagggggggagatggagcgaggaggaagaacggagggaggcactaccgagatgaggaggggcgctgtgacgagaggccgacggcgcgggagtaatctctccggcctcgggccggggaagaggaggaagacgagcgcgcccggagtccccttccgcgtccttgctcgtgccggctcctccgacacgcgcaacaacgaacggcgacggcgaacagagcacgggaggcggcggcaatggcatggaggcgaatgggagaggaaaggaaagggggaagctcgggtttataggatggcaatgtcggtttgggaaccgacttagggcggtcaaaggagagggctagcgctcggcggtcgcggccaaagcggcgacagggaggagggaggaggatgacgccggcgggaggaaaaaggggaaaagagggagagaaaagggggcttgtccccttgcctcttcgggaaaaggaggagggagcgggggtgacgcggcagagggaggaggagctctgcctccgtcccttggcagcttgtgcgcggagtggcgggggccgggcgatgacgacggcgatgacggcggggcggtgtggagcggagcggcgacacgagcgacaggcacggcagaggctgacggcggcggcgaccaggcggtcggccaccacggcacgcgcgcgcgggaaacaacgggcggcgcggacggcgcaggcgcggcacgcgcgctggctcgcggggtcgagcggctgcgcggcagggcagctgggccgggtggcgcagacggcgcaggcgcggcacgggcggcgaccacgcggctctcgcgcacgcgcgggcagagcgagggaggagggctcggctcggcgcggctcacccccccccgcaaaaaaagcccgagaggagcgggncgcaggnacagcacccanccagagcnagnnccgccgccgnngcanaggncccgcgcaccgggggagatgggccgagataaattcggcccatcgaccccgggggaggcaaactagacttttgcggaggaatttgatttggaagggtttggattcggaattgaactcgacgatagatcggggatttgagatcttgagatggcacgagcactagacaacaagcaaagaaacaaatttcgcaattaggtttttaagagataattttcccgctaggcgccacgacggaacgggcgctacagaccaacccccctaacaagaatctcgaccccgagattcagtacctaagggagcagctccgggaactcggcgcggagaagatcttctcgctcccaggttgcctcatcttcagaatggttgctccattggactttgtagaacttgatggtcttccttcgagtctgacgttctgcctcttcaagaaccttgatcggtctttccttgtaggtcagattcttttccagctcgatattacccagggggacttgctcttctggaactcgaagacatttctttaactaggatacgtggaacacgttgtgcacatctgcgagacctttaggtaactcaagctgataagccacttcgccacgtctggtagttatgaggtaggggccgatgtagcggggtgctaacttgccggacatcccaaaccttctcataccacggaggggtgatacccgcaggtatacatgatctcctttttcgaactcaaggtcacgcctccgattgtcagcgtaatttttctgacggttctgcgctgtctttaaacgttctcggattagcttaacttgttcttctgctgacttgagtatgtcaggatcgaataccagcgcttcgcccacctcattccagcacaagggagtgcagcactttcttccgaacattgcctcatttggcgacatctgaatgttggcctgataactgttgttgtatgagaactcagtatacggcaaacaacgatcccaagtgccttcgaaatccagggcagacgcacgtagcatgtcttctaggatttggtttaccctttctgtctgaccatcggtctgcggatggtaggccgtactaaaatttagatcggttccgagggcttcgtgcaactgcttccagaaccttgagatgaactgagtgcctcggtctgacacaatattcttgggacagccaaatctacatacgacatgggtcatgtagagttctgctagtttctttccatcaaaggtggttttcactggcacgaaatgagctgatttcgtaagtcggtccacgattacccaaatggagtcgtacccgctaggggttcttggcaaaccggtgatgaaatccattccgatctcttcccatttccactcgggaatcggtaggggttgcagcagaccagctggcctctgatgttctgccttgactctttggcaaatgtcacacaaggctacgtattctgcgacatctcgcttcattccagcccaccagaagtatgccttgatatcttggtacatcttcgtacttcatggatgaatggagtaggcggactcatgagcttcctttaggatgagatctcttaactccttcttggccggtacacagatgcgtggaccgcaccaaactgtgccttgttcgtctatggagaaattggtgtctttcttctcctgtattctttttattaactcttttatcccttcgtcatctttctgagcttcccggatttgcgactctagggtaggctgtactgtcaagctggcagggacacctgactgtaccacggtcagccttaacttctccaattctctgcacaggcgatcttggttaggccgtatttgagctacattgcaataggccttgtgacttagcgcatcagcgaccacgttagctttaccggggtggtactggattccaagatcgtaattcttgattagttccagccatcttctctgcctcatatttaactcggtctgagtgaagatgtacttaagacttttgtgatcggtgtatacttcacatctgttcccgattaaatagtgcctccagatcttaagagcatgaaccacggctgccaactcgagatcatgggtgggataattgacttcatgaggcctgagctgccgggatgcataggccacaacctttcgttcttgcattaggacacatcctaagccttgtcttgatgcatcacagaagatctcgaaatcttttcggatatctggcaaggtgagaactggggcagtggtcaaccttttcttcatttcttgaaagctgtcttcacaggctgtagaccattgaaatttcttttccttctttaacagctcggtcataggtctggctagcttggagaatccttcaatgaatcttcgataatatccagctaagccaaggaagctgcgaatctctgacacattcttgggcgggttccaagcaagtacagcttcaaccttgctgggatctacttcgacaccgttggaggagatcacgtgtccaagaaatgctactcggtctaaccagaattcgcatttcgagaatttagcgaatagttgatgatctctgagcttttccattatcagcctcaggtgttcggcatgttcttcctcgttcttggagtatatcaggatgtcatcgatgaacaccatgacaaactggtccaagtaatccataaagattttgttcattaagttcatgaagaacgctggggcattggtgagtccaaaggacatcactgtgaactcatatagaccataacgcgttgagaaagcggtcttcgggatatcttcagatctgatttttagttggtggtaacctgatctcaagtcaattttagagaaaactcttgctcctttaagttgatcgaacaaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactctccaattcttcgatttgtcttttaacttctgctaactcattagctgccattcggtagggtctttttgcaattggtgcggtgcctggtgccagttctatggcgaactcaatctctcggtctggtggcatactcgttaattcttctggaaatacgtcgggatattcacagactatgggcaccgactccaaggaggtgacttgtaaacaggttaggatagaccgacttgcggtaggagtgttagaggtaaagcggacttgctttcctccaggtccttgcaaggtgatggacttttcggcacaatctatctgtcctttgtgcttagccaaccaatccatccctaggatgatgtctaagctttgtgagtctaggactatcggtttggataggaagtcaacttcctcaattctaaggttaacttccgggcatatttgagttgcccttatattcctcccaggggaatgtactatcattggtacacgtaaattttgggttttccaaccatttcttttcacaaaagcttgtgatatgaaggaatgggaagctcccgaatcaaacagaactattgcgggtacggagttgacagagaacatacccatcacaacgtctggagcatcctgagcggtctcagcttgaatgtggttcacccggcctcgaccaaagttgttggaagcacgtgaaccttgtccacttgcctgagagctaggacgagactgagctgccactggagtaggagtcctggcagtgctgccattagcatgccctgagttggtgttggtaggattctaagggcactgtctggcatagtgacccatctggttgcactggaaacactgaactgctgacggtccctgcggtgtcttgaaagaggtaacactgtttggcgcagtattgccactaggggcacgctgctgtggctgaggtgccggacggttcatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcatcaagtagaagtgccttgttgatcatatgttgaaaagtgggaaagtcatgagcgagcaactagagtctcattccaactgcgatccctttcaagaacttcctgatcttcttcttgtctgtgtccacttctgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaagctctaaaaaaatcccctttccctccctctccctcttgggccggctcggcccatctccctccccctccctctcctctccccgcggcccatccggccttcccccgcgcgcgcgccgctgacgggcgggcccgcccgccaccctcgctgacgggtggggcccacccgtcatccccttcctcccgccgcctcgcccgcgccctagcgccgccgccgccgcgaatcccgccgcctcccgccgtccccgcgtgcaatcaataggggggaattattccccgtgattccctctccctttccccccacttttccctctctctctctcgcgttcaaacgggcggatttgcccccgcaaatctcgccggcgccattgatggcggccggacctcccgcgcctattccttccccgccggccgccctctcccccttccaaccctatataaaccctccccgcgcctcctccgtccgtttccgcctctcgccgcccttcctcctcgacggaatcgagctcgcgccgtcgctctctctctccgccgtcgccgtcgagctccggtccgccgtcgtcgtcaccccggaccatctcccaccccggcgtcgcctccttcggcttcaccgcatcctcggcgacctcgtccacccctccgtttcgctcgccgaccgccggaacgccgccgtccccatcgacccgagccgcgccgccgccttcctccactacggctgcctttccgtcgtcgccgtcgacctagggtgagccgtggaccgccgcttcttttcccccgtcccttcccctctctcggccgccgctccgccgtgcctatggccgctgccggcgaccataggggcgcgggcgcgtgtaacaccctgaaaattcgaccgacaaaaccaaaactctaaaaatacggattttcaaaaactttttaaactaattgcatcatgccaatcttattcgtctattttatctggagttgatctcgaagattattaatcgtgagtaaagaatagctaattagaaataaaccttaaaaacaaattggtaaaataaatataaattaaaaataaagattaggtgtggatagtaataaataaaatattatcgcgaccatgtttggatcaattaaatttcattgcgatggaataagaattaaccctaattaaagctcaaataaattatataaaaataaaatatgagtaatattaatctagggtgaattcattagttaagataacacgaatattgagtaaaatgcatatatgtaaaattaggaattgtggaatcaaatttagatggaaaatacactaaaatcgggataaataggaaaagtcactgttcattgcgcctaaggtgttcgatgtggtccctagccttccccctcctctcccacctctgcccctagccgccccgagaccgtccatcgcggcgccgctgccgcgccgcgtcgccgtcgcgtcaccgtcatcacgcgccgtgcgccatcgccgtcgccatcgttgccgtcggcctcgcgccccgtgccgccacctcgagccccgtgccgtgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagtcttcttttccccccttcctctcttgggccggctcggcccaactccccctctttgtctctcctcgccccccccgcggcc

SEQ ID NO: 16544 - DNA, 615 bp, Oryza sativa
ggatgtttccttttcaggcattgacaccccacatgcaaacactggtgaaagatatatcaagtccaaaggctgggagtttgttgggacctgctttgggtgatcagcaacaagggaacttctccattcatctttggaaaactgctttccaagatgccttcagcagaatatgtcctcttcgtgctggtggacatgagtgtggatgcttaccagtgttggcaaaactggtatgtttaatcattgatatttaatttgagaagaataatcatttttgtgaagtttatgcatgagttgttttattattgtcaggtgatggagcactgtgtagctcgtttagacgttgctatgtttaatgcagtcctgcgtgaatctgcaaatgaagtaccatctgatcctatatctgacccgattgtcgactcaagagttctaccgattccagctggtgacttcagctttggatcaggtgcacagctgaagaactcggtatgtgcccaaattgcaaaacaactacgttcttagtttaaaaccacttacgttggaacgtttcctgtaactgcatgaagaacaaaccagaacatgtgttttaaatcatctcttccttgcaaacaaaaccaaatg

SEQ ID NO: 16545 - DNA, 730 bp, Oryza sativa
tctcccggctgaaacaaatatgccctattttccgatacctgattagttggtgtggacaagtaaccctgaatctggactgtcgctctatttaatcctcttatgttggcccttctgcatcatccagcaaggctcggaagtctgagctataaggtctagttgacgtataagaggccttcgatatgttaagggagagaggggagagtcattttagagttgggtgggaatcgttgatagaaaatttttttccctgaggtatgatagcgtctgaactaaagaaagggaatatggaaagtgaatgtggtaaaggataccaagagccctgaatgatttttaagcgtcttttctttgaacaaataaatctaactctctcaaaaatataagtccatctcctagagacttatatttttgagagaggggctaaagtttagcccctctcttccaaacaccccatagtgagggagtaaacaaaattaaagtatgtacatcgacgtgtgaaagtcctcgcccgacttaaaaaggtcaaagtacgtaatctccccccaaatagaaactcttagaacttggacgctcctactttgacccaagccccagcctcctatttgattttgcaatcacggaggttggggatggcgatgtgtcgaaagattctagtgttctgctcgcataatagcacccaaacgatgagggtctatattctgaattttcgtccaaagattgatgaattgtcaca

SEQ ID NO: 16546 - DNA, 1331 bp, Oryza sativa
  unsure (1)..(1331): unsure at all n locations
cgatgactgagccggttttgaaaccctaggccagtatatgctccgaagatcgtctctttgacagaaccgatgagaattgagaaaacgccaaagctgtgccggagataacaatagtataaatcttgaagtggcgttgccactttgtttcattaatctctgcaggttaaacaagacaaaaacaacaaattaattaggcaaccgtctcgcgggtttagcccggccccctactaccagcttattatatctcgcctccacgtcctcgtcgctcacaacgcgacacactcccaagcacacacacagagcgcgcgcgcgcgcgcccatgcagcagcagcagcagccgcgcatggcggacattgacctcgacgccgtgcgcgccgtccgcgtgctcggccgcggcgccatgggcaccgtgttcctcgtcgccgcggcggcggacgacgccgccggcggcggggcgtgctactacgcgctcaaggtcttcgacaagaggtccgtcgtcgcgtcggcggcgaggcagggggacgcggcgcggcgggcgaagtgggaggtgtcngtgctgtccgggctcgcgcacccgcacctcccgtcgctgctcgggcgcgccgagacgggcgacctcgtggcgtgggccgtgccgtactgccatggcggggacctcaacgagctccgccacgcgcagcccgaccgcgtcttctcccccgcggccatcaggttctacgtcgccgagctcgtctccgcgctcgccgagctccacgccgccgggattgcgtaccgcgacatcaagcccgagaacgtcttcttccgcgccgacggccacgtcacgctgaccgacttcgacctctcccggctgctcccgcccgtctccccctccgcgtccacctccacctcgtcgtcgtcgtgctcggccacgtcgtcgccgccgccgcagctgcagggacatggccggagccagctgaggcgaatcttcgcgagaagtgagtcgtcggtggccgcgacgacatcgacgtcgtcgcccgggcagtacacccacaacctggcctggttcctcaagagaagcgacggcggcggcggcgccgccgaccacctcaagaaggcgaagtcggcgagggtgtcgccggtaagccgcggcaagaagcaggcgagcttctgctcggccgcgagcgcgagcggcggcgccgccgccgcgtgcgagaggtcattctcgttcgtgggcacggaggagtacgtggcgccgaaggtggtgcgggcgaggggcacgagttcgccgtcgactggtgggcgctcggcgtgctcgtctacgagatggcgtacgggaggacgccgttccgggg

SEQ ID NO: 16547 - DNA, 554 bp, Oryza sativa
agctaaccggccttagaggttgcgtgtggcatgagcaaacgctacatcggtagtcgagccacgcactatgtcctggtgtacccctctcggcaacatggtagcagtgggaagcattgcaccgacggccgtacatgcaataaaaaatcatgagaagattagtatacgttagtaattaatctaaatatataaattacaaggaggttaggaaccggcagcacagccaaatcccatcactcattaaggaacgattttttgatctcgattgccatcctgtgcatgcgaccaaccatcgctccagtatacatgcaaaacaaacagatatagtttgattagccttaaaatattacacgcttaattgtgtaatgcatatatcaagctagggtttgatattaacccgtgcatatcagttgatcaacacatgcacgtgaagcactcagtcgctgttgatcccatggacatgaattgtccccgtgtcatatgaaggttacgcaagcacctgtacagatcgtaccaggtgacgagcagacacaccgggagttcgtctcgatctcagc

SEQ ID NO: 16548 - DNA, 17189 bp, Oryza sativa
tttaaagattagattatggtgataaatgaagtagcaggacagagagagactagaggattttcacaaataaaaaaggatttttatttcgaaaatattgctaaggcttgggatctaaagctcgttctagggtcaagggggctctgataccaacttgtcacgaccagaaataacccaacgggcgttccttacgtgcgtgcattattccttgtcccaggaggcaaggtacaccaaaagttgatacaattcagagtttaacaagcggaagcgtaaatagttaatttattacatgggcggcgaaggcccagcacacaagaagacgaacgaaaaacagcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgcagaataaatgcaagagagtacaagggagccataatatagggggttagggtttgcagtaaatagcactaaaagacacttagttgctcaaagctattttgtaaacacggtcctagagctatacaatattattaatcaagaccgtaaacccacacgaacctgccttaacccaaggcctatgatgattcagaccgaactggcaacccgaccctgggtcccagctcatcccaatccaacccaggccaaccattccacattttagttgttaagcaggttttaagaattaaaaacactaacttgggtacattgctcagcttgcccataaccgagggcgcggctattcgaatagattatactctgatcagaggtgtacaactttacccacaagacacatcttcctcacgtgtaaccacatgccacataccaccatggtatacggacggaagacgtgacatagtttccaacccatcctagccatagacaagagtaccgacctaaccccacctacggccggaacccccgggacaggtaggcaggactgagcctctagcagtaggacaccggccctgtgccatgacatctcgactaccgggccgcagctcatgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgagggttttgaatagagaggaggtgtgaatccaattccacaatgatccaacaattccatagtgtccaggtgatgagaatattcccaaagtctagagttgtaaaaccacctaatgttgcctaattaaccagcgaagcatctacctaaaatcatactagtggtaccatgagtagagtgtccactagttggggtttggtttaatctagggtgaacaaggtaataataacaataacaataataaggtcataacaaaggtaaataggcatggctagataaaacagtgataacgcgggaatttaagtaaagcgataatgcaataatttaaatcaaaataattttataaactgggattcaatatgctcaaggatgatgtgacttgccttgctcagagacaacggccttccgaaccttcggcgacgaccgcgaaccacgcttcgggaacctcaggaacgacagaagctacgcgaagcacacaagcaaagctacaaacctataaagaagcaataacaatacataaaaagaaagcacagggttctttaggttataacaaacgttaagagacttgaacgggtcgattcggagcttgtatgaccaagacatggttatccgaaatttaatgctgttatatggtgatttgcggattattgtaattatgttttacaactataaaacatgagcaagcgctagcctggaaaagacaggaaggctgcgccgttgacatgcggaccccacatgtcaacctaaaggaccacggtagaccgagtacacagagacggtccacgggtcgacggaagcggaccccgtgtgtcaactgaggcgagtggccgacaaacggactccactagacaccacgagggctgcacacgagcaaaccacgcggctaccgagcgcgcacacaaacacggtcaccacacgcacaagcgaacgactaccgacaccggtacacgggtaccggggtcgacaaccacacaacgggtacggggcgacaccgaaaggacgaggacggggcagcgagagaagagattcttaccaccacccgacgaggcgagggaacgacaacaacgaacgggcgcggcggagacggccgggaacgacggagacgaaaggcgaggggacgacttcggcggcgatccttggacgaaggcgagacgcggccggcccaacgcttgacgacgcggagccgaggacgaagacgacgacggggctgcagcggctcacttgacagaatgcggacgatgaacgcgaacggcttgacggagggacgaacgccacgacgatgaggatgacgaccgggaccggcgaggaggcaacgagggcagccggcggcagcttcatggagacgaggatggcgcggaacacgccgctgcgatgacgacgatggtggcggcgcagcgagacgacgagccggcgaggacgaacgaccgaccggaggagtcgtcgacgaggacgaacggagacgacgataacgaacaccggcggggttcggatggaggggaggcgaggccgagggcaaccttgacgctgtgatgccggaggtggagatggcgacgtcggccggcgcacgggcacagcggaagaggctgccgaaggcgacgtcgacaaggaggaaggagaggccggcgcgggcgacggcggtctccggacgaatcagagggtaggccggggtggaggtcgacgcggcgacgctgagggaggagacggcgcggccgacccacacctgagcggcacggcaggggcggctagaggcagtgggtggcggcaatgccaccggttgccggcggggacacgcctccggtggtttccccgtgaaacggaggtctgaccgggggagaggaggcggctgcgaggccgaacgcggcgacggcgcgaccggacggtgctcgggcgaggagggagaggcggctggaggccggttggcgccggagcgagagaaggagaaggcggggaaaggtggagaggccacgggagagcgcgggagggggctaagacgatagaacggagcgaggagattccgttttataggggaggagagggagccggccacgggagaggcggggaacggcggcggaattcatggccggcggccatggaaggtggccggggttggcgcgggcgttcccgacgattgggggctcgaatcaagggggaaattggggggaattgaagaggaaggaaaggggattaattccccctaattaatttggaatgagccggcttgaatggggcggatttggaggaggaacgtctctaggtttgcacgggagagagaagaggccgtgcgggaggaaggagacgaccgaggtgggacccacgcggcaaggcgcgcggtcagcgcgcgtgcggcgctcgtgcgcacgcggctagggcaggagggcgctgcggctcgggcaggggcattgcttgggccaggcggccggcccaggaggagaggagggagtggcggcctgggagagagagggaggaggagggagctgggccgagggggggaggggaagggcggcccaagagagagggagggaggctttgggccagacttggcccaaagggaggagggggatttatttttagtttttctttttagtaaactttgttaattgttgttgttgcttaagaaatattttcggtgctctgaaaattcaagtaaaatttgagggctcattttagaccaaggagaatttaacgaaaattctctaggccacattcgaatttttcttgtacgtattttagtgtttgccaatttcttttcgaattttaattaattatattattccttttagaaaatgatttttatttggggatgaatttattaggacgtgacataccacaaccatgagtacacaccgatccatcaaacaataaagtccatggcactatttcaaccgagccgactaagtcatcacgatgttccacaataaaatcagctattgcttgtccttaatcgccttcggcgactcatacagaagatcaaactcggttaaggaaaatatccactttccaacccttccttttaatttttgagccgatagcatgtacttgacaacgtcggccttgcatataacactacactcgttggacagtagataatgcctcaaccttggacacgaaaaatacaaacacacgcataacttctccacaggggaatatctagtttcagcatctaagagccgacgactgagatagaatacaacgcgttccttcccttccaacgcctgaatcaaagactgagccgattgacttctcaccggccgataaattcaacctaaacggtattcctttctgtggaggaatcaaaacaggaggagagctaagatattccttaatattatccaaagccttttgctgctctgccccccaagtaaactgctgatcggctttcaatctcaacaatggtgtaaaaggttctaaccttctagacaaattagaaataaaccttctaacaaaatttatcttgccgatcatctcttgtaattctgtcttattctctggaggctgaatcttcttaatcgcattaacactcctttgagttacctcgatccccctctcatgaacaagaaatcccaaaaactggccagtcgatacaccaaaagcacattttgtcaaattcatcttcaggccatattttctggttctctcgaaaaccttcctcaaattagctatatggtcctctatttctttagacttaacaaccacatcattaatgtagacttcaaccaaccagccgattagatcatgatatatgtaattcatggctctttgatatgtagctccagcactcttcaagccgtaagtcatgacaacccattcaaataagccgattgcaccaggacacctaaaagctgtcttatgaatgtcttcttcggctataaaaatttgattgtatcctgcgtttccgtacataaaactcaaaatcttatgtcccgaagcagcatccactagttgatcggctattggcattgggtattcatctttcggggtggccttattcaaatttcggaaatcaatgcataccctgaccttgccgtttttcttgataacaggaactatactagaaacccactcagcatatcggcaaggacgaataaaaccagcatcatataatcttttaatctcagccttgaccggttcaagcatgtcggccttgcatctcctcggaggttgttgatgtggcctgacccttggtttgataggtagccgatgttcaacaatcgatcggctgaatccaggcatctcataatattcccaagcgaagcaatctctaaactcttttaagagctctatcagcttggttctaaacactggagataagttcttactaataaatgtcggccttagccgatcgcctggacctatgtctacttcttccaaatcatcggccgacatgaaaccttgatcttgcttgttatcgagatcatctaccgtgttcttagtgtagagatttgaaccctccacgatgccctcaaaataatagcttgggttctccatcttcaattggctgtatatcagaatcggacacttttagaaaatccccatcccagacttttccagatatacaatcaaggccatccatctcccaaagagctaaatcggcactggcaacattaactgacctgtcggctggcacgatctctattttgtcgccttgccactgaatcaaacattgatgcatagttgaaggaatgcaacaattggcgtgaatccaatcccttccaagcaacaagctgtaagaacctttcccatcgatgacaaaaaatatggcaggaatagtcttactgccgactgtcagctccacatttagaacacctttggttttggatagattgccaccaaaatctttgagcaccatgtttgtcttgatgagatcctcggcatttctacccaacttcctgaatgtagcatagggcatcaaatttaccgtggccccaccattaaccatcatttagacatcggcttcccattgacgtagccatttatatacaatggtttaagatgccgattctctgtcccctcgggtttctcgaacactgcctgttctggtgacagaaccaacttagccgattcctcttccacctcatcgacatcagcttgatcgatcccgaatttggctggcagggtaaagaccatgttaaccggtgccgtcacaacactcttcccttttgccaacctctttgcctcatcggctgcaacatcatcagctacaggaacttgattcttaacacgccactcctgccttggctttgctttctttagccgatgattaatttcttgttcaaccccctaaaggcgctccctgttcctcaatctttgaacccttctcttctgattcttcgtgaaaataccagaaggacaccattgattcttcctaatcacattgtccttgtcgatatgcttagtggccatgatcttgattaattggacccaatctttgatgaacagaaactctcatctgccttagccgattgctcctattatatgatcggccggagttctcgatgatatcactgcacccagggcagttttcaatagatgacaacctcataccttcattccagcagaatctaaagaactcacaaccccaatgaggatcaaaaccatcatcgtatttctcatgatgcttctcctgctgcttgtcatacttcttccgatatttcttgaaaatcttagccgaattcacctgaaaaccccttgcatgggccctatcggctgcttggccagctgtatgcaccatattaacaggaaaagggttaccatcgaccttcatcggctttttggaatcatcaaacctaatcttgcctccctcaatgaccacctgaatctgctgtctaaaaaccttgcaatcgttagtagaatgggacctagaattatgccatttgcaatacctctgtttgcctaattcctcagccgatggggttgtatgaccagcagtgtcacgaccggaaataacccaacgggcgttccttatgtgcgtgcattattccttgtcccaggaggcaaggtacaccaaaagttgatacaattcagagtttaacaagctgaagcgtaattaattaatttattacatgggcggcgaagacccagcacacaagaagacaaacgaaaaacagcagaagactagggcgacgaccacaggcgcttgacggcaggcacgagctagacaccaaagccttcatcatccaggggctcctcttctgggtttgggaaaaattgagcaagactgagtacaaccaccgtacttaacaagatacacccacaagtgcagaataaatgcaagggagtacaagggagccataatatagggggttagggtttgcagtaaacagcattaaaagtcactttgtaaacacggtcctagagctatacaatattattaaccaaggccgtaaacccacacgaacctgccttaacccaaggcctacgatgattcagaccgaactggcaacccgaccctgggtcctagctcgtcccaagccaacccaggctaaccattccacattttagctgttaggcaggttttaagaattaaaacactaacttgggtacattgctcagcttgcccataaccgagggcgcggctattcaaataggttatactctgataagaggtgtacatctttacccacaagacacatcttcctcacgtgtaaccacgtgccacataccaccacggtatacagacggaagacaggacatagtttccaacccatcctagccataaacaagagtaccgacccaaccccacctacggccggaacccccgggacaggtaggcaggactgagcccctagcagcaggacaccggccctgtgccatgacatctcgactaccgggccgcagctcgtgtagccttcatttgccctagagatgtccattgacccccgacttcgtccatctccatccgtgtacttttgtttataaccagactgagccacaaactaagccttacccactagacatgtggaactacgatagtgctttgcaacagaggcctgaagaccggtccttatatggccgaggtgctactatcaaaaccatgcaccccaagcccagcctaaaaccattttgagggttttgaatagagagggaggtgtaaatccaattccacaataatccaaccattccatagtgtccaggtgataagagtattcccaaagtctagagttgtaaaaccacctaatgttgccgaattaaccagtgaagcatctacctaaaatcatactagtgttaccataagtagagtgtccactagttggggttttgtttattctagggtgaacaaggaaataataacaataacaataataaggtcataacaaaagtgaataggcatggctagataaaacagtgataacgcgggaatttaaataaagcgataatgcaataatttaaatcaaaataattttataaactgggattcaatatgttcaaggatgatgtgacttgccttgctcactttcccaaacgtcggcttcaacctccacgaagagcggatcttccaaagctgcaacgtctacacgaccaacggaaaataaaagggcttttactctaataaactccatataacaagcaggaaaaaagcacaaaaatgggttcttgacttcttaaggaaaaaaaagagacttgaacggtccaattccgagttcaaatggccaagttatggccatttgaagtttatatgctctttaaatgaatatttgcgaatttcttcatttaaattttaatttaaaaagggtttatttcgtcagccgaggggaggggacgcgcggaccgggtccacgggcgtggggcccacgcggcagcctcacggtccacggtggatcgggcgcacccgggctcgcaccggccggcgccatgggccccacgcgtcagccgcacccgagggcacgggcggctgacggccgggccccacgcggcggccactcggcgcgcccgaaggcggccactcggcgcggccggcgggaggcggcgcccgcgcccctatggtcgccggcggcggccgagagaggggaagggaagggggaaaagaggcggcggtccacggctcactctaggtcgacggcaacgacaaaaaaggtggccggagcggaggaaggcggcggcgcggctcgggtcgacggggtcgacggcgttccggcggtcggcggactcggcgagggggtggacggggttgacggcggtgcggcgaagccggttgaggcgacgccggggcgggagacggtcccggcgagcggagaaggccagccggaggtcgtcggcgacggaggtcccggcgagagggcgacggcacgagctcgattccggcggggagtgggtgcggcaaggggcggaaacgggcgagggaggcacggggagggtttaaatagggttggaagggggagagagcggccggaggggaaggaaaccggcgcgggaggtccggccgccatcaatggcgccggcgagatttgcgggggcaaatctgcccgtttgaacacgagagagagagggaaaaatggggcgaaagggagaggggatcacagggagtatttccccccactttattgcacgcagggacggcgcgatgcggcggatttggcggcagcggcggcgcttggcgcgggcggagcggcgggagcggcgggagtggcgggaggacggggatgacgggtgggccccacccgtcagcgagggtggcgggcgggcccgcccgtcagcggcgcgcgcgcggggagggaggctgaataggccgcggggaagaggagacagagagggggggtggatagggagatgggccgagccagcccaagggagggaagggggacttttagggtttttctttttataaaacctttttaactttgtttattttttaataattattatttgtgctctgaaaattccactaaaatttatttacgcattttaggcttttaggaaatttacaaaaatcctctaagccttatttggcttttaactttgcacaatttaattcttggaggctttcacacggattttaattattctaggcaacatttaagggatatattttagagtcgttttgggacgtgacaaacctaccccccttaaacggaacctcgaccccgagattcggaagaactggcgaagagatcgggatgggctgccttcagctcgtcttcacgctcccaagtagcttcttcctcggcgtggttgctccattggaccttgcaaaaacgaattacccggttcctggtcctgcgctccatggcgtccaggattttcaccggtctctccacgtaggtcaagtcttcgcgaacttcaatctgctctgagtcggcctgctcggacggcactcgaaggcatttcttgagttgcgacacaaggaacacatcatgcacgttgcccaaggaggcgggcagctccaactggtaagcgacttctccgcgtcgagcaatgatacggaaaggacccacaaaccgaggtgcgagcttccctttcgtctgaaaccggtgtatgcctcgcaacggtgcgacccggagatacacaaagtcatccactgcgaattccaggtcacggcgtcggttgtctgcataactcttctgccgagactgggccacctttagattctcccgaatggtcctgaccttcgcttcagcttctctcaagatatcggtcccgaacacttggctttccccaacttggtcccacaatagtggtgtccggcatttgcggccatacaatgcttcgtacggtgccatctgtatgttggcttggtagctgttattgtaggagaactcggcgtaagggagactcttatcccatgtcttcccaaaatctaggacacatgtgtgaagcatatcttctaggatctaatttagacgctcggtctgtccatttgtctgcgggtgatacgcggtgctgaaatttaagcgggtacccaactcttcttggagcttcttccagaaatgagaggtgaactggcgtccccgatcagatatactttttttaggaacgccatggagactcacgatcctagcgaagtagagttcgggtagtttgttccctccataggtggttttcacaggaataaaccgagctaccttggttagtcggtccacaacaacccatatagaatcatatcctccttgggtttttggaagtccgatgatgaaatccatcccaatttcatcccatttccattctggtacttggagaggttggagaagtccggccggtcgctggtgctctgccttgacacactggcacacatcacaaagggccacgaactctgcaatttcccgcttcatactaacccaccagtatttcccttttaagtctaagtacatcttcgtactgccagggtggatggaataaggactttcgtgagcttcctgaagtatcagctgtttaagttccttgtcgtccggaacgcatacaccatttccgttccatagggttccatgttcatcttctgtgaaaccagcggctttaccttgtttcatattcttgaggatcccatgcatatctggatcattcttttgagcctcgcagatttgatcgagcaaggtgggcttggcttccagcgtagccaagaatccacgaccaactatgcttaggttcagggcttccatctgttgatgaagttccggtggaatgccacggacgctaagagtgttgcaacggctttttcgactcagcgcgtctgcgaccacgttggccttaccagggtgatagtggatccccacatcataatccttgatgagctctaaccatcttctctgccaaagattcagatccgactgggtgaagatgtatttcaaactcttatgatcggtatatatttcgtagcgattcccaatgagataatgccgccagatttttagagcataaaccacagcggccaactccaaatcatgggtagggtagttgccttcatgaggccgtagctggcgtgaggcataggctaccacatgaccttcctgcatgagcacgcaccccaatccttggcgcgaagcgtcacagtacaccatgaagtccttgcgagtatccggtaagattaaaactggcgaggaaaccagattttccttgagagtttggaacgccttctcgcattgcgggctccacacaaatttttcttctttcttgaacaactgtgtcatgggtcgagcgattttggagaagttctcgatgaacctccggtagtatcctgccaaacccaaaaagctgcgaacctgagtaactgtcttgggttgcttccaatcagtgacggcggtcactgtttcggggtccacagcaactcctttagcagatatcacgtgccctaagaatttgacttcggataaccagaactcacacttgctgagcttggcatacaattgatgttcccgcaactttcccaacaccagacagagatgctgttgatggtcttcctctgattgtgagtataccaggatgtcgtcgatgaagacaacaacaaacttatccaagtattccacgaacactttgttcattaagttcatgaagaaggcaggagcattggtcagcccgaacgacatcaccgtgaattcatacagtccataacacgtggtgaatgcggtcttcgggatatcttcttcacggatacgcaattggtgatatccggagagaagatcaatcttggagaataccgtggcacctttaagctgatcgaacagatcatcaatccggggaagagggtacttgtttttgatagtaacttcattgagagctctgtaatcaacgcacatcctctttgtcttgtctttcttctccacaaaaatcacaggagcaccccagggggaagtgctcggccgtatgtaccccttttcttttaactcttccaacagtttcttgacttcggccagttcatttgctaccatacggtagggtcggttgtacagaggagtggttcctacagcaagatctatccggaactcaatctctcgcttgggcagcataccgggtagttcttccggaaacacatctccgaactcactgactatggggatttctgacagtcctatctgatgaagttctaaactaccgacagaggttgggggtgcaaagaaaacaaccggttgttccggccctcggtacagagtgacagtgcgtcttgcgcaatccactactccttggaattgagccaaccaattcatcccaaggatcacatgcaagttcttggtgtctagaagaatcagatccgaaggaaaaggaattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtaccagggatggaatgaatgaggaacgtacccacgatgacgtctggagttgtcagcacatcctcggcagtcacgtggttcacatgaccccgaatgacatccttaccactgttgttggggcggggaggcgcttggccttgctggcgcctcggctttgggcatttatccgcaaagtgcaataatttaaaacagtgataacgcgggaatttaaataaagcgataatgcaataatttaaatcaaaataattttataaactgggattcaatatgttcaaggatgatgtgacttgccttgctcactttcccaaatgtcggcttcaacctccacgaagagcggatcttccgaagctgcaacgtctacacgaccaacagaaaataaaagggcttttactctaataaactccatataacaagcaggaacaaagcaccaaaatgggttcttgacttcttaacgaaaaaaaagagacttgaacggtccaattccgagttcaaatggccaagttatggccatttgaagtttatatgctctttaaatgaatatttgcgaatttcttcatttaaattttaatttaaaaaaggggtttattgcgtcagccgagggggagggggcgcgcggaccgggtccacgggggtggggcccacgcggcagcctcacggtccacggtggaccggttgcacccgggctcacaccggccggcgccgtgggccccacacgtcagccacacctgagggcacgagcggctgacggccgggccccacgcggcaaccactcggcgcgcccgagggcgaccacgctggcgcggtcagcgggaggcggcgcgcccgcgccccgatggtcgccgccggtgaccaccggcgcggtggagcggcggccgagagaggggagggaagggggaaaggaggcgacggtccacggctcaccccagggcgacggcggcgacggaggaggcagccggagcggagggaggcggtggcgcggctcgggtcgacgggtacggcggcgctccggcggtcggcgaccgaaacggagaggtggacgaggtcggcgaggatgcggcgaagccgaaggaggcggcgccgaggtgggagacggaccggagctcggcggcgacggcggagagagagagcaacgtcgcgagctcaaatccggcgaggaggaagggcgccgagaggcggaaacggacggaggaggtgcggggagggttcaaatagggttggaaggaaaccggcgcggcgctctcgggctccatcaatggcgccggcgggattaggggagggtttccaaacgagtccaagggagagtgggatggaaaattggggggaaagggagaggggatcacggggagtgattccccccactttattgcacgcggggacggcgggaggcggcgggattcgcggcggcggcggcgctagggcgcgggggaggcggcgggagcggcgggaggaaggggatgacgggtgggccctacccgtcagggagggtggcgggcgggcccgcccgtcagcggcgcgcactgggagggaggccgaatgggccgcgggggagaggagagagagagggggagggagatgggccgaattcggcccattagagagaaggagggattttagggtttttctttttataaaatcattttaactttgtttatttcttaataattattatttgtgctctgaaaattccactaaaatttatttacacattttaggcttttaggaaatatacaaaaatcctctaagccttatttgacttttaactttgcacattttaattgttggaggctttcacacggattttaattattctaggcataatttagaggatatattttagggtcgttttgggacgtgacacatattcctaatgcttataatgatgtttctaggggatatcctcccgatacaagacaaggccaatataatcatattgcgccacaaacacaacctattaggccaccaaacccaccgccaaatcaacaagggcctaataacatggaggatatgattagtgatattatgaggaatagattcgggattgaaactagaaatcgtgctagaacttacaaaaagtcatatcctgattattatgataatgtgctgtttcctcgaaattatagagttcccaaatttgccaagtatagtggtgaggatggtaagaccacatgggagcatgtaggtcaatttttggcgcaatgtggtgaggctaatagtgatacttttaaattgcgcttgttttctttatctttatccggtaatgctttcacatggtttacttctttaccagcaaattctattcatacttgggctcaattagaagaacaatttcatgattatttctatactagagaaactgagcttaggttatgtgatttgacatcggttatgcaaaagtataatgaatctgtcattgattatattaagagatttagagatgttagaaaccgatgttatactttgaatataactgatagagatttggctggtcttgcttttaatggtttagttgctcctcttagagaaagactagatggccaacaatttcttgatgttagtcaactcatgcaaagggctctggctcaagaaagccgggttaaggataatagaaaacttgctagaccatttgataaaaagcctaatgttaatgtggttgattacccttaagctaatgatagtgaggaagagggtgatcatgatatttatgttgccgaatggtcatggactaacaaaaataaaacttttgtttgttctaacctaatcccgactcctcgcaaagatcggcaaagtgaggttaaatatagttttgatgtggccaagtgtgataagattttttattatcttttgcaagagaaacaaattagattacctaaaggccatgtcataccttctcaagaagagttgaaatgtcgagcatattgtaagtggcatgattctcattctcactctactaatgattgcaatgtgtttcgacgacaggttcaatcggccatagatgaaggacgattgaagttcaccgatggctccaagatgaagcttgatcatgatcattttccggtgaatacaattaatttcaatgataagaaggtgttgattcggccggagcaagccgaatctactaaggggaaggaagtggtcattggtgaaccaaggtccaagatgatagtgctaaagaagccggaggttggcgtttggaaagagaataggagtggagcttcaacttctaaagcccctaggaagaccaaggtgacttttaatatgcttttggagaaatatgaaaagcaaggtggtgagaaaattcgcaacaaagggaaaagaccaagatcaccttctaaggagcgatttggtcattcaccaagacggtcgcgttcaccttcgtatcattatccacaagatatgtcatggggttcctatccaatgccgccgtgggttatccttatccttgcttcatgccatggggccgacgccgccaatgttcaatcatatgcctcctatgcaattcaaccaagggaggggaggaccacggaggccaatt

SEQ ID NO: 16549 - DNA, 2068 bp, Oryza sativa
caccagttttgattctgcccgaccagatgaaagacttccaagtctattgcgatgcatcccgcacggacttggatgtgtcctaatgcaggagggcagagtggttgcgtatgcctcgcggcagttgcgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacctaaatctccgacaacgaagatggttggaactaatcaaagactatgacatgagcattcactaccacccgggtgaagccaacgtggtggcagatgcattaagcaggaaaagttactgcactgccctatgcatcgagggcatgtgtgaggaattgcggcaggagtttgagcatctcaacgtaggaattgttgaacacaggttcgtagccgctttggaggcacggcctacgctcgtggatcaagttagagccgctcaagtgaatgatgccgaaatagcagagctaaaaaagaacatgagagtcggaaaggctcggaatttccttgaggatgaacacggcacaatctggttgggagaaagattgtgtgtacctgacgacaaggaactgaaggatctgatactcaccgaggctcatcagacccagtactccattcatccaggcagcaccaaaatgtatcaagacctcaaagaaaagttttggttggtcagcatgaggagagaaatagctgaattcgtcgcactctacgatgtttgccaacgagtgaaggcagggcaccaaagaccagcaggtctactccaacctcttcaaatcccggaatggaaatgggaggagattggaatggactttataacaggactgccccggacatcgtcgggtcatgattccatctgggtagtcgtggatcgacttactaaggttgctcacttcataccagtacataccacgtatacgggcaaaaggttggtggagctttacctttcgagaatcatgtgtctacatggagtacccaaaaagattgtatctgatcgagggagtcagttcacctcaaaattctggcagaagctgcaggaagaattggggacccatttaaattttagcacggcctatcacccgcaaactgatggtcagaccgagcgagtcaatcaaatcctggaagatatgttgagagcttgcgctctcgattttggtggagcttgggacaaaaacttgccatatgcggaattctcgtacaacaacagctaccaggccagtctacagatggcaccgtttgaagctttatacggccggaagtgccgcacacctctcttctgggatcagacaggcgagcgtcaactgttcgggacagaggtattaacggaagcggaagagaaagtcagaatcatcagggaaaggttgaggattgcccagtctcgacagaagagctacgcggataaccgccgaagggagctcacttttgaggcaggagattacgtgtatcttcgtgtcactccgctccggggagtacaccgttttcagacgaaaggcaagttggcaccatgcttcgtgggaccctacaaaatcttggaacgaacgggagaagttgcttatcagttagaacttccatccaatatgatcggcatccatgacgtgttccacgtgtcccaattaaagaagtgcttaagggtacttgaaaaacaggctgattcggaacacattgatatccaagaggatctaacatatgtggagaagccggttcgtatacttgataccacgaaagaagaaccagaaacaaggtcaccaggttttgccgagttcagtggagtcaccattcagaagaggaagcaacctgggaaagggaagatgagttgaaagccgcccatccgcacctcttcgccagctcctccgaatctcggggccgagattccgtataaggggggtaggtttgtcacaccccgaagttctcctcctaagccaaaaatttaatttataagcgaccctaagaaaataccagtgcaaagcaagagtaaacccttttaa

SEQ ID NO: 16550 - DNA, 370 bp, Oryza sativa
ttgaagcatttgttgctatctaaattccatttaaggtcgtaccttatcgcccagcatcatcttattctctatttgtattccctccatctttcagatacggatgtagccttggatgtgcccgtgcccaatgaagagaaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtga

SEQ ID NO: 16551 - DNA, 147 bp, Oryza sativa
ttatttaaatttggatttgagcatgcagtgatcctactcctttgtcttctctagatggccgggcacctacccaaccaccgcggagaaagcatgattgactttgtggcaaaattggcacgtatgacgctggtggggggctaccccaac

SEQ ID NO: 16552 - DNA, 1258 bp, Oryza sativa
agcaaggcactctttttcataggtcgcaaacctctgttctggggccccaaagaacgactgaggaaagccaaaggatatcctgactgcattaatactgctcccacccctttatcagaagcatccgtttcaatctcaaattgcttagtgaaatccggcaacgccaatacaggagcagtagtaagcgctaacttcagagcatcgagagccgcctgatgttctgaactccaaacaaacaccacatttttcttcagtaaatctttgagaggtcgactgataattccaaaatgacgcacaaatttgcggtagtacccagccaaaccaagaaaaccacgaacttccttaacattctgtggaatagaccaagattaaactgcttgaatattctttgtatcagtagccacaccagccaaactgatcacatgtcccaaatacgtaagactagtctgtgcaaatgaatatttggaacgtttaacttttagttgatgttgagccaatagctgaaacacctaccgaagtaaagacacatgctgatccaaagatgtactgtaaactagaatatcgcaatgaagaccaacactcctttccgcagtagaggagatagaattgtgttcatcagctcttgaaaagtggccggcgcagcagtaagcccaaatgacatcacccgaaactcatagtgaccattgtgggttttcagtgcagtcttgtgcacatcttcaagccgcatcctaatctggtgatatccagcttgcaagtccaaacttgtgaataaacaagaagcagccaattcatccaatagttcatcgattattggaagagggtaacgattctttactgtaatggcatttaagtgtctatagtcaatgcaaaaacgccaagtgagatccttcttaagaaccagcaacactggagaagaaaaagggctagaactcggctgtataactccctgctgtaacatatcagacacttgatgctcaatctcattcttctgagcaggattatatcggtaaggtcgaaggttaactggatgagctcctggcagtagaggaatagagtgatcaaatatccagctggtggtaaaccctgaagttcgtcaaagacagcagaaaattcctcaagtaactgagcaatttctgtaggcagagaagaagatgacgattcttccaccaacgaagaaattccacagcatgcaacaccgcattacgatggactagtcccttaacttgattaccagtgatactagggaaaagagcaatattag

SEQ ID NO: 16553 - DNA, 559 bp, Oryza sativa
caccaaatgttcgggaataacttgaggtatcaccgattgatctggttgcacattatgaaccaaatgctctgggacaacttgatttgcagcgtgctgcctcggctgattgtcgggcgtcctgaacccagccgatgcatttaggaaaccttgctgctgaatcggctgagcaacttgctgcctcggtggcgtctgctgaatcggctgctgttgaactgggtcagcagtaggctgagttggtaaaaacatagctgcaacttgctcttgagttagccgattcacattttgtccactatgctgagactgctctctcaccaacaaccgaggattgattagttgacctggtgccgatgatggtccagcaggtgcaggagccgatactggtgctgttggctgagctgatggcacattgggagcaatcggttgaccagtcggctgattattagtgatcaagggccgatagtttgggaaaatacctcctggcaaataaaccggtcctgtagcctgatactcagctattgagccatcaaccatcgacttcaccatgtttgacaaggtattg

SEQ ID NO: 16554 - DNA, 345 bp, Oryza sativa
accggatgtatgatccggtggcgcgacgtgtttgtgtgtcgcgtgatgttgtgttcgatgaggcggccacctgggcatggcatgatcctgaggcggagggaattggagaggaggaattcacggtggatttctttgtgtcccatggaacccgttgttgctaatcaaggtggacaagctggaacgactgttcaaggaggcgcatcgccggcgtcgactattgtttcgccctcgccatctggagcagcagttagggtggaattttgcacgccgccaagctcagttacgccaggaacagaagaaggtcctgtcaggtatcgccgtgtgcaagatattctatccacaact

SEQ ID NO: 16555 - DNA, 1847 bp, Oryza sativa
ataacagccgctctaatttcagctctcaatccttccacaaactgggtgacaaagaacattgtattccaggatgggtgattgttcgtatttcttaacgtcattactagaaatataattcccagcaatagcgcagaaatacttctggtatattatggttacagagttcatccgcaagcgcatgaatataccattgtagcatttcacccgacagtattccaagggtatcgtatttattttatcctgtgggaagatcatgtagagagaacttgactaataatttatatattacttgtgataatcatattctaagtaggggttaagataatctaagggtagagtgacacacaagcattagctactcattctcataatatattatctaagctaagtggaaagaaaagagaaagaaaatctattcctgtacttctaatatacatagtatacatacattctagttaaccgatatacagctaataccctctatccgatgccctccttgtacttcgagaagccacccctgactgccgagttccttacaacagcccgtcataaccatacaaccggggctcaatacggaggaataacctccccagggaattaactttgaattatataccggcgcggaggaatacccgtactaagctgtcaccgtcagcggcccacctcttatccgcagtatataaccccaaataatgatatcccgtaatctaggcaccacgtctaaaatatcagatactactctaatatcatcgtcatgacagagagtaattgcatatgcaaacattatacccgcaccaaagcatctcgcagataccctagccgtatattcagtataacatgaacataatgtaaagtacgtacttatatactcggaaagtatttcaataccataaatgtatatagaagagtattctaataaaagtacaaagctttcaaaagaggaaaggaaagctactagagtcatacccgaactcttccgaaggcttctggactcctgatttctactctattcctattccaccaactagatactactaaactaaacttgagagaaatgagagagctcttgcttgaggtgtgtgttgaagtgaagagagtgaactccttaaataggcaggtaatgacggttatggtggttggaaaggtcggtaataccctccaaccgccatagggagtgaatctccactgttccctcaaaaccctgcatccatcggcgctggcattggttcggccgaacccctggtttagccgaaccctgggctggcccaaccagcccacaagttggctggtggcctcctccggtgttcctcttcgtagacttgtgaaatttggcccagtgtgtcgtgtcaatcctgagttcttggcccattcatacataagtctggttctcgactgtcacaccccgaagttctcctcccaagccaaaaatttaatttataagcgaccctacgaaaataccagtgcaaagcaagagtaaacccttttaaatcaatgcgaataataatcggaactggcatgtggaatttttcttgagttctacatgtcgaaattcactaacaggatttttagtggaattttcagagccctagaaataattttaaccagttaaaattgagcaagcaatattttaattccaggaaatccttttctcctttttctttttctttttccctccctttttcgaatgggccgctggcccattctctccttttctctccctcctccctgctgggccggccgcaggccgaggcccagccaagccgcccctccctctctccccgggacgccgacaggtgggccccacctgtcggacccgtccccttcctccagccggcgccgccgcgccc

SEQ ID NO: 16556 - DNA, 2307 bp, Oryza sativa
ccgcctttttttcctcccccactccccaagttggccggcgaaaaaccgccttttccggccaagtccggccctcccctcccctatttaagcttccccatcgctccctctcgctttttccccttctcgccaaactcccttgtgctccccatcgctcccgcgccgtgcaaccacccgccgccgccgttttcgctactccggccgccgctagctgccgctagggtcgccgccgcaccgcgccgtcgccgccgtcgggttcgcgaggctaagctccaccccggccgccgcttccccgtcgagtttcgtcgccggaattcgcatcccctcgcgctccggtgagttcaaccgctaccgccgctttcggccatgaataccggtcgccgtggttcatctccctccctctaatctctctcttctccttctttagggcaccccgaatcccgtccgccagtggccgtcgtcctcccgtggctcgccatcgccgttcgccgtcgtcttcctccgcgccggccaccctcggtgaggcgccctctcccttctattcccctccctctccctcctagccgccgctttagcgccgccgcccgttagccgtcgctttagcaccaccgcccgtcggcgccgcctttgcgccgccgtctccgccgccggttgccgttgcccggaacgcgctcgcgtgtgcgcgtgccgtcgccgtcgccgcagccggtcggtcggccttgagccgagccgggtcgccgccgcccgtccgatcgaccccgagggcgatctggaccgtcggttccgtggaccggcggtggaccacccgcgtggtcccggtcaacggtgaaccgccctcccccttgagtcgctgaccggtgggccccgcgtgccggcgccccttcctctcccgagccgctgaccggtgggccccgcatgtcggcgccgtctttccccccctccgtgctgacgtcagccctgggatttattgcgcaataaataatttaaggtttttcttttatagtaataaacacagtgaatcttctaaaattcataactaattcatccgagctccgtttaagcccattcaagaaaaatgtgtagaatccattaaaaatggttttgttctctgtttcagtagtcttatagcctgtttgcaatgtttgccttgtatgtcgctagattccggttcgtccgacgctccgatgtacttcgaaatagtcgccgaggttcctcctgcagcagagcaagacaagtcatgcttgtcacttgaacatgttgatcctatattgcaaatgctctattgttttccttcaaatattgcatcgttttataatgttactatgggatgtttacctattgtcatagccatgctattgttctaccatgtctctttgtcagcttggggttataacatgactagagattggactagggattgcttagccatgcttagttcaactagtgcacaatggggaaaaccttattaatgtttagactgttggttctaatggtattgttggattagtgccaccgctttgtgttggtgtgggtgcatggttttgctggtcgcatccatggcagttaaggaccggttcgcgggatgccctggaagaacttatcgtacttatcacaagccagcgtgggcaacggctgggcttgtagtgtagctttcctctagccgacgcatctaggcaagggtgggcgtggtggagttcggatgggccctgcgacggcctatgcggcttccggattcacctaggcacgagaggggactgcccgctgccttgcgaggagtgggggtgaaacctgaggtgtggtgtgcttggttagaggggggttatgcgaagggtcctgtcacggcctctttctggtatgtcgtggtggcatgtcggcgcacgggaacgtgtcgtggggctgtgtcttgtgggtacagttgtacacctttgatcagagtaaaactattcgaattgccgtgcccgcggttatgggcggtcaaccagattcaccgtgattagtctcaccctagtgtaatcttttgaatttggatagtttaggtggatggttgggcctgtcgcaacgtgggatagcgttggacagtggatagttaatattaattaattattacaaccgtttaaatctttcaacttctgtttataaatgctcattttatgcaaatgaaccactctagctctcctttgataattccctgcatcatacccctattccggtatgacttgctaagtacaatgggtagtactcagtcttgctctattttcccaaccccagagcacgagtacgtgtcaaatgaaggtttctccgaggagtagg

SEQ ID NO: 16557 - DNA, 338 bp, Oryza sativa
ttaatggattctacacatttttcttaatttactgagacttgaatgggcttaaacggagctcgggtgaattatttatgaaatttagaagattcactgtgtttattactataaaagaaaaaccttaaatcatttattgcgcaataaatcccagggctgacgtcagcacggagggggggaaagacggcgccgacatgcggggcccaccggtcagcggctcgggagagggaggaacgggcgccggcacgcggggcccaccggtcagcgactcaagggggagggcggctcaccgtggaccgggaccacgcgggtggtccactgccggtccacggaaccgacgg

SEQ ID NO: 16558 - DNA, 1799 bp, Oryza sativa
gatagtattatctccagagcagtttctagattatactctgacagatgggattcttcgcttcaaaggctgtatttggttgggttcgaattccactttgcagaccagagtgttgatagctttccactgctcagctattggaggtcattcagggattcaggtcacatacagtcgagtgcatcgtttgtttgcttggcccggcctcaaacgtgttgtccggatgtttgttaacacttgtgaggtatgcaaacaagctaagtctgaaagagtgaaatatcctggtttgttgcaaccgctaccggtccctgatcatgcttggtagacgatctccttggattttattgaggggttacctatatcagccggctttgattgtatttttgtggttgtggacaaattcagtcgttatgtgtcacatcctgattttcgttttaggatttataaattatttaataaattattattagaatttatattaaatgttcattaatttacaagtgaagttaaatgtgggaaataaaattcttaaatataaagcatggatggatttaatttttatgaaattctccatggttaattatactctctgaaatttctcggatttttcggagctcaattcctaattttaatcatacaaagaacattttagtaattacccacatattaaattaatcattaaattgcctgattataatcttgttaagtactttgagtgtccaagtattttcaggatttttcttgaaattatttgagcattggaagtatttttaacaattcaaagatcatttcagtgattattttaattagaaaaagttttaaatcttcccctaagccgtgggctgattccagcccatctccgtcctttgtgtgcacggctgtgcagcccatgtcggcccagccgagctcccccttctctttctttctttgctttgttttcagccagcccaagagggaaagtatactttccgtccctgtcactacagtatcgtcttcaacctctggcagcttacctgagaccgaattggctcggtttttcccctccaaatccgaccttttctcttgtgttttcctaaaattagttgaggggaaattatctcctccttatcatatttctttccctaaagtttcggagatcaattttgctcggataaaccgaatcgaattcgttttcgagtttatctctccacctaaccctcggatttttctggctcaaatcctttcgttttgagttcgatctctctcacccatgactatataaagcatcccctagtcgtcctcttccgtttgccccaagtcccgagctctaccgttgcccgtagcgcggccaccgcgtagccctagccgttgccgtcgttgtcatcgttccagccgcgccgcgctgtggttgtggtcgccgtcgccgcttagcgtcatcaccgtcgggttcacgcggaggaggagcacctcggccgcccctttgcagccgccgaagaccgtcggagagccgtcgtcgccgtcaagtcaagccgagccgccgttggagttcgtcgccggccttcgttcgtcgttgttctttacaccggtgagttcgcgtcgtcgtcgtcttcgcatgggtgtactcggaagacccagccgagtcttctagctccggcgacctcatggttcagagccatggccggcgatgatgtcatcgtgacatcataaatctttttttaagtttttctgaataagatgaaatctgaataaacttcagaaattcataactaaatcatcattaactcggattcaagtgggtcaaattgttaaattcatgtaaaaccgat

SEQ ID NO: 16559 - DNA, 2108 bp, Oryza sativa
cgtgctcatgacaattaaggaccggttcacgagctactgttgtgaaacattaaccgtgccaatcacaagccagcgtgggcaacggctttatcttttgtatagcatgattcattgcggggtgccagactgagaagcggcgagaagtccgtgggggtcgctggggagtccatgcctctggttatagttatagagggggtgattatgatccaggaatggtgcactgtggtgagttgtgttgtgcagagagtattgtcacaacctctattcgggtactttctagtatcgcgacgcatggtagacatgatgttgaggctgtgtcttgtgggtacagtggtacacctctggccagagtaaaagtattcgaatagccgtgcccgctgttatgggcgggttgagcaatgtttttcgtgattactctcacacctctcacaaaaattattgatgctataactggtaataatttgcttagctcctggtttggagttagatctgtgcagccgggtttggttgtttagaagtgtgctgttcagtgttgattaaaattgatgattactctactgttttactattcttaaatatttgttaaatgctgcttttgcaaatgagtctatattatgccatcctttggtatccttgtgcacttgcatatttgctgtgtggcttgttgagtatgtcatatgctcaccttgcaataatcaatcaacctcagttgaagaaaaaggatccagaaggagaagacgtttggcttataccctagttgagctgcctgtgggagtggagctgaaaccatcgctagatcgtttttccgctgctgtttttttttcttttgtaagaatataacgatattattatgatggatttgtatattaaattgcctcggttgattcctggacgaggattttatgcacaaataagttcggaagttactagtgaattctgggcgtgacattatgctcattttgtggcgttaacacatccatttactgcttttgatgtgggtttggcatatttgaacaacatgtacaagttacatggattgcctcagcatatcatttctggttggaacgtatctttacaagtgccttgtggacagaactttttcgcttggcagatacacaattgaaaatgagttccgcatatcatccgcaggctgacgggcagaccgaaagggtgaatcagtgtctggaaacttttttgtgatgttttattcatgcttgcccgaagaaatgatttcaatggcttgccctggcagaattttcgtataatacggcttatcactcagcacttgacacctctccgtttgaagttctttatggacatccacccagacattttggtggtttggatatttctgagtgtgtagtatctctaaagaacgatcactagtttacttcgtcagcatttgctgcgagctcaacaaggaatgaagtcacaagctgacaagaagcgttctgaccgtacctttcaagtcggtggttggatttttcacaaggctcaaccttatgcacaatcatctttggctgttcgttctaatcacaaattggcgttttgctactttgggccttttcaagtgctagctaaagtaggagtcgtggcctaccgtttgcagcttccattggattgcgctattcatccggtgttatgtctctcagcttcgtcaagcatcttaccccgctcaacctactgatgttcgtcttcctcctgctgttccacctgaagatattgttcctgtggaaattcttgaacgacgcgtggtcaaaagaggagatcatgcgacagaacaggtgaagattcgctgcaaggtcactcgtcggctgagtctacttgggaggatgctgcagctctccacctgcattttcctgaagcaccgccttgggggcaggctagttccgaaggagggaggaatgtcacggcagcgactactcatacgtctactgtggacaatccgacaacagagaacccggtgaagcattgagttcgacctgagcgtatcaagcgggccatgtcagaatcgctgggccagaatggatcatgggctgatgtattcgcgcggctatataagcgcactaggtggaagggaaaagaggtcgaattaattgtattctgaa

SEQ ID NO: 16560 - DNA, 22615 bp, Oryza sativa
tctcccactggctggagggcccacgcgcatgcaggagaaaaggcggagccgtggcaatcggtaattggggcgcgcgatgtcgagattgatcccaaggcatgcgtgggtagtagcggcgcggatcatccgtggaaaaggtggacttgttgtggcggacatgttgtggctagctacatgtcagtgatatgaggctttttctttggagtggaggaacaacggatggcccagattttatctgagctagtgttttgccctaagagcatttgtgacattgtcttagttaggggatttcagccacattggacaataataaggggtggatgcttggtgagaggtctccctttgagtcgcctatacaccttggtgtgagagagccttcatagctttcgtgtgtgattttaaattcaaatccaatgtgaagatgtattttttagtgtgttagtctcacggcagcgactactcatacgtctactgtagacaatccgacaatagaggagaacctggtgaagcatcgagttcgacctaagcgtatcaagtgggccaatgtcagaatcgctaggccggaatggatcatgggctgatgtattcgcgcggctatataagcgcagtaggtggaagggaaaagaggtcgaatgaattgtattctgaactatctcctaaactgaatacttcttccccttccccaagtctgaatatctctctctctctctgtctggttcttcccctgttcgactctgttctatcttcttcctctcaaactttccagaaatcaacagagttcgtaacagttagctccactcttttgtaatgatatgatttgaatttattttatgtaatttaaattcctgtatttacttcatgcaatttaaattccgcatgagttttgcctctcctattaatttctgtggagtgtgtttctactctctctctccaattcttcgatctcgtattcctagcgaggaacgtagaggcaaccttatatagccctcgagctatttgagagggagttcaatttgagaggttgaactcctcatctgagtagggttctttgtagctttttttaacctcctcctagatctagctttccacataactatgatcttaaggaaatgtttgatagaaattttaaacgagtattatgggggaagaattttgggacaattttgttcttgccccaactttgattgccaatattgattttgcccctgttttttagggttttcgtttttaccctaattttttaaatgaatcaaccgtttgcccctgttccgttaattcttgctaacggtgttaaatgtggagggtaaaaagacaagtaaaccattagatattttcccgtacttttgatataatcaaaatacaaatctattgatgccatactatagcagtaatttaatttgtcaaaaaattgtgaaagtttgccaaaatttgggtcaaatttgaaagtggtgtacaaaagtaccggaaaatatctaagggtatacttatcctttctaccccgcaatgaacaccgttagcaagaattaacagaatagaggtaaacggctgtttcgtttaaaaaaaaagtagggataaaaacgaaaacctaaaatataggggcaaaatcaatattgaaaatcgaagtagagacaagaacgaaattgccccaacaatttttgtacgctttattcatgcccacactagagcgggtagaggtcctaaaaaacagccgactttttctggacttacatagttacatatggatggatgtgcggtagccttctgagcggtggaagatatctcagagaattaacccaagcctttcgagagtaataggtttttttatctacaagccaaggtgcatctaagagatcagctctacctaaatctgaaataacaagtatgtgtacctttggttgaggatttatattgctcctccttattactgtctctatttctaaatcactactataaaaaaacatttttgcaaacgggccaaagcgatttttccaggtggccatccactccgcatgaacttcaaagcatgcgaaaatacacgatttttgtaggcggacatttgtccctcctgcaaaaatgattttagcaggcggcatctccatattcgtaggcactatagccacctgcttgcgaaaatgttttcggagaaaaaaaaagccaccacccacccgctgctgccctctccccctctggccatgccaccgccttcgccccctccgccagatctgtgagggagacaaagagggagtgggggagggagggtaggggaatcgcaccaccgtcgacttccatgacgacgaagaagacgaccatgacgacgaggaagatgaccacacccgtcacctgatccgccgcacccgcacgtcgccatccaggaactgccaccccgcccgtcaccatctccagctgccgaggtagagtagagctgaggagaggagagggacgggagctacaccgcccctcccctccggccacgctgatcccctcccctcggttcgcgccaccaccgacgcccctccccttcggccgagccgccgctgacgccgctcctcgtcaccaataccaccacccacacctccccttcggccatgttgccgccattgcccctcctctccgcccgcgccgctgcaaacgcccctcccctctgcctgcgacaccgttgacgcccctcccgtccacccgagctgccaccgacgccgctcctcgttgccgataccccgactacccacaccgctcctcctcggagccaccgctgacgatgccgcccctgccctctgagccgtgcgtgagagagaagaaaggtcgagaggataaggataaggatggtggagagaaaagagtagtggatggtggaggaaaggataagatgggacgcaatattatttttggtgagctgcaggcacgattttcatagacggaggacaatctcagccccattgtcaatttcgtaggtggccatttacttccaagatgcctatccgcctagaaaaaatatatattatcgtctgaaaattggtttttctagtagtgaatatttgatattggttagttcaaaattgaaaatgtagggctgccacgataccctttgcaggaggactatgttcccgattatttcatttttcgtgatctacttttttgtttggagaaaaggtaatggaaacaaatctgatgtttatatacacagaagtgcttgtacaaaatcgaaagatacatcattaatacttaaactacagatctcataacaaagagaagaaaaacaaaaccaaaactacttgactaagcatcaaaactacattcgttctgtcctgctttcacaaaacaacactgaagtgatcttgatagattttccgaatggatccacatgtcctgacacatattaccttcgcccaccgacgctctctagcagaggcagagaagaagaggccctgccaataccatttgcgttccacgaatggatcctgcacaaacacctcatatcccgtggcacttaagcctccgatctaacatagttccttaaccattgtcaacacctccaaaaagcctttcgtccactcctcgccgtcctcacatgaacgctagctgtatctagccattagaccgaatccagtctccacggttgccgctagcaccgtcactgagcttattgttatcctaccaaagcccctccttgttgtcctaccagatctagcaatgatctggcagccagcacacctagggccctcgccgctgaccatcgtcaccgtcgtccacaccacaacgttgaaatgtacaggctgccacgttgaggaagccgcccctccaaccggagttgatgccgtcttccgccttcaattatctcgtgccacccctccagtcagaaccggtgccatagcccctgccaatgccgtctaaccaccgcctccatcgcagcctcaccaccctgccaaccaaagccgaacgcccgcctccaacgtcgttgtgcccccaccacttggagccaaggtaaagaatcaccactagcggctagcaaaggtgaatggcgagacaaaggggagagatgaccatccgtccaaccgcctgccaccataataaacaggtgctgccggccagcctatgtcggcgtgccaccaccaaactcaagcgtgtgtcatagtgaatgtggatctagaagagagagtgataaggacacggctatggtgcccggatttgtcccaatctttcacagtaaccaaaagatagcaaataatacagaccattgactagataaattgagcagcaattaattttcaaataaactagcagaaccaaatagccactccataaaatatagtgacaaaatagttgtgcaaatctcgcaaatatactccacccatgcggcaagggagtcacacgatcagagaacgaatacttctgtagaaatcaaagatgtgcccaagaaattgattcccgagcacactcctgttggttgattttgtggacttgtggcgataaaaattaggagatgggctaaaccaccggtttccttatcctaacaagaaacaaactaagagataaatctgttttgtgtgatcggtacaaaatagactcgaattttagattgagatagacccccgagccccaccagtgtcacctataaaaggaaagagaaggagggaggcaggtgacgacttatctcactctaacctcaaaccctaaattaatcacccgatcgatcaaggcactggaaggggttcatgaggtatctcacaacagaagaaacaatgaagaagaaagaagaagagcaatggcttcatctcaggtcagttagatcaattaattttcgcataagcagaaggtgaccatgtttaggctaagactcaattatttaattggaataaattccaacattgtggtatcagagcctaatcttagccttcttgttaacagtgaaatttggtaagcccggagtagtcatcgacttagagtcagcatcggcttcgaagtcttgagattagccgatgagagttgtcaagtcatcagttgtcggattcttgctatattcggttaaggaaattgatctactagatgaagcttatctagaagagaccgagttcaaagagaatgtggcatggcaagttatctattaattaggaatagtttgttagtttccttttatctttaggaaagtgtgtttagtgtcctataaggattttatcttttccttttatctttaggaaagtttctttcttgtccgatgaggacttgtatcaacccatgggtataaatatgtacacctaggatctgtgtaatttatcgctacgatcaatacaatttgacgcatcgccaccctttttacttctacttttgtttttacgttccggcggaacttggcacccgatgcagggctgcatcgtcttcgatctctggcgaagggataagtccaatgttccgccggcccaggcaattgtatcgtctacatcggcgtagttcaaggctgcatcagtacattcgacctcttggattgctttggtttggatgatatacttgcctacctatttatcatatgtctatgttaatctagtcttagcatatcaatttagctctatcggctgcttctcgttttagggtttctgccggtatcggctaaatctcatatgtctctgttaatcttgtcagttgcaggatcaaactgactggcacgcccgcatctcatcaatctttgaacctgcacaggagctaagcagatctcccaggccggtgtgttcgattttttcatcaacacttctttatcccatcatccctaagtgaagccattatgccaattaaaccctaatttctattcggcatgcatgatgcgattttgagttaattagattagattaatccctttgccttggttgcataagcgaagccctgttatactgctgatctcggccaactgctgatctcggccaacagtagaagaagcaaaattattgaagagtttaattttgttgatttttatgagaagaagaggattgggataaacaagattgaaattcccaattcaaacactaagaattcctagaccgatgctaaggtttcggctagcactcagcaaacaagaaaggggataaactagattgaaattccccattatcaagcaaaagggaataaacaagattgaaatttcccgaaatccccaataagccggatccaattggcctaaaatccccaaatgaggaagcctaatttttgggggaagaaccctaagtcacaaatatccgaattaaatgcaaattcaagtcaaaattaggtttgagtttgggttacttatcggatttagaccccctaagattgccggcgcacaccggcctcctcggggcagtgccggttgaccgccgtgcgcgcaccaccttggagctcgtctctccaccgtccctcgccggggacgggaaacgtcggcttggcagctgccttcgtgctcttgccccaccccgatgaggtccggccgcatcgccgccgcctcgccggactgccgacgccttggcacaacggcttggcgccgccctcgggggcgccccccagccggctgagatggagccgctgcggcacttgtcgccacacgcgtgcgccgcctcgtcggaccgccgtcgcaacatcgccgccgattcgctcgctcgctcgccggacgccgaatcgggaatagaaggggataagaatgagctagggttaggtctcacacccattcccccctggcgagcgatttcttcagtgcgggcgaaatcttggccgtccgtttgatcagatggccgccctcgctcccgcatcgggccgtcgccgtcatgggccaagctgatctgggccacgtccgccaaagcgccgagcgcgcacataaatgggccggtccattttgggccagcttttcgataagagtgggcctttattttttatttattaagcccatgattttaattcctcagaatgtgttatatctttattagctaaattttagcccgattttagccttttttttatgggccggcttaggaagtgatgagccgtattattattttaagcccgccatttatgttttatgtatttccagaaatttatttatgacctttcttagccattaaaaattgctggaaaattatggtcaattatttgatcactcagaaaattatttctagttaaatggaaccaacaggaagtttagctagaaagaaattaatgatatgatattatatttgaccaatgttaatatgatttcatgtcaatatttattaagattattatttccttaagccacttaatttattcctagttgaatagaaatttaactagaaagtatttatgatttcatgtcaacatcattatgatggtcagtgccttagtaacttaattatttatagtcgaatggaaccaacgagaaattcgagtagaaagcattaagatctgaagttatatttaacccacgtttttataattgcatgtcaattataatttttttattccttagttattttctaccaaatggtgatataattaaggaataaattttaagattattcataattatttatgaccaatggtgttttgactatgaaattctaagtttattttgcatatgattgactaagccaaggtgaattaattatatgcaattggcaatgtttattatttaagatcagttgcaatacttggtaaatatttctagattaatggaaccaacagaatgtttatctagaaagaaaaaatatttcattaagatagtaatttccttaattattttttgcccaacggtgatgtaattaagggaagaaatctaagtattgtcaatcgttattttaattttctctgtcattttggccttaacggtgattagacttagaattttatttatgccattagtgcattaattcctttgtcacttctaccttatggtgatgtgatcaaggatctaatctatcagtaagcttaattcctttaccatttctgcccaacggtgatatggctaaggattttaattttaattctatggcatcactaatggcgtcatttcctatatcatttctaccgtatggtgatttgatttgggattttaaattatttacattatcacttctaacctttggtgatgtgacttaagacattaatgtttattccctaatcagttctgcccaacggtgatttgatttttggattataagtaatttcatttaatgattctttcgccttgtctcttcccaacggtgagacaaagcgaaataaagattaagctatcgttattgtgtaagtgattgtaataatgtacatcatttgcacaagcaaccacaataatagtgccacttaatattttagcaataaataatgttgtttatcagttaaagtctatggaattattattatttttcctcattgacttaactgagcctaaggcctacttgagtatgacttggcattgacaaaggattccttatggctcccgtagctaatgtcactaatttttttttctaaactcaagaggcatctttagcctgggagtaggccaatataatgttatgtttcgcatatcactcataaacattaagattatcatccctgttggtgttaggggagaattttgagcatgactttgcaaaactgtatctagcaaacgttgagatgaacttttagaagtttgtgaaaactaatgcttagtacaattttagtgcctatgcacatttgccgccataatttaaaaggtagcacaagaaataaatcataaggcgtgcaaacttagtgggatggacatcgaacatttcatatgcgccacttgtccatttcatattatttttctcccattagactacggtcattttcagttatgtaatactaagacaaagtggaccataattgacttggttcatcattccccaaatcaataaaaaatatagaagattaagaggcaaaataagtaagatcctattaatcttgtcatttgatggcaaagatgaagctttactaaggggttgtagcaactctaaatttaataataataaagctcactttcctcgcaaggggaaataaaattgcctctatgtcctatgtatgctactcttgaaattttcttgtgtaagttctttgcaagtaatagggacatgcttaatgtcctgattcaacaaactagttaaataagaagattaaaggcattattttgggttgaatcattatgagacgttgtcgaaattatggccttatttttcggccacatttctaggggagaatatacgtctcattaaggtcgagacacttcacccttagaaatttttgacatctatcattacttagatgataattcgctaagtaaagctaaagtaaaatcaagtgattcaagttcataaggtattatgcttccattacataaataataagagaagattattctacctcatttatgactcatagctccattatgtggatgctagaattttgtatctcttaatttgtgacttgcacaattaaatatacataacatagcttgagggttttgttatggaaagaaaagtcacatatagggtgcagacttaagaaatccatttgtggacttaatcaagcattgatgatgatttaaattccgctgcatcattagtgaactaagcttaaataagaatcaggagaataactattctataatgatggaagtaagacgccattgggagtgtgtcattgtcgcttatgtcacataactaggggagtttggaacgtctcatgagatagagatattcttttccttagattttaatggcgttgtttagctttaagttaaaatttcactaagtcaagaaattagccaacaaatgatcatttaaggctaggtttacccataagcgacctccgatttcctttaagaaatttaagacactaatgctaaaatcaaatgaagttatgagatcggattatggtggtaaatactaaataaagtttgttcaccttataagacattaaaaataagcgttcatccaaatggttttcgaaccatgtaagaataaattgagatggatgaacaaaataagacattaaagtgttcatctaaatggttttcgaaccatataagaataattgagattgatgaacaaaataaagaatttagtagaagtttctgaatgagtcaaaatattcggccatttaagtgggttaataagattaagcctgactctaatggaaatttcgaacaattcaagtgaggtggacaggtgcatgaaaattaaaggtggaaaatttcattcaccggtactccatactaatgatattttattgttaagcaatgcatattgctgttagaaactaaggaaatttttccatgaattattttggtctgaaggagcactgggcttatatcagtaagtcatacattgacataaagaaataatttgagagaattcagttaaagttagtcaagttgaaattaaattataaagataatcatttatgattcagctgacagaagcttgagattagctcaaatctggatgcctacagatttggcaaacatttttactgggaatcttggcagtatttaattaaatccagagtagaccactggtattaagaatgttcacaaggcaatcttatgtaacatgctcatgtttctaaagtccaatgatctcagaagtttagagacatttggacacttattttgtgagatgtgtggatatttataaagattattcagattaagctatgtccacacataggggagcaatgaccatgtaaaagctccaaaaatagtctcttactgcatagtcgatgatgcagttagattttaaagcatgttatgattaatcatatatataagaatatttcccagaactaagagtggtaaatagcgctcataaaccactcaaaaggtgtaaaccactcaattatactgtgttatatgttgtgcactaattgaacacagttttctattttagtagcaacatgttgtgtgttttctgctaatacattgatatagttgtgaaacatatgtcctaggatcgaattattattaatctaagcttttgcttatggatgcatactctaaaggctcataaagttaagattaattaagatatgttctagccagtacatgtgtaaataagagcctcactaagatcctggatgagggggacttaatttttcaatcaacacccactaagttaagcttgagtttatttgagttctatagtgagatataggtcttgttgtctcggtgacgcataatgttgttgaagacacattgccttggggagctattttatttaatagactcataagtaagtctcgaaatcaaggggagaatgttggttgattttgtcgacttgtatcgataaagattaggaaaggggctaaaccaccggtttccttatcctaacaagaaacaaactacgagataaatctgttttgtgtgatcaaaatagactcgaattttagattgagatagacccccgagccccaccagtgtcacctataaaaggaaagagaaggagggaggcaggtgacgacttatctctctctaacctcaaaccctaaattaatcgcccgatcgatcaaggcactggaaggggctcgtgaggtatctcacaatagaagaaacaatgaagaagaaagaagaagagcaatggcttcatctcagatcagttagattaattaattttcgcataagcagaaggtgatcatgtttaggctaagactcaattatttaattggaataaattccaacaactcctccaaaccagcacttggccggtggcttcaatagatcatggtcgatggattcaccattaaccagctcagcagggatgataaccctagatgcgaaaacttcgacaaaagatcaacctctccaaaaagttgtcttcggcttggtgaagtgtcacgcccggaatttctatccaaaattccaaactcttacatgtgtgtgaaccctcgtccaggaatcagccgaggcacacaataacaaattgataatagagtacaattattactctaattaataagcgaataaaatgtcattacagaggtagatagttcctatcaatcaataaaaatctaagcagcggaagaataagataaacggcgcagacgactccactccacaggcagcttgaccaaggctacacctaatcctccacaccatcagcatcactgtagaactcctcctctgatgaatgattgcaaggtgagtatatgacatactcagcaagccacgcagcaaatatgcaagtgcacaggataacaaaggatggcatagtagggtttcatttgcataaacaacatttaatgaacatttcagaatttaataaaacagttaagtaataattaaacaatattaatccaacgctatacaacataccttgttgcataggcccaaccattctgaacaaccatcccggctgcacagttctatctccaaaccaggaatatgccattccaaaccaggagctaatcaaattattaccagttatagcatcttttactatggtgagaggtgtgaaactaatcacgaaagacattgttagacccgcccataaccgcgggcacggctattcgaatagttttactctggccagaggtgtaccactgtacccacaagacacagccccacaacatgtcaccatgcgcctcaataccaccacggtacctcagaaaggagctgtgacagtacccctcgcacaacacaatccaccacagcgcaccgttcctggatcataatcacccccttataaacaaggcatggactccccagtgacccccgtgggcttatctccgccacttctcagtctggtgccccgcaatgaaccatgctatacaaaaggtaaagccgttgcccacgctggcttgtggttggcacggttaatgtttcacaaccgaaactcgtgaaccggtccttaatcatcatgagcacgaccatcaaaaccatgtgctcacaacccaccattatcaagttttagttggcaatttaattaattaaccaatcacgattgaccatcgtgaactatcattaagccatcattaaataatagtaatttataagttatcccaatagtgtgctaatgtttctaagcatggctaagcaatcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgagatcaacatgctcaagggttgtttgggatctgtgtgacttgccttgctggccttggaactcttcaaattcttctcctgcaaaaacggactctctggaaacatcggaatctaaacagaaaggagcaaaacaccaaaacaacacataaacaagcatgaacagtacatgtggatatttttaacatgtagatctcaattttagaaaaaaatagagacttgaaccaactaaatccgagctaagatgaattagttatgaattttcaaagattaaatcggattaaaacacttatatggattttaattgaattatgacgcaataatcaattatttttgaaaaggaaaaaggggtttattgcgtcagcggctagggttcgcggtgaaccgggtgcacggcggcggctcacggaaacgaacggccgagatcgattcatccaaaacggacggccaagatccatcggtccacgaccgggccacgggaaacgacgacgatgacgtcagcgggaccaccggcggcggctcgggcgcgcaaggttgccggcgaacgacggcgcgacgacgcgaacggaggacaccaacacgtagagggcgacgcggcgaactcaccggtgaccaaagcaacggcggaagatcaacggatggtgacagcgtcgaggaagaagcggcggcgaccttcggcttgacgacggcgacggtgttccagcggcccacagtgacgacggaggggcagacgaggtcggcgacggcttggcgatcacgacggtggctttcccgagcggcaacgacaaccggagcgacggcgacgcacggttggagctgcggcggcgacggcggcgcgaagctacacggggctagggcgctacgggcggcgacggacgaagacgagggtggcgacgggtagcggcgggcttgggggtccttttataggggttggaaggcggcggcgaaggcccacggcgaccggcgacgagaaggaaagtttagggttcagaggagagagacgaatccgattcgagatcgaatccacggatttccaaacgaaattagccgacgattccaaaagagaaaagatagaggggatcccggggatcatttcccctctattaatttcaccggaaacggaaaggggcggctggatttggaaggagacgacggcggcgcggcgctagggttcggccgggcgatggcgcgaggaagacaacggccctgacaggtgggccccacctgtcagcgggcagacgcgcgcgcgcgagctcggctgcgggccggattgggccaggagagagagaaggttccaaaagagaactttaaaaccttttccaatttaaattattcatgaaatgcaattccatttattaaaaatacttccttagctcaaataaatcccagaaaaatctaggaattatagaattaagcaaagtatttaatgaaattttatctggccccattttatattgaaatttattaattaaaactagatcttctcttctaggcttttaaaataaattctaataattccaatttagacaacaatttaaatatttgggatttttagtgtgtgacatgaagtgactggaatagatatactggattgggacaccaccatttttaatttctggcctttctggtatatcctccttcttcctctcgtgccctgtagaaccaattataagtcccttgcattcaaccctatggttccgattcacttgaataggatttgttccaactaactaggctctaaaaaaaatatcttatatattagaaggcatcttggtcccatcactctatccacctcgaagcaaagccgtcctcggctttcatgtaattttggaaacctcttgttgagattataaacacataatgatttaatttattccataaataaatcataatattgcagatgcaaactagcatgaacgtatcattggatctacacatgtacactaggcagtaaaacataaacagatcaaatatacgtaccatattgaacacgtaccgaggttgccgaaaaatcggttgctcagcaggaattactcgtggttgtgggcgttgacgaaggcgtgcaacacgcgagcgaagaggaagacgagccgtcgtggacgaacagggagcagtcgtgcgaagcgctttcaaaaacattattgccgcctctcccggtgcagaaagtcgaaggcagaggttctggagaactgctctcccgatcgccggtgcacgccggcgagcaggatggagtagtatacgagcgacggcgcagcacagagtaggaggcaaaccctggatgatttcgcgtgtgttgcgtggaagcggcggctcggtttatatagagaaaggttgctttatcagggcgcccgcatgatctctactccgcgtcgcttaatcagggtgcccgcacgatctccactccgcgtaactgaaccagatacactccgcgtaaccgaaccagataagtcgcgcataacttatccagatgccacgccgtttttcacgcaatggatttttcggtatgtttccaaaacaaacaaatctgaatttcccacagcaaaacaaaactgcaaaaggaggctgcatctgcgacaattcgacacgtacgtcgtgcacgcgcatcgccggcctagcccggcgagcaagcgcgcgtctgtccccctcttctctccacctcacatgcttcaagtggctaggagggcatcctcccttttaaggaggtctccctctcttagaataactccccatgcatgtcatcctatgaggtggtcttttgtgattttccaaagaattaatctttaagtgggctaagacccatctattaattccaacacctctttctttttcttcatagcaacaaacacatcagcctcaatagcactcctcgtcatcagtttcagcacatgttgcaccgccttgtgcacaaaagaataattattggactgaccaccatgtgtagcatcaagatcaaactgccatagtctacccaacaataaatgacatgcactcaatggcgcgacgtcagagtccactttatccacatactttccgatagaaaattttactctcaccttgtgagtaattttcagtataccactctgattcatccattgaatataacatggtgttggaagcctccggattggcaaagcaccaaatctaaactaacaacatttgtaaaacttccaccatcaattttaatttgcataccttctcacgaataatacattgcgactgaaaaatattggagcgttgtcccttcacaccattaacagtatagcttctacttcttgagccatcatggataaaccgtttttactcacctgtaactattggcttatagttaggatatgcgtaggttacgatagcataaatcaaaattttctaccgtgtaaaccaggaaccacatgcaagtataagatcatagatcgttaccactcgacgcgctgcatagcggaagaaagcgctaagaaggcaaagccaccctctgcgatgtagcgcgtgccgatatagaggaagtgctcgattgcaccggctcgaccttctcctcctcgtgcgttctcctcgtcgtgctcccacgccgatcagcaccgcaaagcagcagcgcctctaccggtattcacacgtacaaggacggaacaccatgcatagatgtgctagcacccgcgcgcggctagggttttgctcgggagggaagtgacggctagggtttctcgcatgatgcaataactccgccggtcacacccctcataaatatataggatccacgactcaggcctccaaggcctataggactcctattcagatccctatctgaactaaggtcatattggatctccatccaatccccttattctggcccattaagcgtgccaccttgtaggttcatgtacactcggctgtaacccgaaaactcattttcggtccacgtgtcaacagcggcccctagcagaacttattgaccaaccggacatacataaagatcatatcggctgaacctctagtatatacttgtataaacccctttgcctcacgatatcgattaagctcgaggctagatatgtgccatcctataatagctcaatcattcactcgaacttgtgatagattataaaacctgtgattgactcctcaatcacctttagcatggccatgcactttcataatctataatatcgaggggcccaaatatctctccataggaggggcaaatcccatattcttgattaattattcatatcccactacatgtttcattgcatacccgaaaactgttttataactacccaattacgaagtagtgtttagcagtccctaagcaagctactacacatcatagcaatccaaaattaagctaaggctaatctacaccgcacactttactctggagtcctggactcttttgtagttccccgactccctctccctaatggcagttgcagcttgcagtgccatatccatgtccccctcctatattccgtgctcacctcaacattctcctgggagttatctcctagctcagcaggtggccgccctgctctctctctcccttcctctccagtgggtatgtcctctctatttccttagatttgtggattgggcgtcagccgctggactggtgccgcaggacctcttattgcaaagataactcgtccaaattgcatgttgtagaggaccggaggatggagccactaaaatcgtgtgttgcagaggattaaaaggtgttgctgacgaggtgtacatatatatgtatgcaagccggtgcatatatatatatatatatatatatatatatatatatatatatatatatatatgtaatcttgccttaaattttgctttgagattaatttgaaatattgccttgtgtacacaatgatggaactaatcttcgtttattcatgacaaatacatgctctacacgtgcctaatcttgcatgccatatgtgattagattttgctttgacattaattttgaatcttgcctcccatacacaattatatggaactaatcttcgttagttcacgtttcagaattagttcacggttggaactaacccatacactgcacatgcgggccctagggaattctcaactctctcgttgcaccacgtggcgagcgttttgagggagacatgtggcagactgagagcgtttttagaaagtttaatggaattttagtatataatagatagatagataatagataatagataatagatagatagatagatagataatgtgttatctatttcaaggaacaatgttagataattatgtaaacatagtatgtgatacaatcatctatacgattgcctctaggacatatcacctatagtaacattagtggatgagtcaccaagaggatcatcagagaaagctgtagttaccaatcctggtgcagaagaaacttcagcactgctagcattcatgcattccctttgcactagaggttgatttgacatgccgattaggagaagaaaagtttttactatggaccactttaaacttcccataattattcatagcagcaattcttttgttgttcaagtctgaatactgatctctagctgcaaaaacacatacctctttatttttctttctactaacatctttgcaggacttaacgataatttgcttcgtggcaatagaaagattttcagcaaacataaacctcttcccatcaagttgggtcgcacaaccatgtgcattcagtaactcatctctgataatagatgcactccacgaagaacgtatagcctgcttcttggaagccttaaaatcttcacctacaatagccaacttctcaattggtgaatcatgttgttgacgcagcagcactttcatccccttccacgtcgctgtagatttgttcttcctgtagatttgaccaccactgcaaaacacgaaaagaaaatcgccgctctgcaaaatccaacatctgggagtctttgtagcatcttaattagcggcataaacatagatttcctgctagatcgaggaatagtagctagatcgaggagtctttgtgcatagcaccttcccaatcatagtagctagatcgaggaatagtagctagattgaaaagaaatcctccaacgcacatcttcacaatcatagtagctagatcgagcagtctttgtgcataatagcggcataaacatagatttcttcccgagccaatattcatccatcattgaaaaacagtagaaaaatttctaaatgaagaatgatcaacccaaagctttgatatcaatgtttttttgagcacgatcaggatgctattcacttcttgttcactcaggtctccgccgagtgatatgattttggcggggtcagagtcatctatctgcaaccagacaaccttgccgtggggacgggtttcagcgtcggcctggttctttcttgccgttcgacttctaaggtatgaactcccctgtcgaaggaggccacctatagatggccataaggcccgaggcccgaaggcccggcccatggcacggctttttggcccggcccaagcaccgcacggcttgacttgggtcgggcccgtgccagcctggcccgaccgccgggccgtgtctgggcctcccctccggcacgctgggctggcccggcacggtcaggccggcctggcatgatgggccggcaggccaggcatgccacacaaagtatagggactaaaaataaacatataaatgtcactgtccaaagaatagggaccttaaatagacttattttagctattgatatcacaacccaaagaaaagggaggtaaaatagactttttttagctatatatatgtcacagcccaataggagggaggaaaattagacttattctgaggaaaagcactatgggccatcgtgccttcgggccggcccggcacggccccaggcgtgttgggccgtgcctaggccgtgagtgcggcacgtgggctggcacggcatggcccggtgcgtcggtcgggccgtgtcggctcgacaagccttggcccaggcacgaccgggcctgggccgtgccgtgccgggtggcccacatggcgatctataaggccaccatggtagccgaaggatgggaacccttgacaactaccacaccggctgggctaggcatcttgagcttgaggtagttgtgataagagactgcttcaaacttggtcaaagtgcctcagccgaagatggcgttgtaattgtatgggatgtcaacaatgtcgaagagtatctcttcttctctcttgttttcttgtgtgccgaaggtgactttgaggtgggcttgacccaaaacttgcactacttcgcctccaaaccccctgagcgaggttggtgcttgggacaatgccagtgtcggcaaacccatcttggcatatgttccggcgaagatgacatcagccgaactgcctccataaatcaagatatgccgaacttcaataccaaccatctctgcaccaaccgatcctggtgtgggaaaaggactccttcagcatccttcggtctgaaggatatctgttgcgtcaagtatcttgggaccccttcgcctgccgaaacaatactatgcactgctcgaagttgcatctttttttgtcgtttcgacacttgcgagggggggataagatcttgtgatgacctagatcactcttcactgtgcatcttggcgctgttcagcctgaggtgcttggttgaggaccgcttcgcgcgttgcctcttcagccctggcttgctgctgcctgagcttttgagtgttgccttgctgccgaatgttccggcattgctcggttgtgtgcgaagagtgtccatgaacggcgtagtataggtctttcctgatctttttgcgaaaaggttgttgctggccgcccgcttgctgagcgtcgaactccttgcgaagggcttgcacttcttctcctgccatcactgctttgccagctcgatcagttctaaatttttccatgtcatcggggcatggttcggccttaaaggctgcccttgattcaccggaggggttgagtgaatcagaacgggtgccgaactagtaacttgggcttgaatttgagcttgtgcgtgagcttgcgcggtggccgtctcggctgcggctgttttgtcatattcggcttgtatctcttgccgccgcttggtatctttttcgcctcatgcataaccatcgattatgcgaaagaggtgttcgagcatccttggttccttgcgggcgatcttcctagtgagttcgcccttaagtaggccggtcgaagtagcgttgatgacagaggcttctgttatgtcttgcacttggcaccgtgcttgcgagaagcggcgcacgtattcccttgtcgattctcctggcctctggctaatgccgagaagaccttattgtgttttcggctcctcataagtgcctcgaaagttaagaacaaagacattgcgcaattgctcccatgagtaaatgctactagtaggcaaattaatataccaagatcgagcaatgccatcaagagcgaggtgaattaccttcgcctttgtattctcgtcaccatgggcagcttcgattgtggactcatagatggagaggaactccttcggatccgtttctcccgaataccttgggacatgagggaacttgaactggggtgggatgggatgattcttgatcccccaactcaacggcaaacccttttcgccatccgacttgatcatgacgccttgctgagaaggccagcttagctgcgggtacgggggcgcaaatgaggttgagcagcagctgttgattgatgccccgtgccaaacaccattggctggttttgttggtcagtcggagcagcttgcatcaccatagctgggtcgaacacgacttggttccaaacttgatttggtagtgggaccgctccgtagccagagggcacggcttgtgcgaaggtcatgggtgcttggaccgcggtgcttgggtcgaattgcggcagttggctttgaggcgatgccccttgggcttgacttgtgttaacgaccaaatttcataatctgagtatcaaagatagagatcagatcgaagcagaatctaaatccaagatcttttaggaaacagagcaagaatcggcaagagtccgaatcggctttgatcaggattagtagagtccgagttggacagggttagccgattgagccgaatcctacaatatgacaaagaatacattgtcgggttgagttaataagcttcatgatgattgccacgcatggatagaatcctgagaagacaattgtatctattaattaggatattttacgtaatttccttacagatatgtttgggcaaaagtctgccgcaaagacttatggtatcatagagtttgttagagataagagtcgtgtccgatgtgtacatattttgtaaatctcgcgtataaatagaccccgagccccatgtaatcaaact

SEQ ID NO: 16561 - DNA, 589 bp, Oryza sativa
atatcgccatctaacctacaatcggctatcgtctgttaatagaagccacccgagtaggttaaacaccaatgttgacttagattatatagaatatctaccactctatgaaacatccggcggcttgattgtctagatattgtccttctttttatacttatagctgcatcagttgagtctgatcttatgagtcgtgattagaatctcaatctctagcctgcttttggttgccgattagggtagcatcggggtttcagccgatcttacctgatttaactacttttatcttatgtgcttgattgacatgttaaatctgccctttatgttaagatcttgtagcatttaagtatattaggctttcgtttggtatattttacttgctttaatatgttaatatagagtggtatctgttaacaaccaaatttggtaatatcggcattgggaaagaagattagatcgatgcaaagtcggaggcggagatcgagttcggaaacagagcaggaatcggctggagtccagatcggctacaaattggatcggctgggtctgagtcgggctaggtaagccgatgcagccgattccgacaatgcaa

SEQ ID NO: 16562 - DNA, 10550 bp, Oryza sativa
tttataattgcaatgcacaggtaatgacttcttctgatgcacaggtaatgcctatattgaaccatattgtagaaaagagcttcttatcagtattcatatctcactgaaacctcactatacaaaatgaactctaggctagttttttactctgtcaggttaattttgtaagaaagattgcggagcattagtgctttgagatccttgatattttttacaatagtatcagtgatattttttttacacaaaaaagtattgtcacaacaaagttttgtcaggtttgaaagtgaaacctggagcctctcatttctggcaaggaattatggatgtgaaagaagtgttttataaatcctgtactaatgtagtaggcaatggaaggaatactttgttttgggaagataattggataggaggtaaacctttggctgaacagttccgtgatttgtacaatattactttgacaaaaaagattactgtggcagatgtgaaacaggtggggattgactctattaaattcagaagagatgtcctggggaataaactgctgaaaattaagcaatcctggagtgatttggttctggaagatggaaccagagatacacttcggtggaatttgaccaaagatgggaaattcactgttaaatcctttcacacagctctgaagatgcaacaggtgattttcccgcataaaaagatatggggcttgaaagtgcctttgaaaatcaaaatttttatttggatgtttacaaaaaacaagattctcacaaaggacaatcttttcaagaggggctggagaaaagggaaggctaattgtcaattctgtgaccaaacagaaactttacaacctcttttttattgccctttagctagactgttatggaatattgtgaaatgtgcccttaatataaattctgtgttgaatagacaagatctgtttggatcttggatgaacaagattgataaatttacgaaaaaacttgtggtagtgggtcttgcggcaataatatggacaatctggaaatttcgtaataaagcttgttttgagaaaaaactcccagctgatcctactgatctggtgtttatggcttgctctttggtggactcgtgggcaactttgcagaagcaggagggaagtcgaagaaatcttcaactgggggccaggttgctaaaacaagtggtaaatgaagtctacaactcgaagctcggctggagaggaggtgttcgaaggattaggtcataactcaggaaaggaaatgtttactgagtattttgtgtggatggaatgagcaaagatagctctgtaatagacaatctagctatggtctttgtttttttcttttgcataagggtcggatgtcctccctcagatgttttagtttttatttttctgttttctgtttagtactctggtagtctgacttgatctcatttctagtaaaagaaatgggggcttcatgccctagctcaaaaaaaaaatcagtaattaactcttcagggatcaaaataataaagatttttgaaaactgcgaaatacaaaattgcaagtttgatctgaaactgcggtgaataatccattttgcattaacattagtgcagtacatgttatcatagctatgtagtggaatttggtacttctagaagatcttaaactggatgacaattacaacatcaacaatgtatagtctggataaaaaaatggattcaattatgcagttcagcatattcaactctacaactaaaattcactgaaagtatccccttacctttctatatgaacagaaatcaactgcaagggtgagaatagaatgcaggcttgcgctggagcatggcaatgaagataatttgtcgctcagcattgctgtgcgagtgcacagaggaagatatagtggtagacatggggaggggaagtggagcggcggtgggcgcaggggagctgcaagccagcggcatggctggagagggagaggaggatgtgccgatggatggtatcaatttcatagggctcgcagcatcgctgaacatttggtgattgggagcgcactgatgttcgcgggggagaccagacgctgtcagcctggccagatttttttttaatcccccgtggggtgtctttgtattaaagaagaagagaattgacccagtttataaggaaaaccggacccgaaaaccatacagctgcacggttaattatgggaaaccggctgaaacccactgcacagagaagagaaagggacctagctacacaactaacaaaaacggcggagcctaaccgcaggatgttgctgccaatctaacacaaaagcaacacaacagcttcgacttcacagaagaggtgttatcattgccgagctaaccacccaagcgatccagcagcgccggcttcacaactgcagcgataatgaagcgaaagttgccaaagcgaaaagcatctccgacatcttacaatggacatcagccaagccaccaaagagccacttcattcacacggctagcaccaactccctggaagagactgcaacatgtcatcgttgccaagcgtcgctgcatccatcagcgagcagctccgacttcataagcagaaacagccgaagagcgtgttgcccaccgcaagaacaaagcgacccaagaaggcgaagggcctcgccaaaccccaagatatgaaagcttttaaacccaaaagaccatcaacagtcgtcgattcataggaacttctctgaagcgacgcccccaaggaggacatgacgtgtaacactgctgccgctcgtccgaaagccggaacaaggttttcacctagagatttgtgggggatataaaagaaacgcccagacaatgcctccaagaaggaaaacggcacccacgggcgtcgtcgttgttaaactggccaaaggcacgacaaggctttcgtcagcgtcttcacatcacccacacaaaacacccccaaatcgacggccataggacagtctataacgtctcgcaagcagtcataccttaattgtagttaacggcaaagatgggctcatggccaccctcgaagcgccatcaagacaagccccattcctgcttcacgccagcacaaaccgtcgtcctgccaactccacatcctcacatcaccgcccacgaaccatgaaatccgccaccggcccctgtcgagcagggggctcgctgccagagtgcaaccccaccggagcccgcctagcgacgccgtgcagccgccgaactcgccgcaacgtgcccgagccgcgggcagccagatctgcctgcggcagtcgcccccctccggcctcatccctccggtcgcatccctcgcgccaccgccgtccggtgggcgagcatcaatgatgcaagaggggaggataggcgccactgccgccgatgagttggtcagccaccaccggtcgtgccgcgcccccgccggtgctaaggccacgatgaccttcgtcctcgcgctgccgacacctctttcgcgtgaccgacgcctccttcttcctcgcgcacagtagcgcaacgccgccactgtggcagcctccaccgttgtcggcctcacctcctcgctcgtgacgcaccgtgctccgtcgttgctggctgcaccgcctagccgtagccgcgccagccagtgccgccgtcgccgcacaagttctaagcatgcctccgtcatccgctgaggccgcgggcttccaccgcgctcctccggcgtcggccaccttcgcctgccggccacagccgttgcatcgcccgcctcaaccagctgtcgtcgcagtggacagtcgctggctagatccgcgctccggagggccagatccaccaccggtgtgctcggatccgttgcggctgacgccccgttgactgtcaccctgtcgcccgccacggccgctgacttccgaccggcacgcaccactctgcctcccacgaggctggccggatttggtgccattgagtttgttgcggctggatctgatgagggatgcagcgtggcctggacagggaggcagcgatgacggagacatggacagtggaggagccaaggaggcaggtgtggtggtgaggggatgcgacgcgacggcggcggcggtgcggcgatgggagaggacggcgaagtaggccatgcgagaggagtcatggaggaaccatggatgggagaggaagggtggaggaaccaaaaaggttcagttctagacatattgtggtgtggaagaatctaggttttattgaagtttcatgaaggatcttcatggtcttttgccatttgagccatccgacggttcatattggctggtgataacatcggacggttcaagttttcttgatgacgtggatacataattttgcgagaagacacccctttcacttatttagattatattgttggattcgttacaactacataacaacatttaagaaggctctattccgacaatttttttttactttttaaatgttgcacatatctttagtgaaatatgcaatgttccaacaagtatctattgatgtttcactatttcatttgcaatgttgcacgttatctttttatatgtctcagcaattacaattcgatgtttcaaaatcaaatatttgcaaatgtattgtattgtatgaattttttagtgtttcactagttgggacataatatttcatgtaataacaattattgttgcagtcaaaactttttatatgttgcatctctataaaacatctgcacaagtgatgaagcaatttttttttgtaaatgctgcaacaaaagtttgatttttctagaacacacatatatacttttataaaaatatatttatgtgagatcttgttataaagatttaagtatgacaaataaaatggtataattaaattatagattggatatatattttagaagaaaactttgtttagagtttgattaaaaatggagagagaaagtaatgatgaatcagtgcaccttggtaaccagccttgctcctctatgcgtgtgacacatagtaaaaaaacaagaccggtggttgacccgttctgatcgtcggttcaccggtcgaaccgccgggtcagacacaactagccttgctcctcactacatgcatgctacagacgtggccctgcatgcgacaaatgcgtagcagcatacaatttgtagctttctccccacatccatgctgggtgccgacccgttactgatgtacatagttgtaacggttgaactcttttgaacaatcagtgatgtggaaaagaaaatcccagccgtttatcgacctagacgtggccgtccttccactctcggtcctcactcattgtcagtgcctccaccaggccaccgcttgatgtgtcatgcccacaggcaacattgtggaagaggcgctgtgaagaggacatggccagatctgttgctgtcatcatgccggccttgtgtcccgtcatcaaagctaagtggaggatcgatctataccaactatagagaggtgaatggttaaaatacccaaaaaccaaaacttttagcagaattaaaagttaccatcaaatcgatgtaaatcggcctgaccgtagatcttgcaccgctccactactgtagaactgatatggattaaagatcatttgtagtcccggttataaagtgcaaccggaccatataatatttacttccgattggtaacacctattgaaattaaagatgatatttagtcctagatcactttatgttaaggggctgtcaggggccatggcatctttagtcaaccggggctaaaaatcatgactttagatctttagttctttagttcggttggtagcaccaaccggggctaaagataaaaacatttataacattcttcttcctcttccaacccgagcaattgctgcaaagatttgtaggaggaagggaggtgctgccaaaattttttgtgtaagtgttttggtgataatatacaaatcagagggatctagaaggttagcaactctcgaatgatgtatgcttagcatattacatttatggaaaaattcgctactatacattaaaaaacgtgtatttagctggtggacatcgcaaaaacacgaatttggtgtcgggcatcacaaaaaatggtaattagctgatggacactcgcagccatatcttattatttccgggggaattggaaagagaaaatgatgtgagagtacgattttgcccctgcgcggcttcaatccatcaccgccatcgccgaaactggtcgtcgactacgccgccgctactacttcctcatgcctgtagtaccccaaggcgctcctattccagtcgccgcggttgccgagaccgagaacgcgatgtagtcgaatcgtctccacctccccttcaaggacagcgcccgcaccgccgtgccagtgccgcatctgggcctccacgtcgctcgtcggcgacgcctacctcctctccaacgacgacaaagacgatggcgaacggcgcccgcaccgccatgctgtccccatgctggcgccacagccgcatctgggcctccacgccactcgtcctcgacgatatagatggccaaaacgcccgaggcccgacggcccagcccacggcacagcgttttggcccggcccaagcacggcacggcccgtcaagggtcgggcccgtgccggcccggcccgactaccgggccgtgcctgggcctctctgccggcacgttgggccggcacggcacggccgggccggcatggcacgatgggccgcatgccaagcccaacacataaacaatagggagtaaaaatagacatattttatgccacagtcgaaagaatagggacgtaaaatagacttattttacctatatatatgtcagcccaaagaggagggacgaaaaatagacttattttcactatatatatgtcacagcccaaagtggagggacgaaaactagacttatttaaaaaaggaacgatgggccacccgcgccttcaggccggcccggcacggcccgacagctggtgggccgtgcctgggcgggaggcgcagcccatgggccggcacggccctgcacgaagtgccaatcgggccgtgcaggcccgatggctggtgggccgtgcctggccgtgtctgggccgggccttttggccatctatactccccgacgacgatgacgacgacgacggtggacggcgcccgcaccgccgtgttgtccccgtgctagcgccgctgccgcatcaggcctctacgctgctcatcctcgatgacaccgacctcctccccaacgatgacgatgacggcgaggaccggacggcacccacatcgtcgtgctgtcccgtgctgtcgccgcatctgggcgctgctaagggcacccatcgtcgtgctggcacccgcatcgtcgtgctgtcgccatgctcagtgttctcgctgccaagggcgtccaggagctcatgctgctcagcgtgctggcgtcgctcctttccttaccagagagcaagttaccaagggcaaatttatctttaaagagtgtttctctctccaattcctccaaaaataataaaataacgcaacgagtgtccatcagctaatttccagttttttttttgcccaacaacaaattcgcgttcttgcgatgtctaccagctaattacatgctatttggatgtcctatagcaaattttgcctacatttatagctatgttttttatatattattgtgtctaaaaaggttgatggaaaatgatgagagagaaaatttgtttagggaaaattaggctacttttaaaatataaacatgtggataaaatgttgtaaaagagataacaaaggaaaaatgtagaaaattaagataaaagaatagaaaactaagttaatttaataaaatagttagaaaaagtacaatgtattaaagatatgcttagaactttaaaaatagttaaaacatgaataatatgtgggagtattgtataattattgtacgattatttatatataattattgtatgattatttaattagtttgactttcgtggattttatttttacgatttttgtgcatttcaggtaagtggatcggcaatgtgtgtacactgtggaccgatggtcgaaagagtttatagaaggcgtgtattattttttgagtgtggccaatattaacaagcataagggttttatgtgttgtccacgcaaaaagtgaaaaaaccagaaggagtattctacatcaagaacatttcatgcccacttgtttcagtcggggttcatgcctagctataattgttggacctcacatggaaagctaggggttgcaatggaataaggtgaactagaagaagagaacatttcggactgtgcgcctcaataaggtggatttcaaaaaaatacaaagggcgaggcgaacggggcttttgaagataacgatagtgtggatgatcttggtcatatgttgcacaatgtaaaggaggactgtgaaagtgaaaaggtggtccagaaattggagcgtatgttagcagaccacaaaacgtcattatgtcctggttatgaacaggggcacaaaacgttgggcaccacgctagaattcttgcaatgaaaagtcaaaaatggtgtgagttacaaggcatttggcgagttattgaaactcgtaaagaacattattccggagggaaacagattgccctaaataacattcgaagctaagaggtagtctgccctctaggactggaagtacagaagatacacgcatgtccaaatgattgtatcctctatctccgtgaggaatacgagaacctagaagaatgcctggtttgtaaagcactacgatacaagattagaggagatgatccagccttcgaagaagagagttcctcctaaggtgatgtggtatttccctataataccacggctcaggcgcttgttcaagaacaaagcgcatgccagaatgatgccgggcacgcagaagaacgtcaacaagacgggatgctgagagacaccccgttgatgggttgcagtgatgaaacatcgaatgaacatttcaatacttcggagaggatgaacgaaacgtaaggttaggtttaagtaccaatggcatgtatctatttgaagagatgagcagcgcccatagcgcttggcctgttcccatgtgtatctacaccttcccccttgggtatgcatgaagcagaagtacatcatgatgccgattattatttaatgccaagagcaacctggtaacgacattgatgtgtacctaagaccattggatgaacatctgaaactgccggggaagaaagaaggtgtttgttagcattaacgattggcctgcacctagcaacttatccgaacagtcaaacaaggggtataaggcttgcacccactgtatggataaaactgaaaatacgtatatgaaacattgtaggcaggttgtgtacatgggccatcatcgattccttatttcaagccacccattccggaagaaaggcaagcatttcgaacagaatgaagaccgccgtactaagcctaaacatcgcaacggaaaagtcttgtttactctggtgaaagatctagaagccatgtatgaaatgtctatatatggctcttatgaagagatgtaacaatgaatagaattaatcaaatatgttgatttctagcttggaggattcctccaaagttagatgactgcaaccatctgttataatacttacatgtatggctaatgttgggtttttctatgttttctataaattttatattattcttttttttattttagatactaaccccaggcatatctactgaggctaatgttttgatatctctgatcttgtttattttcttccacttcttgtgttgctccatccaaaatactcatcccaggcgtatctattgtggcatgtaattttagacattgcaaatatgcatatttctctaccgaatatggctttagatgactccagttagagcatgcccaacagctaccgaatactgctaccaatctcagattttttaattcctatggaaaaaagtagttccagcatttcccctatatgccaaaaaattggaaaccccatctccatatatctcgctctccacaagttgggtgtcctcctcattccctatccctggatctgagggcaagtgcgagggaacgtcggtaggattgaaaaaatagatttattcgttacatggcccatttttaagttttaggcatctgttggaaagacaaatattttcacccctcaaattccatttagggttctccaaaataaaatttggggatagatttttgaacatctcttggtgatgctcttggtttacgctgatttcaagtaatacatgcaaattaacattgatgtccatttgtcagacacagtaatctccatcatttctgtatgatctgatattggagcaaatccgcaggtttgataattttcagtaatctcaaccatacatcttttctaatctaataaatcatgtttatctatactaattactatctcaactactggtagaagaatagttttctgtgctagcaatagaactcataaatgaatgtttgagatcacttctacttatgataatactggcagtacaaggagagacccacataaagttactctttcttgtaattgtgcgagaaaaa

SEQ ID NO: 16563 - DNA, 1103 bp, Oryza sativa
cttggatcgagtacccaaaggaaaaattgtcttccaaaccaagtctccaacttgaaacaactttcctttcacccttttgttgtatgccttggccaccctcttcttctctttctctatctcctccaatgccctcaagcgcttgtcgatgacttcatcaagattatctcccatcaacgtcttgtaatcttcacttgacaaatcatcttgcttgatataacgaagagaaccaagatttacctcaaccgataaaacggcttctttaccataaactaactcaaaaggagtgactttagtggcaccatgtttagatatcctatgcgcccacaatgcttcggaaagcacctcatgccacctctttgggtgttcctcaatcttcttttttactagcttcaacaatgtcttattactcgactcggcttgtccattagcctaagcgtagtaaggagaagaactcaacaatttaatactataagattcggtaaaactcttcacttcctaagacataaaagaagccccttggtccgtagttaatgtttgcggaataccgaatctatgaataatatgcttcaaactacagtcaataaccattcatatgatgtcatatacttcaaaggcacagtttctgcccacttagtgaagtaatccgtaacaactagcacgaacttatgcccctttgataatgaaggataaatttgaccaacgaaatctaaagcccaccctcggaatggccatggtttgattatgggattcaacacggcggcgggcgccaattgaacattgccgaaccgtagacaagcctcacatcctctataatatttgaagcaatcatcaatcatcctccgccaatagaatcccgctcttctaagcaaccaattcatcttgtgggccgattgatgagttccacaaattccttcatgtacctcccccatagccactttagattgatcttcatctaagcacttcaacaagacaccatcaagcaatgtgtatttgaacgattgccgccgaattttccgatcaaccttaagtgtgggatccttcaaatattgaatcaaaggaattctccaatcttcttctgtcacctgggcacaaatgtccgaatt

SEQ ID NO: 16564 - DNA, 767 bp, Oryza sativa
tttggttggacaacctgatgttttcaattatgcgagctcaagctagccaccgacaatttcagttctcaaaatatcctaggggaaggtggattcgggccggtgtataaggttcttgtttcccataattaatcatgtacaattggatataaattaatgtgatttggcttttgagtgttgcattttagcaatattttgtccatgctcaaaatatacatgtaacaaatttggcagggtaagctacatgataaaagagttatagctgtgaagcaactttctcagtcatctcatcagggggcaagcgagtttgtgacagaggttgcaacaatttcggccgtgcaacatcggaatcttgtgagattgcatggatgttgtattgacagtaaaacacccttgttggtttatgaataccttgaaaatggaagcttggatcaagcaatctttggtgagttcacatctgcaaaatagcatgcacacctgcagcactaataaaactatatttgtttaattcacaaataaatatttttgtttcatgaataatagttgaggattttgcctttttctgcattttgttataatttgcattcatgatattaatagagctatttcttcttgtaaaggtgacagtagcttaaacctagactgggtaacacgcttcgaaatcattttaggcatagcaagtggtctaacttatcttcatgaggagtcaagtgtgcgcattgtgcacagggacatcaaagccagcaatgtcttacttgacactgacctca

SEQ ID NO: 16565 - DNA, 3267 bp, Oryza sativa
aacttcatcaacagatggaagccctgaacctaagcatagttggtcgtggattcttggctacgctggaagccaagcccaccttgctcgatcaaatctgcgaggctcaaaagaatgatccagatatgcatgggatcctcaagaatatgaaacaaggtaaagccgctggtttcacagaagatgaacatggaaccctatggaacggaaatggtgtatgcgttccggacgacaaggaacttaaacagctgatacttcaggaagctcacgaaagtccttattccatccaccctggcagtacgaagatgtacttagacttaaaagggaaatactggtgggttagtatgaagcgggaaattgcagagttcgtggccctttgtgatgtgtgccagcgtgtcaaggcagagcatcaacggccggccggacttctccaacctctacaagtaccagaatggaaatgggatgaaattgggatggatttcatcatcggacttccaaaaacccaaggcggttatgactctatatgggtagtcgtggaccgactaaccaaggtagctcggttcattcccgtgaagaccacctatggagggaacaaactagctgaactctacttcgctaggatcgtaagtctccatggcgttcctaaaaaaagtatatctgatcggggacgccagttcacctctcatttctggaagaaagctccagaagagttgggtacccgattaaatttcagcaccgcgtatcacccgcagacagatggacagaccgagcgtctaaataagatcctagaagatatgctccgtgcttgtgttctagatttcgggaagacctgggataagagtctcccctatgccgagttctcctacaataacagctaccaagccagcatacaaatggcaccctatgaagcgttgtatggacgcaaatgctggacaccgctattgtgggaccaagttggggaaagccaagtgttcgggactgataacttgagagaagctgaagcgaaagtcagaaccattcgggagaatctaaagttggcccagtctcggtagaagagttatgcagacaaccgacgccgtgacctggaattcgcagtggatgactttgtctatcttcgggtcacgccgttgcgaggcgtacgtcggtttcagacgaaagggaagctcgcacctcggttcgtgggtcctttccgtatcattgctcgacgcggagaagtcgcttaccagttggagctgcccgcatcattgggcaacgtgcatgatgtgttccatgtgtcgcaactcaagaaatgtcttcgagtgccatccgagcaggccgactcagagcaaattgaagttcgcgaagacttgacctacgtggagagaccagtgaaaatcttggacaccatggagcgcaggaccaagaaccgggtaatccgtttttgcaaggtccaatggagcaaccacgccaaggaagaagctacttgggaacgtgaagacgagctaaagtcagcccatcccgatctcttcgccagttcttccgaatctcggggtcgagattccgtttaacgggggtaggtttgtcacgtcccaaaacgtgtaaataaatttcctaaaagtcaattaaggcttagaggatttttgtatatttcctaaaagcctaaaatgtgtaaataaattttagtggaattctcagagcacaaataataattattaagaaataaacaaagttaaaatgattttataaaaagaaaaaccctaatgggccgaattcggcccatctccctccccctctctctcctctccccgcggcccactcggcctctccctgcgcgcgcgccgctgacgggcaggcccgcccgccaccctcgctgacgggtggggcccacccgtcatcccctttctcccaccgctcccgccgcctcccccgcaccctagcgccgccgccgccgcgaatcccgccgcctcccgccgtccccgcgtgcaataaagtggggggaatcactccccgtgatcccctctcccattccacccaattttgcatccctctctcccttggattcgtttggaaaccctcccctaatcccgccggcgccattgatggagcccgagagcgccacgccggtttccttcccctccggccactctctccctcttccaaccctatttaaaccctccccgcacctccttcgtccgtttctgcctctcgccgcccttcctcctcgccggatttgagctcgcgacgtcactctctctctccgccgtcgccgccgagcttcggtccgccgccgtcgtcgccccggaccgcctcccacctcggcgccgcctccttcgggttcaccgcatcctcgccaacctcgtccacctctccgtttcggtcgccaaccaccggagcgccgccgacgccatcgacccgagccgcgccgccgcctccctccactccggccgcctcctccgtcgccgccgtcgacctagggtgagccgtggaccgtcgcctcctttcccccttccctcccctctctcggccgccgctccgccgtgccggtggtcgccggcggcgaccatcggggcgcgggcgcgccgcctcccgccgaccgcgccagcgtggccgccctcgtgcgcgccgagtggctgccgcgtggggcccggccgtcagccgcccgcgcccttgggtgcggctgacacgtgggacccacggcgccggctggtgcgagcccaggtgcgcccggtccactgtgggccgtgaggctgccgcgtgggccccactcccgtggacccggtccgcgcgtcccctcccccttggctgacgcaataaacccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttctttttcgttggtcgtgtagatgctgcagcttcggaagatccgctcttcgtggaggttgaagccgacgtttgggaaagcgagcaaggcaagtcacatcatccttgagcatattgaatcctagtttataaaattattttgatttaaattattgcattatcgctttacttaaattcacgcgttatcactgttttatctagccatgcctatttacctttgttatgaccttattattgttattgttattattaccttgttcaccctagattaaaccaaacc

SEQ ID NO: 16566 - DNA, 2056 bp, Oryza sativa
atagctctaggaccgtgtttacaaaatagctttgagcaactaagtgtcttttagtgtagtttactgcaaaccctaaccccctatattatggctcccttgtactcccttgcatttattctgcacttgtggttttgtcttgttgagtacggtggttgtactcagtcttgctcaatttttcccaaacccagaagaggagcccctggaagataaaggcttttgtgtctagctcgtgcctgccgtcaagcgcctgtggtcgtcgccctagtcttccgctgtttttcgtttgtcttcttgtgtgctgggccttcgctgcccatgtaataaattaactatgtacgcttccgcttgtcaaactctgaattgtatcaacttttggtgtaccttgcctcctgggacaaggaataatgcacacacgtaaggaacgcccgttgggttatttccggtcgtgacatttgccgatgtacaatagccgatattgttatatcacccttagttgttttataattttatcaatgtttttgtcattgtaaaattaggggggcacatatatatcaaaagcatgttgacagaaaacacgaggcctgggagatctgcttaaatccagtgctggtccaaagctcgccttcgaatgtatgagcgtgccagttgatttgatcctgtaatcaacaagaaatagaagcaaagaaaccgcagttaaatctataaatgatagccgatcggctaggtgccgatgacatatcatttatctttgagccgatgtcatatatgcatcgatcggcagtcattaataaataagaagggactaaatctactcgattggctgtagatattaacaatatataatcattatatcgatatatacttaaatcaagtgattgggatagatcggtcgccatgccgagacagaataaatcacttagatcgaaatatatattaataatgagactatatacgttcatagcataaccgatcagatagatctagcatgtatcggctaatactccgataccactctatattaagatattaaagcaagtagaatatactaaacaaaagcctaatatacttaaatgcagcaagatcttaacgtaaagggcagatttaacatgtcaatcaagcatataggataaaaagtagttaaatcaggtaagatcggctgaaactccgatactaccctaatcagcaaccaagaagcgggctagagattgagattataatcacgactcataagatcaaacttaactgatgcagctataagtatgaaaagaaggacaatatctagacaatcaagccattggatgtgtcatagagtggtagatatcctatataatctaagtcaacatcggtatttaacctaatcggctgccttctattgacggatgttagccgattgtaggttagatatcgatattgccaaggattatgtaggatatatgataactcgacgaaatacataaacaagattagagtgtcataaagatggaagcactaatcccaagaacgcaagccgccataacaagttttacctcttgttgaagatcgaaaccgatgcagctcaacccgaaagcaagaactcgtcgaaataaaactaaagcaaaaaggtagcgttgcgccgggattgtattgaacgtgtgtgttaaaagtaacataggactcgggtctatttatacccaaaaatcacaagatatgtccataacggacacgactactatctctaagaaactctaagataccataagtctgtacggcagacttttgcccaagcatatctccaaggagattacataaaacatcctaattaatagatacaattgccttctcaggactctatccatgtgcggcaatcacctcgaagcgccttaattcaacccgatatcatacatcaggttgcattgtcaaaatcggctgcatcggcttacctagcccgactcagacccagccgatcctaatcgtagccgatctggactccagccgattcctgctctatttctgaactcgatctccgcctccaactatgcttcgatctaatcttctttcccaatgccgatattacaaa

SEQ ID NO: 16567 - DNA, 444 bp, Oryza sativa
gtgctgcagtagtcttttgtgtcctggtctctatgtgattggagttttgtagctattacttagcgaatgcctcagtggctaagttatcactattttgctgcacacttccatgaatttgatataatgcaagtgacttatcgtgagctattatatgctttgcagttgatcacttgattgtaccgttgattgctttacgagccagctagtattttctttgcatgcccaaaattttgctttactatcccagtttttcaagttagtactataatgatctgatcaagcattcttacattatgatctggtaccttagcttggtttccatgttgctggttgtgttaagagaacaattggtgacctcactatgtaactgacatgattcttgatttgttggtgaagctagaactacatctgtcaaggctttataatacaggcacctgaaattac

SEQ ID NO: 16568 - DNA, 1123 bp, Oryza sativa
agtgatctagcccgctctacccatcaaaatcccgtaatcttagaacgtatagacactcagatcagacagaaggatcgggaaaataagaccaaaacactggatcgagcgggcaccagtaacagccatctaacacgggcagaaacagtagaacctaagtgctcgtcagaacccaatacgcccgccacgaactcagcaccaggcgcggacatcgaggtgccatccaccccgaagagatccacacgacagcatccaaactctgaccgcgcgatcgacggattcaaatcgaaccaaggcacgtcacgggcagaacagatcagaacccccaacactcggcatgatctgatcggtaaagaggggatccctcaccgcgtccatctcgtggcgtcggagactggggaccggaggcgaggatgaggggggttggaatcgcggcgtcacggagcggaggaccgagccgagaggaagggggagaacgacgacgacgacgacgtggtagagcgtgggcctggtcaaaggcggaggcttaatattcggatctgggccgttgattttttttgagcccacaaaccagacgagcgatcgtggcactggcctgtaatgttgtgggccggaaaaggcccaactcggtgatacaaattataggcctgttcagttcaatgccaaaaccaaccatatcgaagtttggcaccttctcatcacaaaccttttcaatccctaccaacattttcacaaaactatatcaaaatttagcaaggtgtcaaactaaacaccgctttcacatcttcatttaaccaaaattttagctttatcagtttttggcttaccaacaaatggtaagtttttttttaatgaaccgaagaggccctatctcgctctctttattttttcagaaaaaaaaagattgcaagtacaattaagtggtggctactctgatgcggccaaacattgcgttgggttcgtgcatcgcatgtccgagaaatcaaaatcacgcagccggatcgatccgaatctgttcgacgcaggctcggcagaaatccggcgtgggcgctgcaaatctgcaatgggaaagcgacggcgcaacctaaatcgcttgtttgttctgttcacaggtgacggatccgaa

SEQ ID NO: 16569 - DNA, 13259 bp, Oryza sativa
  unsure (1)..(13259): unsure at all n locations
gtacagtagctcatcacaacacccttaactttttgttatatctctcctccatataagcttatagtaggtttatagctcactattatacttgctcttatgaaggacaggggaatgataaatagggtgtgagctgaaaaggcatatctatttgggttatggtttcccctagttgaaacaactaaaatataagtactttggttaaactcaatccaagtgattgaggcctgaagaacgacattcagggtgcagttataattttttttccctatctccctgtctataaagcagctttactttaggatcggactagtaataatcaactttagagctcagtgtatatatctccaaaacatgacgacgtcaaaactatatgtgttgatgtctttgtcgtagttgttctcactcttccaagtgagagtccttgcaatgtgcaactccgtttttatgtcagatatgatggaaaagacatgcctttaccttaaataaatctccgcaaatgtaacacgatgatgggcaagtccaacaacaaatttcagctttcccctatcacttggttaggtcaatagaagcttctagaccagatcgcctctatgtgaaactatggtgaatttggtttacttttgctaatacattgcataaggattatcatgcaagtgctgtgtaaatacattacattctattccattatctaaaagaatgcatcgcatttcttttcttcttcgtacttcacacgaaaacaaggattcttggatgaaatattctggttgctctcgaagttactcgccgtcataggctccagcttataaatttatggattattcctgccacaaactttaaattatgatttttctatatatattctgcattaatataatattgcttagataacttgttctaaaatacttttatgtttataatatgtaatatttaattaatccttataagcattaattatccatatatccaatcatttataaagaacaaaaaccataatcaaatgctgagagatatatatcatatttttcgtataaaacttattacctctagataagtacctcgagattctaaaatttgtgtgtaaaattttagtacctacaaatattttctcaaacgtaaaatttgtcattttctaaacattataattcagaactatttgactacatatatgcaccaagaggtttcttattccaagtatatacatgttgaattgtgcgtgtgcatataaaagtttgtgtacattcttgaccatatgaatacttcttacctttcaaatcaatatattgaacgcaaaaacggaaaaacctaacaattttatttcctaaaaaatacagtagtcaagcagctgctatagtcagcaaatatagttagctactttcatcgctcacataactcatcaatagattatacacaaagttatctcctcaatagaccgaggatatagatcatactgttgtcagttgacaaggttggcagccactcttttctcatttaggagtatatgtaagattagtcttgcctaacattctccagtcatacgcattccaattaatattgtgtcttactccctccgttccgtaaaaacaaatatagtacgtgatatataactttgtagtattacgaaatattaggagcaatcgtttctattttggcttgtaattagagggcgtttaattagctactcaaaaaaaatactccatttgttttaaaaaaacaaatatagtagcttgatttataatttacaaggatcgaaattaaggagcaatggtttctattttgacttgtaaccaaaggacgtttaattggtcataaaaaatactcgagatataacctattttattaccgtgaatttagacagagatagaaaaaccattgctccttcttatccttgtaataaatcaaactataaatgaacccaatcccttaacaacatgtagtaccatcataaatatatcattataatcatggaatgacggaatatgttagtacataatcttaatagccaacatttactgagccatctttatgtcatatagtacactaatcatctactaaagaaaagaagaacaataattattgctattttaattccttacaatatttttggccaccgattgaaagtgtgtttatttgacccattttgtcatcctaaattagtttggtagtcacagtcttcaatcaacccgagttataattccttgtcctctcctccaccgtaacccgaacagctcttcttgtcaaggttaacaaaaccgtatgattatcgtacgttatagtggttatcacgtacggtaatcttttcaactttttaaaaatacggtataccacgctgtaagcctgtaacgtcgtcccaaacaatttggcgaagctaggtgaggtgacgctaaaccccgcttcttgccgacctgagagtcggagagtctcggcacgacacgacgagaacgatctgataaacactcgaccgcaacgtccccacacgaaaaacgtccagggtcgggtggggtgaaccgtgtccacccaccaaactccaccagtccacccccatccatccctgactgtccgactccgagcccatcgcttgcggtcgccatcccaccaaccacccccctcgccccacgcgggccccacccgtcgccttcttcaacgaacgacgccacacggggtggaagaaaacccgaaaaataggaggaaaccgacgggggaaagccgcaaaaaaaaaaaaagttgagagaaaaccagagtgagctgcgcagctcatgacacatgatggtgagctacgcctacgcgagctcggagctcagctctaccggccccgcacgccgccgtcgcccgtcgcctataaaagccgctccacccccaacgagcccaccagctgctctccaccaagagctgctccgcccccctaccccgcaacccgttgctttgtgccgcgcctcgctttggtcttcatccgcctcagatctgattcgttctaggttggtctggtgagtggtgcttggcgtttttgttttttgttttttttttgttttcgtgtgtgaggggattgggatgctcacgaggtgtttggtggtatgcgtgggcggcggcggcggcggtggcaggggaagatggcgatcacggtgaggcggtcgacgatggtgcggccggcgtgggagacgccgcgggtgcggctgtggaactcgaacctcgacctcgtggtgccgcggttccacaccccaagcgtctacttctaccgccggggccccgagggagggggcgcgccggaggggttcttcgacggggagcggatgcggcgcgcgctggcggaggcgctcgtgccgttctacccgatggccgggcggctcgcgcgcgacgaggacgggagggtcgagatcgactgcaacggggaaggggtgctcttcgtcgaggccgacgcgcccgacgcctccgtcgatgactacggcgacttcgcgcccaccatggagctcaagcgcctcatccctgccgttgattacaccgacgacatctcctccttctcgctcctcgtgctccaggtgagctccaaatttctagtagcaagtacagttagatccaagcacaaaatcaaacgaggttagagatagctttctggaagtggagcgcaaacaatgctttgcaactgcagctgacaactaagtttggcagtaagccattaattataacattttggggctgattgtatagctaggtcccatgttggctgttgcactaaatgtttggggctgagcttagcgggtcacctactctttggttggctttaattagctgcatcagatgtacggttccatccaggcagttgatgtctttctgttgtgggcggggtctatttttggtttgatgtttatgcttattgtgatagtttagtaggggttgtgtaggaattatagaattttaaaacaccataattcaatgccaataatcagtatccactaaaaaaatgaagtatatgcttcaccttgactgtgtcaaagcctagacaattttgatttgtccagagtgattgtatcatatagatttgaaatgtgtttttcacgttggactccacattgtcttctatgttataccatctaaaagtggcagcagcgtgcatcaatttgtgcattaagagtaacagacaacaaaagccaccggtcgtgcgggtacatccctgccaagcttgagaaactaatactagaggactactttattaagtagccctttaatttgctccggtatatccctatatcctgtcctgaactactacacttatggattcatgacctacagatatttgaaccgagaagcttatcccatttggagctttttaacattggatttgcacgtttaaccctgctagcctttgttgaatacttaaaactttgtggcgatgactatatatattgctttgatcacttaagcataagtgccgatcattccatgtcattccatgttactgctgatatttaagtgttttgatgccagaagtaatggttagattgcattaaaacttgttattagatgggaacaattttagtaggcactaatgttttcttctagggcctctatagctcccatatatggttgattggtcaatctcattgttccaaaatgtcaaccatttgccccatgatgtagacaggaggggacttaattgggtgtgatattaacattttgtgatagttagtctttgactgacaatagctttcttttgcctgttcgataactgaagcccttgtcctgtagagcctcatgagctgtttatcctttgatggatacatcattcaggttgcacgttcaattttgtcctaaatgaaacatgtctgatctgctcaccttctggttatccatcatcagctgccctttcatgctggaattcttgtacaataaatcaattaggttgaatgaatcattagtcttacgtgagacatacttgactttgaaataatatggtacagtgtacaacacaacgtgttaatggaaagaatttatttgcttgtaagtctagtagaccttaggagctaaaattttatttagaaaattgttctaataattgaggcacatgctaatactttttccttgcaactgaaaatttgtgcatgcactttccataacataaaactgggccaaaatttacaaggttacaaaccatagtttcattcaatttttttactcgctgatatgtcagcaaccatgactctgagtagtcttggtgcactgcatgttggttggtatggatctgagtgttaactggagcatgttccatctgacaagtttttgcttataataagttaatagatagtactgttttgcgccatattgttccaattttagaagttatttaaaccttgatttcctctcttttatcaactctagttgttgctaacttgttgtaacacctgtttagatggcaagctgacttcaattgtggtgtgcatgcatcaaccttcttttttttgtgggttgggttgaccatggaatgttgcatcctgagctagacaagccatttgcatgtagtccttctctgttagttgccaataaaatgtcttgcagctgtggcaaaggtacttttgcattgcttggtagagtgcttgtcaattgttggatcctaacaccttgttaatgtggatctgaggcctgcgaatatcatgcatcccaaccccaaaaaattgtagagaaaattatgttactctttatctagtgcacaattggagcatctcttgtcatctgtagttgattccttctatgttcatcagaaacttggtgtattgcctgtcttaatggctcttcctagtaaaagcctctaagatcctgtccttgcgatattatattcggtgatgcacttgcagcacatatactcagatcttgcatgtgcatatgttttaaaattcacatatgtaaagcatcatcgaacatttcttgagtggccataaattctaccatgccatagcagtcactgtcaaacacacaatgctatgcattcatgtccatggacaattcagctatttcatgcatcagcatatgtctgttttcattctagaatcactttgccatctcatcttctggttcgtggccttgattttagttgtgttagttttatttattttgttatccgtagcctcattggttagctgattatgctagaaaaaaaactatatcaacatgataccatattggtgattcaacacttaactgatgtgacatagaccaactttcaatgccccctaccatatatgtatttggtctaccattaatagtaagcacgacagtagtcaaaggaccaaacttatcagtaagggagatcacacatgttcctataacaaagcggaatctaatatgcatgcatatagtattatccaattattactatcatgttgtcttgcaatttcatttagtcatcaatacacattgtttacctcatgaactatgtccgtatttgtgattaggtttaaacaattctggctcacatttattaattataaaattgcatgcctgcatgtttcatgttaattaatgataaggcatagtacatgcttgcgctagtttttgtatcacttgtactcttgtttgaaaatttttttttggctgatggcagattctatggcacattttttatggtagaatcagaaatcgggaatttgatggaggatgttgtcatttgtatgcattattacatgacaaaagtttgtatagaagcacaaatttgagtttatatgtttatggttgcagtcaacaattttggtggcaatgcttatgtcttgcatcctaagtcttggaaattcaattagaaatccagtacccagtatagtatggaactgagtttcagttcaacaatataacttgcagatttttgaagagttgtgtcagtacatagttaatttctgacatccagaatgtttatgcctattggtgtaagcaacttctatctgtgtcattcatgtactatctatctcaatacttgtaatgttgctataatggtatatgcagttgaaaatatgaattatatttatcttagtaagtgaaacatttcaagacactgattctccttggttttgttattttgttccaggtgacctacttcaagtgcggaggtgtctcccttggagttggtatgcaacaccatgtggcggatggcatgtccggtttgcactttattaactcatggtctgacctctgccgaggaactcaaattgccatcatgcccttcattgaccgcactctcctacgagcccgagatccaccaactccatcatacccacatgttgagtaccagcctgccccagccatgctgtcctccgtaccccagtctgttactgctaataagacaacaccacctccaactgctgtggacattttcaagcttacccgctcagaccttggtcgactgcgttcgcagctcccatcaggagaaggtgcaccacgtttcagcacatatgcagttcttgctgcacatgtctggcgatgcgtatctcttgcacgtggcctgccttctgaacagcccactaagctgtattgtgccactgatgggcgacaacggttgcagcctccacttccagaaggttactttgggaatgtcattttcaccgccactccacttgctgaggcaggcaaggtgaccagtgggctggcagatggagcagcagtcatccaagaggcgctagataggatgaacgatagctactgccgctcagcattggactacctggagctgcagcctgatttatcagcattggtccgtggagcacacactttccggtgtccgaacctcgggctcaccagctgggtgcgcttgccaattcatgatgcagattttggatggggaagaccagtgttcatgggtcctggtggcatcgcctatgaagggctggcgtttgtcctcccaagcgcgaacaaggatggtagcctatccatagccatctcattgcaggctgagcacatggagaagttcaggaagctgatcttcgaggtgtaagcagactacttatgttatgtcagggagaagttgtagagctagagttctcaggtaaaataccttcaagtgagtcatgggggctatgctcttgctcctgttgagcaaattgtctggccacgttctcttgtaccttagcttgcaaggatatttggccatcaccacagccgtgtgacgatgtgagcaaccaataatgagctgtttttttgttttcgtttaggataggaatcaacaatgaagaaaaggtgctgtattctgtgaaactacatggcagtgttgttcttaccaaaaatacatgacaagtgaattgggtcaagttattgcctgttgtagctcaagtcgatagatgaacatcattgtacagtacgaatgtacgatacgactataacagcctgattgcctatgaactgcaagtaaatgcatgtgaataactgaatatgtgatcgtgactgatatttgttgcttgattgcctccatcaaacgtatatgtgatcttgactgatattcgttgcttgattgcttccatcaaagctgcattcctggtgtttttcgttgcaaccactccttgccatggatatccaggcttgtttatttgcaggcctcgcccatggcggcgattcatgtcctctctctcacacgcatactacatgttctctgaccttttgttccaaagagaggaaaaaaacagcggagaagcatccgttccgtttctagtgtttgggtgggggtaggcctactgcgactgccatgtgggacacacacgacaaggcgacccccacatcctccatgccgttcaaaacttcgcgacacgaagcccgaggagcagggggtttcgtcctccttcgccgncttcgccttcccccccnnnnnaggccacctccctcactcaccgcctctccccccactccccctctcgatacacgatcaggcgacacgccgtcccctccttccttaccccgcgtagcctagtggcttctcatcgccaccgccgccgccatgccgtccgcgccccgctctccgcgatttcaaacgttcctcgtccggtgcgccgccgacggggcggcggacgtgggatgctgcctcaacggtcaaccctgcggattgccggtgctgggccgccgtgggcggcgccgttgcgcgctggcctcccgcggccgcggcctcggaggctctccctgataccccgcgctcctccgacgcacccgtgtgctgcggccctcgtgcgctgcttcaagtgtgaaatcggtgagcacatcataactccccaaatcgcatttcagatgaactcgagaggaaaatttcaacattatttaaattcgttgcctgattacgccggcttctcgatgggaatttttgcagatacatttgcgtgtgccaccccttcttgctagacgtttcctagtgttattgctactagtagattcaagtgagatcaatcgccataattgctcatttattcaactcaaatgtgaaaatgctgaaagtctatttaacaccaaaaataataatcttagaaaaaaacaaactcgagatattttctcgtgcttctagagtattcctccagaaataaattaaaaaatacggagaaaattaaccttggatggggaatgaggtacagctagcacagtgaaaaagaaggctaggttgtgcagtgcaggctacagtgaacttagatatgcgtacgtgcatcaagccaacgtgacaaagcccatctgaatatgctcctattctttctatgcttagttacgtcatcaagctattaattgcgcctaccaccgaaagactaaccagggggtttagcaattaaccagggggtttagctattaattgcgcctaccaccgaatatgcacatattctttctaagagtatgtacaatagcatgctataagccggctgtaaccatatatcgagaagaaaaaagaagagagataaaaaagcgagctacagatttgtagccggctgcaacacggactttaagatgttatgtgtgtatgagaggtgggaccgtgtattaatggtgcagtatatttttatagttaactattgtataaatagactattagattggctatagatattttggagccagtagttggctatatattgacctcgctcttaaccccctacgaatccttcttgtttcttgagattttgttcgtgcactgctgcattggattctgtagttaccagtaacaaacttcctaatgtggtcaggttaaacccctcgcgaaaggcgcgggcggggggcttgtccggacgcgcgcgagccgagccggagccgaagccgttgctggtccgagccgagccgagccgagccgagcgaggcgtggggggtggttggtgttggtggtgacgcccgggtagtataagtgaaggccccctcagttgcatggaaggcgaccgcttgcgctaaggccaaaggtgaggagatctctccctctccctctctctctctctctcctcccatctctccctctcctctgaatttttgttcgtttgcttccaccgatcagaagcctctcttcctcgcgggggaacctgtgaattctcgatctatcgcctctcttcgtgcttcgatttcgctgtgcttgatctcgctctctcgctcgctcttgcggccgcgcgtctgtgttctactggtgttggtaacgtcgatcgctcgctcgctcgctgctggtgtttctcgtcatcgtgcggtggggggtgcgtgcgtgcgtgctactggtttggtaagcccgctccgttcttgtcgtcgtgtgtgttcttgcgtgcttctgaccttctgttgctgatgctgacgatggttttcttctcgggttttggtgccgtgggttttcctgctactggtggtggttttcgtggatgggatgaactgaagttgccgaaggcggacgagcaccgcgattccatggtgatctccgttcgcctccgtgtttgcaactcccacgggttttgctcgttccaccgtcggatcgaagcgtcctcttgtcgttctcgtctactagatcccttcggtgtacggtgcaagagcttcgtctctcttttttaggcccttcagtctccaaaaagttcgtgagattttcacccttcttagatcttctggtgttcgcgtgttcattatcgttgcttttttggctgctgtttcagtcgtgatcggtggttttcttggaggaggctgcatccgagtcttctcggaattaactcggtgattttttgttcttcccaccatctgttcctggatgcatctctttctttttttcttttttttttacggtgctacacagatgcgcaatggcaacacgagggtggctgcttcgtctcgatctctcgcttgtttccatttgaaactattttctgttccggaatgttcgagatcgccatttcttcatgtgggtttagggttttagaacgtgtaggcttgtaacatcctttcctatcgttgggcttctgctgcgattgctggtcttgttgggcgagcggaaactggatgtctctgcccgtgctttttacctgttatttggtttaattttctgctttttatatgccaaatcttcattaggattcccttcttgctgaccgagttattttttttcctgcaagatcgacgcgttctgtttattaagcgtattaacacttttccattttgttgccagtttccgggggttgtgcactactgcagtgttacattgttcggcagttcgtttttggtaaacatctatccatccttagaccatagtagaactgaaatttgggaccgcagagttttctccccctcgtttattcttgttcttgaatgctagattcgagaatctatgattatacttccttttaatcaattccctaaattagtcgttaccatatgttttgattatacttcctcgagtgaatttcttcattcttcagattgtctggtttattcttgcaagatgattgtaatcttgtctactttttgtatgatgcagttgtgtttgttttcacttccctctgttggaatgcactgataaaatttactattatgctgtgctaaatttctatgtattttttactgtatcatcatagttcaccttaggtctaactttcatgctagatcttgggttcaaaatgatggcatttgtgtatcttgaagattataaatgcaagatataaaaagaagaaaaaaaaatcctggaatgcatccgtgggacctgtgtctaccaaaaaattgctttgtatggactgctttagagtcatgagtcatctttgcttgctcgctcatcaacaatatgtgtccaaaatattggagttatgctttgagctttgcaaacagtggcataccgcgtatctattttttgtttctgcaaaatgcagttcaaattcaagctagttaacctttctattcattctgccccaataattcctattcgtattttcaccgttacttctagtatttaggtgatctgtaacctgatcttagtatggaatttaaggatattttattcctattattatgtttcagcgaagcagactccgctatggctcaacctcaacgtcccctccaagttcctgacataacaaagtctactcattctggagggaacactgtacttgcttatgcttcatcagctatgcaaggataccgtagcaccatggaagatgccgtgagtaaccttccagtcttttgtaggagaaatggggggttggcttgcaactaattttggtgaaattctaaaggctaatttgtgtactcttctattctccagcatgcgactattgaaaatcttgatgctctcactaacacgtcattctttggtgtttatgatggccatggaggtttgatcttcaatctcatccccatataaacagcaaaattcaaatttattgtactgattgaggggatactcccttctcattgtatagggcatattttctttaggcatgctcattcttctttaaagctacactttcaactttgatgtctcacataatatattgttcatagctacaaaaccaatatgacgagaaagcactttgactaattgttggtcaaaacctacaaagtttgacttcttgaaaagtatgctcaccctacatagtacataatgtggggggaggactaggctagtaaaatttataatatccatgtacatgcaaccttcattgcactcaagagtaatgttgcgcaatggttatgtaagatgagtatctcaattatttaacttctatttcaggttctgctgtagcaaggtattgcgcaaatcacttgcacaataaggttttggagcaagaagattttagcagtaaccttgctaatgcattgag

SEQ ID NO: 16570 - DNA, 1084 bp, Oryza sativa
cagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaattcggcaaatccttgcgggaaattgtaatcccattcaccagctctctacatttaattaacaagagaactattgtatttatctaacacctggattatctccacctttcatttgatccctatttatagattacgctgcgttgctaacgggccgcacctcttatttcctcaagggtgagaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctgacaacgagttccacgtgattacaagcgcatcaagaaaacgatcgtctccatgttgtcctcctctggggcaacaaacagcaggccgagt

SEQ ID NO: 16571 - DNA, 829 bp, Oryza sativa
  unsure (1)..(829): unsure at all n locations
gacctgattcttgtgaacgaagtggcttgtgcaaaattatttatctgataaacgaactatagaatatggtggagatttactcagtttgtgaacgactgttatgtgatgacccatttatgtgggttcacatgtgctttaaaaccttatttttcagctggctgtttcatgtgctctggctttcaattgttcaactaatgttatacctttgatttcatttctctgcatttttttattgtctgttagttcttaactgtaccgcattctctcgccctctgtgtgtgtgtgtgtgttttacaagttattactgtggtgcatgactaggaactttagctgttaaaagaaccacaggttagtttttttttccttggtcatcattagcttttcctgtctcaggttgagaagtggaatgaacagagggagaatgggacatttgcaggaccactctaaatctcctgtttgagagtcttctcagatcagtccactgccctcgtcggtgtcactgctatcatctggtttgaatttatgctgctgcttttgttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16572 - DNA, 17383 bp, Oryza sativa
ggtcctcaggtgctttggcccttcggagttctctgttgctgttaccatctttggtgggcatggtcatgctggaacatgggcaaaggagctcaatgctgatgcttacaaatgcaacaacatggtagagcaggagctgccctgtggtggcctcctcatctaccagagcttcgacgctactgaagacgtacctgttgctgttgggtcgcccaaatctgttctgcactgcttcgaggctgagaatatggtgaaccctgctcctgttaaggaaggtaaactgggcaatcttctcccctggggagaggatgcgttggaggagaatgatggagtgtttgatgagtaagatgggacttctggtgacgattcgctgctttgttttcattccgtggcatttttatctgttgaggttgtcgtttggttattctgtgaagcagccagccaggctattagtattttcgcttgtaagcatgtgttctgatcttgggacgtatgcttggtctaaataataatggtgaactaaaagctctaggtggtcagctgcgtctgccacaatgagcatgcgtcgggagaaatgttgtcaaaacatatgaataagtatttgcgggaaatttcctttgccttctgctaatgttccttccgatctcaattgttaaattttgttgctgctggtgtctaagaaagttctgcttgggacactagatagtatggagaaaacgattttcgaaagtttccactcttgttatctcaactctgtagagctccccctgttccatgggactgcaaatgcccatggcacaggtatatcttaaggtagtacattaatgaaaagtctgggagaatagcatgtgcaaaatgcttactagctcttataagttaaaaatagctggaagaactgcattctatagctttccccgtgttcatggttatcttctgcaagatatggctggacgaagtatatgccgcatgcttggctcttgccgccccattcgccttggcatggaccattgacttcgattttttttttggacatgtttatgtatttgcttattgtcctctactttacatgtaacagtaatttaaaggagtgctgcctgatctgataattgcgtttggaatcctttaatgagcttgatcttgtcgcgcttggaaagatgatgcagcgacctgttcggtaccctatgcttatcttctgacatccatatctgtattattgtttatgaagttgtacgctttgtacccaattatccatgaatatatatattttttctttctggaaactgcatgttgctgaattggtttatactggacgatcgcgacctcctccattattcgggtgcttagattggttcggcttcgttgacacgcgcgaacgaaaaagaaagatattagatagatagatagatagattacgcggtctcgatcacggactcgtgagggcaatcgcttctcccctaccttgccgacctgttgtccttggaacacttccgagttctgacgagctgattcctccgatggtggcgcttctgtcgctgttccgttctcgctccaacgctggtgcttgattcatcagttgcaacttggcaaggaactggaagggatctgtgctgaggaggtgtgatctcacattgtcgtccaaagcttggatgcgttgcttggcccgcatgatatgctcatatgccgcgtctagaaggcgatcaggtaggcaggcagctagctgctcaaaaaaacgtgccacatctcggggcgggaatatgctcctggtctgtcgcccatatgatatgtgagcatcaaagcatctcccattcccagccacagagagcggatcgtttgttccgagcgtatcaattcctccctcctccttggcccgcgcactgcacgtaggagtaggacgtagcctagattgttgtagcaggtcgattgaccgaacctgccacgcagtgattcgatcacacgggcacacggttggcctgcactgggctaccgatcgatcggacgcgagatggaaacgagattcgccgccagagcacgagagggaatcgatctcccttacacgtcggccggcaagtggagtggttgatggctctagacgccgcgggaaaggacaaaggcgaccgacggaatccgccgcccggtcgctgcgacacaccccgtgccgcgtgcatgtgccgcgcgccgaacgaattaataagcttccgttccgttcggccggtacgcgcccggaagctggcagttgggcacccgcgggggcgaaacgagcggcccacgccgttttttcacggattttcagcccaaactgctgctgcgcgactgcgatttgggtccgagattggcccggctcgtggagttattacgggacaatcgcttcctcaacggtcttcctggtcattcgtgtgccagaaagggcatgtgactatctgaggacatgacacgtacagcgttttctttttcatttttctttgcaggttctgacgagaacgaacagacgcatttactaatctcatacgtgtactcccagtccgagagatttggtgataagagcttaacttgggctgtgatcagggtaacattttttagcgtgtcacatattatatatggacatatttaaagtattaaatatagtctaataacaaaataaattacataattctcttataaaatatgaaacaaatttattaaggctaattaatccatcataaatttattaaggctaattaatctattattagaaaaagtttactgtagcaccacattgtcaaatcatatatcacttaggcttaaaaagattcatctcacaaagtagtcgcattctgtataattaattattttttagtctatatttaatatttcatgcagatgaaacgttcgatgtgacgggatgaaaaattttagggtgacatgtaaataaggccttagttacagataaaacgcatctcgcgccatctgcattatactcctttcgctaaatcatttagaatttagatcacttaattttcactctcctttcgctaaatcatgaccatccagaccagagcatggagaaaaaaaaaaccaagctgctactacaaacagatcatcatcaacaacaacgaacaaatcgaatatcgatcattctcaacatacattgtgtcgatcccttctatgcatgtatgtatcgatcgtgcgtgcacgcatcatcagccgttgacgcgggagcacgtccggcggacctcgccgtcggcgccggtcctgacgccgaggctggtgagcctggcgaacgaggccgcccagctggcgaagaagctcccctcgctccgcgcgaacgcctccaccgtggcccgcgtcgtggcgttctgcaccagcacggcgtccgtgcgcagcagcccgcgcccggcgagcaggttggcgaagtaggcgttgtcgaaccgcgacgccgacccctcgtcgcagtccaccgccgccgtcgacgacaccgtgttgttcaccgccgagcacgccctgatcagccccccggcgtagtccgcgttcatcgccgcgtccgcgggcaccgtgctcccgttcgcgtccacccggaaccgctccccgaacgtcgtgcagtgcgccgacccgatggtgtgcccccctgcgcgccagtgcgccacgccggcgatcgacagccgtgtgctcacggtgagaccaggtgaaaagtgaaaatcgcagttgatcctccagcattcaagagcgtgtgtgtgtgtacctgagagggtgacgaggtcgtccagggtgagccctttggcggagaagctcctcgccatggcgtcgacggagaagccggtgtcgatgatgttcgccctgacgttggaggccagcgagaccaggccgtcgagcctcccgagagagactggcaccaacggtcctccggtctggtttgcagcaggtgaatgcatgttagttcatgaatgtcactcattttacattggtagtttatctgctttgtaaaccaatctgccctaacatgccaataggattttgtgccaagactaaaaattgagcttttaagtggcacagaaaccggagcaagcaattaacacaagattaattaattattaattaatataaaattgaaaaagggttcatttgaatttttaaagaaacttttatataaaaagtttttgcaaaaaaaaaacacggtttagcagtttgggaagcatatgctaatggaaaacgagggtgttgaagtttagagaaacatttccgtagaaacaaccatattataagtcttgctgtatttcttttttgttaccaagtctatgccgaatcaacatctatatgatgtgggtgaaatggtgaaggtgaatgtgagtgtgaatgttactgcaaactctgtatttctagatacagaggaatgtagtttcaaagcatatctgttcttaagtttcactattccagttgttttttttataaaaaaaccgaagccagcaaagctggtgttatattaagcaggggagaaaaaaagtatttacaagatcaccaaaacagtgaaagagagaaagagagaggaaagaagaagctactaaacaatgaaaaactattccagttgtgccccccttcattagctcatttcatcaatccccttaggaccattaatcatgtcccccacagaattacgcacataaaatattgtggtccaacgacataagatgacaatcatgaaactaatggaaacggaattgtgttcacttagttaagttcatgatggtctacctgtctgattttatttgggtgtaaccatagtagttctaattattttccaaggtatagtcgtgtaacgtatgcatggaccaggagcactcaattcattggatgattaaagatctaactgttgcagcattaatgtggattatttctgatgtcctatgcttatgaagagtactacatctgcttaactatatttagtagcaacatttctaggaaaattcatctcaggcaacaatttaaatatttggcacatttacctttgagtggattgtagcaactagaaaagagaaatcacatagtgccatcatacttacaaatgtaacagcatctcttgcggcaaggactaaaatgtcgctgcaggaaacagttacagggcacacggcttcaagcagcctcttggcagcatctatgacattgaacccaccaagtgagaggtttgcaggatcggtcctctccgtgccgctaccttcaatcatcactgatgcatcacatccctgagaccaagaaaaaatgtactctaagaatgactttctcactttctgttattgtgcaagcgtggatgttttcacaattcttaaacccgatgagatgcaaatgcaagacaaatacaattgttcccataattgtggcagtgacaatgtgcaagctgtggaaaactacattatgtttggttataccaagcgtgcataatggattagggtcttaattttagccaccacatagcttagtgatcaataactattctagactggaccattcaatcgacaagatatacattatattcgaataatgccagattattagccgatgcaattagtgccacacatgtcataactattctggggaaaactagggtgagaaaaggaatatcctaaactaactagtagaatgagcatttgattagttcttcaggtcttcagcatttcaaactaagaaaacggatgaaaataactattattcagctgctagtaaattgggccgaaggaactatatatcatcataaaattgaacaaaaacacattactgcattatatttccaccccaccattgttatttctgagaatatgaaaaactgagacggcaaatggcaataccccaatccagtgtgatggaacaggaattgttgatggctagatctacacacttggatgtgattcatataaccatctacattgcagacagccatttcaccatttgcttgcatgcacaagaacttccattgttgcaaattgcagccaatgtgacgcatttgacaaatgcaagcagtatactactagattctgagataaacagtcatggcatcagtagtttcttacctcaacaaagcagtcatggaagagcatcctgagaagcttgccggggatggtggaatccaatgtggaggccgacctgacgacatccctcaccgccagctccacgctcgggcaggactgcgcgtagaaatttggcgagagctggaccggcgtggacgtcgacggcgaggaggagttcgtcgtggaattcgttggagccggaggaggagaaggagatggtttcggtgccgctgccggcggcggtggcggtggcgtccgaggaggaagaggaggagacggtctcggagccggtggcgaggacggtggaggagacggctttgtggtcggcgtcgccgcaggagaagaagaagatggcttcggcgcgggtggagacgacggcgttgtggacggcgacggcgcaggaggggaaggtggcttcggcgcgggtggagacgacggctttgttggcgccggcgacgtcgccggtggcggctgtggaggcctcggggctggcgccgcgggtgtccgtggagaggacgacgagttcgtcgccggtggggatgccgcctttgccggcgttgctggcgtcggcggcgtccgttgagaaggcgccctcgcagccggcgttgctgagctagcagctggcgccggagacgaagacggcggctgcgacgacgagccggagcctgcggcgacggccactgccaggacagagaaaaacagcgccgagcaaagaacaccaatgcactcccgccgccgctgccgcctcatctgatccatcttgcagccgaggagaacgggatgctcatgagctagccagcccagctgagctcgctcacgagcgcacaatcactcacagtctcacacaccactacaccaccaccactatgtgcaagaacagctagcagctgatgaacatgcagaaatagtttcggtggtggacgcagagagcgatcgatcgagttggcgtagagaatctactagtcgcgtacatgtatctctcgcgcgccggcattacgacggtggacgcaccggcagcagcaaccactatagcgaatgcgccgatgcgatccattataaatcgggggacgcacaaccgacgccgcgctacactagacggactcatgtacgagcatacgacgacataccggacggtcggctgggacaatctatagtaggagtacgtactatggatttcgaacagcggtacacgtacgattctccggcagcatgcgatcgagaaaaagtttcgtgtcaacacggcgaggccggttaattccccggccgtaccagctggtccaggagacccgtgtctcgcgtgtacttgtgctttaccttagctcgggctcccccgttagagcaaggataataatgggctataaggctctcatacaagagctagcttcacacaactttcaagaaacatacatcaaatttatagagtgagaaagagagaatggaaaaaataaagttaacattatagctaacttattatacaagttaactctaagattgacttatagtaagcagcgcgctttactattaaacttgctcttaatggcggctatctagctggtaaagctggcatcccggatgcacgcatgtttcgtgtttttttttcttttgaaaaaggataaacatgcatggccggctcttgttcaggcgcgagctagtagcatgcgcatgtggatgcgtaaggtgtattgatggcgagggagtgaatcgggtcggggttgggttgggtgcctggtgcgccgcagtaaattcggggagagagagccacgccattgatggcggcatttactccggcgacgcggttggtaatggatggatgggcgacgactcggcgctgggcgggcgggtttgcagatttgcagcttcctgatcagagttgaggccgcgggcgccacctgtggctgcacgcgccggcggcggaggtggaggagaaaggctggaagggggtgtagttcagccgagaagttcagctaaagctcgcgcaccgacttctccatttcggcatttcgcgattccacggtcagaagcgggaaggattggtaggcgggtgagtgagtgattgtttagttatcatttttttctttaactagttaagtgcctgtgcgttgcaacgggaaaaaaacgcatcaatttcaaattacagagtaaaattgtgctgaatagttattgaatgtaagcttatcataatcagaccgataaaattatgttaaataattattgagtgtttcttaaaaaagtagtaatataataaaatcctaattcagtccggggatatacgtattcagctgtatttacagttttacactcatgacatcaaatcaagtaactaatcaactaatagcacatttgtttggcaacaagtatatacagatgacattctgtatttcgtaacatagcaagtgaatgcaagagaagtaattttgcgagtagaagggactaaaccaaacaatacatgtattttttaaaatgcctctataaaatatctctacactataaaactcctgatctaagaggcagtttgcaaaatgcctctacaaaagtgtctttatataaggttttttttgtagtgacagcataggatcacacgtccgcaattcaaacccagaacaataccataatgttcacactgctagaacatcatagtgtcaacgattgattgagaacacacacaagtatcttttgtcatgagaaacatattctctatgcctgcaatatattcaatataaaaatctactgaaccacaacacataaagcatcaatatgtcctcatgaatcacacaccacaggtgcaccacaagctagcttgtttggtcatattcatagcaggtgatgttacaatgggagaggaattgaggaaggttacttggtttggtttgcctggataaggggaaaataggtcagtccttatttaccagtatatagtaatagttatatatatgtatgtcataccattcccgtataactattttctctatacgataatactatgtgtttgcttctaatatacttaagcataacatgtaatttgtgcaaagatgaaaacatcagccacaagcaaaatcttttaaaaaaaaagaagggaaaatagttgcataaaagagaagctttgagatctggatcaagaaaggacattggcccatgaactatttctcaaaaggacaaatccgctttcttaaaagtattatttcttaaatttctccacaagttcttcaacaacaaagacatttcatgggtcacgtatagaaaatacagacctaaaaacaaatgatagagcctcttctttataagagagaagagggggaactttttggtggatattttagaacagtcgctatggttcaaggaaatagctaatcctcaagtgggtaatggacaatcaattctatgcttggatgatacataagccaaaaaaatgaattggattgcatatgtgcacaatggtagccatatatagtattatcagggctcctggacccactaaattgatactttgctgaaaaaagagaacaaatcaatccaaaagtcagctctaaacaaatgacatcgatctgttgatgtagcataagcagtgcaattaaaagccatggaatatgagtaaacagatggagggtttcgtacagaaaaccccaatttctgatagtctaacgttaactaaattcagggaaccttataaagctttctacaaaatgcaggctacacaggaaatgctatctacttatacatcaaaagaaatttagctttgttattctgaaaacagatttgtaggcagtcctagcagcctatgtactcctatttgtaagttaaatatttattaacttactgttaaaaaaaacatgttcagcatccttgagtctagtttgcatatatctatatcaacactggctactttaatcccatgtaaacatatgaatatgacaggcaacaggataaagtttaagagaaaaatatatagagcaaaaggtttgtagttgcagcctcaatcccatataaatgtttaaaagcttgacagcctgatgcaagatttttttcgttttctaccgctggttgtacgattttgggtagcaaccgattagctgggctggatagctgcagccaaaaacgccacaacaatcagaacagatcagcctcaatatgctgtgacttgagactttaatgcattaagaaaaataaagctgcacttaatcagaagttatgtgcaattaatctgaagatagcattatatagtttagaaaggatatggcatcgaggtggggaacaaaagcgtgaaaatccccaacgatagagcagaactggacagtgaagcatgacctggtcatcgaacatcagtttcttacgccagcaagatctcaactaaattgcaagctcaataaacaaaagaatctcctctcttgttctttacactatacaaagaccatttcatttgatctaacccatccatcctgcccaagttttttcaagtctaagccattggttatgtatatgtatgtttctggtgataacctaaattagttacagattataccttcagccaacatttagcttgtacaagtccaactcaagatcaacttctatattgaggcataaataaggaactctcaatttattgaggatgaattatgaatacactgagaggtctttcttgaaaggaagattactatgatctcattaacaacaacattagtagtgcagcatacacatttttttctcaagattactatgaaataaatatcagttatcaatgttgataattcaaaaccacaaacaaaactatatacttattatgccgtaaggctgccctatcaggtcacttcttgctattttttgggtttaaaaaaaaatcatcaaacgcagaagtatttaatacaataatgaccttttcaatgtcagagcttcgaggcaaccttctgccacggcggggtgatcggctgctgcttggcgcggggttgcgtcgtaaggggccagctcccacgatctggcagcaactgctgaggtcgaggagggaggggaggcagtgcggggtcacgttgtcgggggctggctgccgcgattaatacaaagatccatgctcacttcaaatatgaataaatagaactgtcagtttagcataacgattcacagaaaagggcatccaccacaatctttaattttgcatgtggagatatatattcgaatgtggcaaccctatggccagagaatgcataatataagcagatcggcacaagtattaccttgttgatgataacctctgtttgactttccgacaatcagatcacaataaggcaatatgaggacaccacctaagatgtatcggatatcagaatgatgttttttttttgagatgtacccaagcagtctaacccctgcaatagattgaaaaacatacagagtgagattgtttctttgcaagacacatttttaccatcatatattttaattccatgatatagcataaggacagaaatgattaacagttgtctgtagctaaactctgaaatgtctttctttttgatccctagtgagcagaaaagagcaagcaagtgtacgtccaaaaaatataagtacattttaatgataaaactgttcccaaaaaacaaggaaataggaatcaggatgatgcagagaagatacattttattcagtgcccctgatcaacaaagattcactggccaggccataaccaatgttgcactttcaaccgggctaatttattcaggtgcaaactacaaaggtttgatgttttgaaaggaattagtagcacttgctgaccgacaacatgcatgtgtgatacagttacatgaaaagaacggcaacgagagcctgatagatgccatcctggagggcatctattgaaactgaaaaaccaaaaccttttcaagcttcaccctaaaaaaatcattagtctacataaacaaagtcagatcgtgaacaaagctttttaagctacatccgcaatggtgatagtacataatataagacatacatttataaaggcaaaatttgctatgggacataaaaaacgtgcaattttccttggaagcagattactaaagataagttcactcaccagcccaccaaccatcacaatcaagctccccaatttctgcctaggtagcatgatgccgtctaatcatgttgatagaaactggcatatatatagtcccacagtgtttacagaaggaggctatgaatatggcaggaagcatccagctcctagagtggtggctggcaacaaaagtggccaaaagacgaaaaatttggagagctaacattatttactaactacagtattgtgttgaacaaaccacatgaataataaatctcaagtaaattttagattttgatgaattctgccatacaaaatgatattaaatcaatgttccagacatactaacagatatacttgttagttttctgatcgataagtaggaaattaagcaaaggaattcatagaatgggttgaatgaccttaacgcaggcggcggcagactccaatggctgcacggtgataggcaggaggctagcggcagtggcaggtaaagaggcgaggcaccgtgacgtcgacggcaggctgatggggaagaggagcggcagcgacgtcgacgacaggctgatgggcaggaggaagacgcggcggcggtgacaatctggagtggctggcgctgtcgacgacagcgcggaggctgatgcagaggagggcagcgcgggggagtgggctgatggggagtcgacgatggcgtctggagcggccggcgacatcgacgacggcgtggaggctgatggggaggagggcggcgcgggagagtgggttgatgggaaggagtcgacgatggcgcaaataatgatgggaggagggcggcggcggtggcgggtggccggaggagtaggcgtcgacggcggggaggagtaagaatcggcggcgggtggatctggagcggagtccacggcacgagggggggcgcgccggcggcggttgcggtgggcggcggcgccggcgccggcaggggcaagtgggcggaggaagagacgtcgcggggtcaggttggcggaagaggagtcggcggcgatggcgagtggggcggagaaactgtccgcgcgatggcggtctaccgcgatggcgatctctgtgcgcgattgcccgttggatatgacgatcagatggttgatattacgcatgtctgtcagatgcgtctgctatgtcaggaatcaagaccaccactacggactttttaagtagtagagattttttaactttttcatcacatcaaaactatcctacacatagggtgtgtttagttactgaaaaaagttggaagtttagggaaagttgtgagtttgaaaaaaaaaattaaaagtttacgtgtgtagtaaagttttggatgtgatgtgatatgatagaaagttggaagtttgaggtagttaggggtgaatcaaacacggccatatacttttaactgttttctttaaactactaattttagtcaaacttttaattttaaagtgaaactaaacacagcctgagaggtggcagtgggttttatggcttcgccggccaaccaccggtggcagtgttcatcagaattctggtagggacaggcgtaatgggtatactagcttagaatcacgtagcaaaagaattaacgcaactccggatatagagtatcacgcgaagccaaaagcaaggtgtctcacgactgactaaaagttgaccctacctgaccaacattcgaaaaaaaaagaaccataaaaaatcattcaaaatatatatgactataatcacgaaacaactatacatatacaaacaaccactccctccgtcccagaaaaaaaaagacaaaccctgggtttccatgtctaacatttgaccgtccgtcttgtttaaaaaaattatgaaaaaaaaataaaaagacaagtcacgcataaagtattaatcatgttttatcatctaacaacaataaaaatactaattataaaaaattttcatataacacggacagtcaaacgttgtacacgaaaaccaaaggtttgtcttttttttttagggacggagggagtagtgcgtatgatccatacccgatataatgcgcgtagacacaactattgttttcctaaactccgatggtgagaaaccgagcgtaagaattgatagatgaaacgtgattagatactaactatacgtatagaaaaaaattataatgtaattatattgtaactaacatataattataataattatagtataacacggtggtgtagatgcgccgcggcatccacaggttgcatgttttcttaacttttgtcacatgttagatagcaattatctctttttttctgagggagagagagaggagataataaaatactcgatattgaattgccgatggattactcattaccatgtgtataaggtatgataactccaaatctcatgtgcttgtgtgtttttactttttagagctctataaaaataacatgggtgctaaactattgttctggaattatttcttgaaggcccaattaatttcgggctgggccattagcaagcaagccgcgtcgaatttgtcgctttgaatgggccggaaatgctagggttaccgtctccctcccaaagccccgcctggtgattcgccgtctccctccgtcgccgtgccttcccccgccaccgtcctgctcaccggcgttccgccggaacgacttgaagtccacctctcgagctcggcggcctcccccttagggcagaagcggacgaggcgaatggaagaggttaggggcagggagagcaaagaccaccgcggcggcggcggcggcggcggaggtgatggggacggcgagcggacgggacggtggcgcgccgaggaggtcatcgctgggaaccgcgcggttctggaggctctccgggagctcgtgatgtatcctgtcctctacgcacgggaggcccgcgtgctcggcctcaatgtattgtcgcctatcccctcttctcttcgtccttattatcatcaagtgcacctgcttgtaaatagcaatccatttttgaaataatctttgcattggtgcagtttcccagaggattgctgctccacggcccctctggcactggaaaggtactgcttttacggtgttaatgtcttcaatccggtgcaatttatggccaatgcgtctgcttaggctaggttcatgtagagtttgcttttatcttgctgtggattttgctactggtatcgcaatttgtagtgctgaatgttttactgcttttgcaattctgtcagaaaagcatggtccgagctgttgttcgagaatgtaatgcccacctcacagtgattgagtaatgacttaactcgaattggttaaccttgaaagactctgctttgcttttaattgcatattttgatttggcacttaattcacataatgtacatatgtttacagttcaatttctgtgcataaaccccacgctggagagggggagaagttcatgcgagaggcttttactgaagcatattcccaggcatcacagggtagaccagccgtgatattcattgatgaacttgatgacatatgtccaccgcgtggcagtaggcaagtttgttatattacctacaaattttatatttgccaagaagttattattaatgtatttttcacaggagagagcaagggtcccgcattgttggtcagctgttgactctgatggacgggaagtcatcaaagctgcttccccacctagttgttgttgcatctgctaccaggtcaggaatgtcagttgcgtgatttgtgatcttagcaaatagcctaacattttaagttcattttaggaagttcctctgttgatacggcagcatattccactaagtgcgcttaagttttcctttagttattctggttatgaacttcgtgtttttctcttgaatgaaaacacaacttgctttcattagggtggatgctattgagtcagcactgcgaaggcctgggcgttttgactcagagatagaggttactgttcctacagcagaagaaaggttcgagattcttaaggtatcatataagaatgtagttttcccctcaaaaatagtaaaagaatgttgtattttatgatgtaacatagcaagccctgcattttttggatgtggttaacgtatgttcatgatgattttttcttatatgaagcttaatcttatagaccatattatgtttttagctttataccaagaatctacatcttggtgaatgtgttgatcttcaatctgttgctgcatcctgcaatggttatgttggagctgatttacaagctttatgtcgagaagctgcaagacgtgcttatggtagattatcaagctcatcagagagtgagaatgtgctaacgctaatcatggaggattgggagtctgctaaatctgtggccaaaaatagtgtgacaagaggggtaactaaagaaattccagctgtttcatgggatgatataggaggtttgaaagctgttaaggtaaaatatgcctcattttaggatttctttaatcaaacctcctttaatggttattgttgctatgcttcagaaaaaacttcagcaagctgttgaatggcccatcaagcatgctgcttcatttgatagacttggaatatcacctatccgtggggtgctattgcatggtccaccagggtgctcaaagactacccttgcaaaggctgctgctcatgctgcccaagcttctttcttttcattaaggtttgctgcgtaaaaattgttctctctttttctcatttcatccttccaacatgcaaaaagaagcctgtgaatcgcataatattttctgatgtgatgcttatattgtaataaattcaataaacatcacttaatctcagatgtactgaaaaggagttattagaggaagcaaaagaacttaacatgtttatttcatgtactgttaagaccaagctggcataatttgttcaaattctgctgcttgaatcgttgtcctgtacgctagtccaaataatatagctagaacatgctaaccggatcattttgagttcagtatacagtcttctatgttgttctaaatttcttacacattttcaaacagtggtgctgagttatactccaagtatgttggtgaaggtgaagctttgttgcgacgtacattccagatggcacgtcttgcttctccaagcattatattttttgatgaggctgatgcaattgcccctaaaaggtgcacatttatatcttgtctcttgttgtcctgtggcacatactagtgagatctatgatacatgatgcatgatattggtaaaaatgattctgtacaatcatcataagaatgtgcatgaattgttataggctatcttctataattacgtaataataatatttg

SEQ ID NO: 16573 - DNA, 12721 bp, Oryza sativa
acgtctgaggtttatggttcgtgatgtggttgatcttcgttcaaacaaatggggtgcctcgacgtgaagaggtaaataaaatcaccctagtgttttattttagttatcttttatacatgcattgcctttctttcataatgacgttagtctcttggttgtaccgaggtgctgctatgagtactttggtcaatggctaccaaattctagcaccatagttatctgtagtggctctttaactgtgagcttattagataaacatgcatgctcatgtgggaatggcaagcaatcgccagtgctatgaaattgcatatatttatttagaatcaacgggtttgtctattgctttgtacacccctatattaataagagaatggccatgtttataatccatatttgaaataattcatcagttcaccgttttgactatacattgaagcattctgtttggtaccataatgttgtttctggcttacactaaatttaatgccaagtatggcttcaatgtttttgttcccactcttagtttgctgtttgtattagcaatcactggttagctggatttataaatttattatccattctgagttttgtgatgcttgcaatcttcagattaaggccaagacaatcagtgaaattcatgatgaggctatgaagacacttggactacggccaggggcaacaggactcacgaggaatggccgtaatgcaccaggtggtcctctttcccctggtggattcccaatgaatcgaccaggaacaggagggatgatgcctgggatgcctggaacacctggtatgcctggatcaagaaagatgcctggaatgcctgggttagataatgataactgggaagttccacgttctaaatcaatgccaagaggcgactctcttcgtaaccagggtccgttgcttaataagccatcatctattaacaagccatcatctattaactccaggcttcttcctcatggaagtggagcactaattggtaagagtgctcttttgggcagtggtggtccaccatctcgccctttcagccttatggctagtctcactcatacaccagctcaaactgcaccatcaccaaaacctgtaagtgcagctccagctgttgtgcctgtcacagacaaagcagccggttcttcccatgagatgccagctgcagttcagaagaagacggtatcccttcttgaagagtattttggcatacgtattctggatgaagcacaacaatgtatcgaggagcttcagtgtcctgagtactactctgagattgtgaaagaagctatcaatcttgctttggataagggtcccaacttcattgatcctcttgttaggctgctggagcatctgcacgccaagaaaattttcaagactgaggacctgaaaactggatgcttactgtatgcagccctgctggaagatattggtattgaccttcctctagctccagccttgtttggtgaagttgttgcacgactgagtttgtcgtgtggcttgagctttgaagttgttgaggagattctaaaagcagtggaggatacatacttccgcaaaggaatttttgatgctgtcatgaaaaccatgggcggaaactcttcaggtcaggctatattgagctcgcatgctgtggtaatcgacgcctgcaacaaacttttgaaataatagccccttggcagccttggcatatcaaccttttggatgctgtgcctagccaaaacagcatcgtgtattctctatagcttaggtgtttcaccccagaggaactctcgtactggagatgtgagcaacagccagttttgtgctgtatatttttgcaaggtcagatgagtgttcattattgtttcgacaacgaaggaaagaaagaagccatggattttgctatcgggtgacagcttaattcgctggagcctgagatgaacaaggcttaatgtggtatttttgtgtccctttattagttcttttctgtgcgtacacattttgtaacaatgtactatggttttggagtattctgttggtttacaatatatcgtgtcattgtagcggtcaaattttgatacctaattctgaggtttgcttgagcattcgtgcctcgtgtgcgatgaagttttatcattttcctcagaattacttgctgatgcatttgactatgattctgtttgtgggctgcctgcttgtgcgtgacattcttcatactatcaatataacaagagagttcacatcgtctcctaagctaagtttcctaagggctagtaaattggccttatcaatttttggtaagttttggaatttttgtcaatgctaaattttggtaagttttggaatttttgtcaatgctaaattttggtaagttttggcatgacaaattttaggaaggcaaagttgtgctaaacaaaaatagcctaagttaattattgaaatggcctattttcttaggcattctaaaatttgtcttcccaaatagacactacatactattaaaattgtcaaatattggtaagtaaaatttgggcctcaaaccaaactagccctaagttcagttttttttacgaaactagccctaagttcagttttttttagaaggagagatcacatcatggcctattttcttagacattctaaaatttggcttcccaaatagacactacacattattaaaattgtcaaatattggtaagtaaaatttatgcctcaaaccaaactagccctaagttcagtttttttagaaagagaggtcacatcatctcttagattaagttttttttagaatgaagagagtacggcatacatttcaaccaaaatttaaatttagataatagtactagacaaagcgctagaagccttccgtccctatccccccccccctctctgttgctggagatcaaaatcgaatcaattgcaaagctcaccggtcacccacccaccccctcgttgcgttgctcctaagccaccagacgcagccctgcactgcagcagcagcagcagcagcattagtctcgtgtgcttctcggcggcgagtgatcggctccaccacctcccacttccctttccccttcgttgtcacgcgaacgcgagcgagcaatcgaatcttcctcgcgtaagcgtaacacctctcctctggtcttgctccgtccgccccgacccgaccgtgcctggattggacctgacgagaggagctcgcgccctgccctgtggtgccagtgccactcactaatcgaggcgtgcttttttttttcctttttagggttcgtcggccggcgcggcggtgggcgcgtgtgctggtccagagctgcatcggcggctggcgcgctcttcgctcggaacatggtatgcacccgtttcgctcctgcttttcctcccccagctgcttgcttctgttgatgcttgattgaagaaccttcagctgtctcgtctctttgggtagtaggaaggcaaggaagaatcatgtgctacagtatactagcgtacaggcagctgggttttgcatgcaaaatcataccatctttgtggtgtggagcttctgctcatgtgcgtagggctgccgaaatgctcaggatatcatctagtttgtgcctgttgggcgtgcaaatgcagttctccttgtcttcctttgggaaatcgggaatgcttggttggttagtgtgatttttcctggtagaatctgggatggtttgctgcagcattcactgccttccgctgtgcattgaatattgttcccggcaaaaataacattagcttcggtcaccctggcaaagatattgttccgttcgttctcagtgtctagagtaatgcgagcttatttcattttcaaaatcattttagatgtttgccagcattttatgcaccatatgtgatttctgccctttttctcaggccgggaggcacaccatcattctcatgcaaccatcgcagaacagagcgacaagaacatttatggacttcaattcagttaaccatgcactggatggtcggtattttctctcatgcttgcttgaaatgttagtgcagttatgggaataacctttccccttttgtgcctgtatgttcccggttatgaacttatcacaaaagtggtgcattaataaattgcatgagcatttgttgcttgcttcagctatataagcagtggcatagtattttcttcatttactccttatctgttagtactttggactgaaattcaggaaattcatcagatttttgttcactgtcttttagtttaaccttgtaggaatatataacagaacgtgtacagattgctttaataaactaacatgatatgctatagctaatgtacagaaaacccaacaagctactctttaaagctcaaatatcattgaggaatatgcgtagtgcttctatttgaatcaacatgataacagtcatacgttttctttaaccattaaatgaatgtctgtaaatttcacatagtttgggagtcacgcagtcaagtatcagctaaccataggaccatgccaacggctgtacgattgttgctgttttccattctaagtcttgggaaaagcatctctattatccccattatgttcttaatcatgcccaggacaagcattgcgtgctcttccttgtttcttaatccattttctatgtttatatgtgtgttcttcccttgaggaacttggtacttacagtttgctgtatggaatgacaggaatctgtggcctttacgaaaggaaaatcagggatatcaaccctatggccagggacttaacttatgatataaatgacctgtacaatttcatcgatggcctaaccgacataagtgcactagtgtgagtgccggcttccctgacatcgaatagcattactaatcatacactgatgcgcttagaactaacttaaccatttgtgccctcaacacctcgcaggttcgaccggtcgcttcatgccttcctgccatacgaccgtcggtggataaagcaggagatgtttcagcacctgaagaggttagcacagcagtaaagcgtgatcgatcgccgttggcaggtgaatcagcaaacaagcgtgatcgccgtggtatcctgttgcggtttgtttcgtggtgtgagatatctgggatttgtttcttgtaagaaaaacgcgaggttttgggtcgccagcctcctgtcgtatccgatgcagtattctggctttgaatggaatggtttgcctctgtctgtctgtgtctatgacagtatcatactatcttgtgagcacctttggaattcatgaattttacagaattttcacatgatgaaacagttcaagtcacatgaaattcctctaaaaatcgtacgtcccaaaaggacgcttgaacaaaacacaaaaacacacacacccaaaaaaaacccgaaggaactgcctcaatatccttccaaatgatactgtgcttctttctgttacaaaaaatgaaaggaaaactaactgttgtttcacctataacctattgatgtgctgttgctgatgatacataaagaactagtctaccaaagagtggagaacagaaccagaacgccattggtaatttggtatagaatgaatcatggatggaagacaagtatcctgttcatgagcttgtcagtcaactcccacggtcttgtagctcgttcatgagaggaatcaactccacagtacccgttccagcatcgaccactttgattctttcatcttcgacagccacattcagagcatgacagctagaatcatctgcgacaaggacggaaaattcagcagtgtcttgacctcctttcctagcttcagtagattcattgtcctgaagcatctctgccgggaggagcattgagttttggtcactctggggaacaagaaacagcagcatcagcgggagcagcctcgacaagtttctgatcaggacggcaacccagaggttactgaactccgttcgagtcacattcagcaactgcagcatcaggccaccccaccagccagacatcagcaacccggcattttggatggacatgagcagcgcatagaaagttccttcgatgcctggaggacaaagcttggagcaaagcacgaggagcggcaaccatttgagcctcccaaccatctgggagacactgttgtcaatcaccgcaaagacgtaatccggaatgccgattcttgtgttgagccgggtcaccattatcagatcgagcattcctgccaggcttgaaagaacttggccccagaatagcacgccgcggaaagggcagtccttcagtgaaatttggtatagtaaaactcagagcagcgacccgattgagccgaccgaatacacaaggaaaataaattcctgaaataaacgatcgaatgacgcaatcgaagtgtcatcagatgattaaaattagaagaaggtcaaataactgaatttatctaaaaccacacctcattatatggatttaacagtggtatgcattctcagtattacagtccatgcaaatgatgcgatgaactgatgatatctagcaaatatctatatgcaggaatgtgcatacctcagagaatcctggtcccactattggatcagtgtaccagtagaacattcctgcttggatatccaggcttagactgagagaaacatacatatacacacacggccgccaaacttcggcacacttcagtgttgcccccatggactgaattgctttgtagaatttcctatgaacctgaatccatcaaagcactcaagtggcatcactgtccatgcctgaattcagcaatctcaacacacaaaaggaaaggtgttcaaattttgtcttgacattctgacctgcttgtaatcgaaatctgtaactcgcctctccttcagcaaaacaccagccaagaacaccagtgcagaagggatgcttagtaatccaagagcacccttagaacaagaaaagaaaaaaaaagcaagaatcacaatcatatcaattgacattgtgtgagaaaacaaatgatgatgcaaatcattatctaaggtcagggaatatcacacctgagaccccatggagtggacaagaagaccactgatggagaatccaagcaatgccccaacggaggagctgaacccacacaggctctgcatgtctgcggctagcggctggtgcgtgatgctgttctgagcaaccagcgcgtccaccgtcacgtcggccaccgccgcgcccgcgctctgcgccgtcagcgccaagatcgccggcatgatgcccagcttgcggtggagagagagcgtgagcatggacgacgccccaatcactcctgaatgaatcaccgagagaagtgatcaagtaaggcgaaagccttcgaactgcgagatgggatcgaggaggcggaggaggctgcaatcccctcaccggcgagaaggaagtacggccggcggcggtaaccggcgacggggacgacgtcggtgagtagaccccagatgggcttgacgacccagggggcgctgacgaacccctggtagaactgcgccgccgacggctgcacgcgctgcacgtccttccagtagtaccccgccgcgacgccgccgacggcgtcgccgacaccctggcaggccccgtagacggccacgacggcgagcacgaagctccagtgcagctcgcgggacagacgccggagccagccgccggggaaggaggcgccgccgccggcttctcgaagcgccgcgtcgtcgtcctcctcctcttggcgatccatctgggcagcgatttcttgccgggggtttcttggggatctacggcggaagcccgccggaattcgcacggctagaatgcaggtctcgcgattgatcggtgggagagattgacgaggcgcatcttggcgttggcgagctgagcaagagcaagtgtgcgttgatgggtatccgcgctcaaggttttgacttgacaccccccaccttgcaactattatagtactgtatactcctactaatttaaccatggtaattttgcaccattaatctatgtactagtagtagaaaactgggcaacatgtcaacactaattttgactttgtgccttttactattgcgcatcatctctttgcactgcgttattactgtgtagctacttacgacctaatcaaggcctgataggaattaataagtgaatatgaaataagttcactttcgacatttaaatgctgagtttgaattgcgtccttatccacaataccagtataatgtcagttaatttataatatcggtgtacccgagattctaaaatagtataacaccctattttaactgacatgatgagccaactatgatcatactgatcgagtaaacgtgagacccacatgagccccatatattagcggttaactcttttttccttcatcgcctcttctctctacccatccctcttgccaatttctctccaccggtggagaaggccagaaaggcggtgagcagcgggaagaaggatagcagctaatgggagaggggtgacaaccagtggactagaagaccttgagcttgccaggcggctgctcgagcaaccctcaacctcaggaacccagcatcgacctcgatcgcgtaacatcgtgttgccccctcggcttaccccgatggcaacacaagctacgtggccaaggtaactacggggttcttgagcatgatggcttttccagcagttgctccagttcctgtcgggaaagagatggggaaaagggatgggtagatagatattaggtaaagggactcggtagagagagttggctgctaacatgtaagacccatgtgggtctcacgctgactcaaccagattgataatagtcaactcgtcacgttagttaaaactggatgttatactgtcatgtgacctcggttacaccgatcttgcaaattggttgaaggacacaatctaaactcatcgtcaataagagagacctaaagtgaacttattataatgaatattgactattgagttggcccagcagcccaccatgttcataagaataaggtccacgacaactgctgctcacctactctccacctctcccagtctcctgttcgttcctctctcccaagtctagggatgaaagtggttggaaatggtcggaaacggcatcattattttattattttttaaaaaacaagcagaaacgggcgaaaaattttcatattcatgaattcatctatttagtgtcaacttcaatgccacaccgttagaaattaaaaaaaactaaattttaaaaatgataaccatcgataaaaatattattattatattagttgtgcggaaacggtatcggtacggtcagaaaatttccataccgttttcacccccagcaagtcccaacaacgttccgaggtcacagcgctcgtccgggcgtccatcgctgccaatttcaggcccgttgttttggcgcccgaatccccctcccgcatttttcccctttagaaaaccctgcgcgcgtggcattctcgattcctgcccgtccgatccgccctcacggccttcaccgctcatctccgccgtcgattggccctaaccccaccgaccacccgcggccctcgtcttcctcctcgccacgccccctttcacaacggagccgggcgctgtccccccctccgcgctgcaccgcaaaccagccgccgcctcccgtcaaggccgtccttcgccgccgcagccgtgagggcatccctccccctccccgctgagcgagctacactggcctctttcccccctgccccgtgctggacggtgagtggcattcttcttcctcctttaaaagttttcttgggttgatgtgtatatctcgcttaggtctggggatttttgggtatgatacttcttgattttgttaggctactcatatagcatatggtagttcagatttggatgtgttttgcacatatgttgggttctgcacactggttaattctgtagtttagctattttcacatagaggttgcacacatgcatgctaataatttgctggcaaattcgcataattcaccgccgccaccgcggcgtcggtttcttcactctccgtctttccaagcagcatgacgagaggcaagaagggcatgcagcccaagatcagtgcgtttttcaagcgtcaggcccccgagcccgagacgagcaggttcttcatcttggtcccctcttcaaatctgttagctgtagcgatccggtaccaaatattgccggattccactctagtagcgaatttctgcaatattccatcaattagagcgaatattaaaatcgctcgtcaggttggaaaaaaatggttgttgatttagttctcgttaattcccaagcatgctgtccgacattggcatgttcctggattcagatttgataatggactgatcaatctttgttgatttggtaagtggtggcgacacgcatagggaaggaacctgcgggatggaggtgaagaggcccaagagctgtgcggatggcaaggtcctcaacaagaagaggaactacgcgcagttccacctggagcttgggcagcccgattttctcctccacatgtgctcggtttgtggcatgatgtatgcccgcgggaacgacgacgacgagaaggctcacaaggcatacccaagagttacttcgagggcgtcccgttcaaggtgttgcacctgatgtatatttgtgaatctcactcttctgttcatctcgtgttataaatttctgtgaagagtttatgacaaatgtttgagttgcagggttggcgcaataaaaccgtggtcgcgaggtctgaaggtggggatcggataattcttgtgaccgatgaaaattcatgtgctcggaacagcaaggtattttgcctgaatgactaactgtattgcctagatagttgaaagaaatcactagttggggtcttggggaaatgaatattgaaaagagtgggttcctcatagttctaaactgtagaatgtgtgtctttactaactgcgaagtttctgatccaattttgcaaccactttacatttacgagaagttcagaagcagattgcagacattttatgattatgtaatgtcatgtgaatatttcaggtccaggaggtgatcaaagtggtacagaaggagctggggtttggtgaaggtcagctccttcacaagctttgtaaggtaacatcagctcctagttcaaatatgacaacatctatgcacatatattcatcctaatgggtaaaacctcatttgcgttgcataggtatatttgttcatatctagtcagaggatagtgggatgccttgttgcggaaccaatcaaaacagcacataaagtgattccaggctccacagaggaaaacggcactgatctgcctgttgataaaattgaaccagtcaaaacaaaccatacattagagttcgggaaaatcagttttaagagggaagtcctgaaacggcatgatcattcagacaagaacaaagaagagtaccgagatcctggtgctataatatgtgaaaaggaagatgttcctgcacattgtggatttcgagcaatttgggttgtaccgtcacgcagaagaaagcgaatagggtcacaactgatggatgctgctaggtaagttctaagtttgatgcgcattctcacctactttgcttcacttagcatctttctttttcgcagcattcctgcaatgcccgtcttgaactcttgatagcatacattgttctttttggggggaatacgcaaaaggcttgcgcatcattgcattaagagaaggatagcatgcattgttctctgtaacaacaatgtatagatccatcatagcacgcattgtcaatttggacaaattccaagcttttgaccagattataggactaataaaactatttgttaactgacatcacactgcaaatatcactgaattatttatctgtctgtccagttgttctcttctatgctctgcaagcatttccaagagtttgatattatcttatcttgctaaggcactctccattcgtcttctgcaggaaaagcttcctcgaaggcgagactttgtgcatctcacagtgcgctttctcaccgcctacttcctccgggaaggcgctggcacgcagctattgcaagaccagcgcattcttagtctacaaggagcaagatgcataggagatgctgcagaagatgttacatatctgaaacttctcttcccattgtaaaaattgctttgctggggatatatgtgaaacataaacaggcatgttctgcttttagtgtaagtctaagcaccagaagcagtgcgtttttgcaggatctctatgtattgacacttggatttcctgatcagcagcattttctgaatatcatttcatattagtagcttgcaatcttcttggggaagatgagatctttattagtccttgggagttattaacaggcagagttatcttctagtgttaacctctgtctctcaatactctcaaaacccaagaaaaacacaggggaaacagtacaagccgctgcaatcatatgggaacatgtcacaactttggtcaatatatacagcagaccgatgatacaatgttctgataactagtcagaatcaacaatgggcgacactgatgcttgtgcgccagaataatacatcttttagtgttttctcctcgtcaatggaccatggatggctgcatttgagtactcatcaaccactgattgtgtaagtgatggacgcaaggatcttagcgcggcctggaagtgaatatcgtcacatacaaaacgctctgacctcagactttccctcaaggcagccattcccgcctccctgcacaggcctt

SEQ ID NO: 16574 - DNA, 4693 bp, Oryza sativa
cttaggctctcagcaccttcaaatgcttcctgacaattgttcaacagcacacgcttgaatgtaatctctttgccacctgtttcttccgaagggaatgatggtagcttctcattgagatcggaacaaagttgagcatacatcggacagaaggtgggctcaaaaacagccttctcaaatatgagagaaataacatcctgaatcaaaagcagaagatatattaatcacaaggaggctagcaaaaaatagaaagctacagaaaagagatctaaaatcatccaacctttagaatatcagcagtggtaattccagattccattagttggcccttgagtagatcaaatttctccggtgtcagtttgtttagtatactgcatacgcacaagaaaaacaggcagcaagtcaatgccagaaaactgtgttataaagaaataaagaaataaagaaataaaagcactcaaaaaggaacaaaaacatgaaaaagactgaacgataattatgataccctttcactgttttcaggactctatctttctctgagagattgcctcttctagctgaccaaggtacctcagccttgataagagcaggagtcgggccaacctgaaagacatacatcagcaaaggcctgatcacaaagtcacaaatacatacaagtatacaagttatgaaagaaaaatacatattaaaacatgtgaattgatttcatacaacaaaataatatggactgtcacatacaagacaaactgacattgttctgtaccaatttataacccgacacttcttctgtggtttacatttcaacattcattgcaagaaagatagggttaaaagagcatagatggcactagtgatcaattgtgaatgaggggacagcaaaatgtgtaaataacactgttgagttgggtagacgatcccgcaaaaggcaaaacctagttagtttagtaatttgatgaataataatagccatggattaaccgaggaggttacatcagacataatcaacagagggaaccaacattaattccgaatcagtagctaccactaagcaaggctacttcaaaagcaacattgtttagcgcaggaagaaatatgagcttattcaagatatgaaaaaaaataatgaatgaataaggtcaaatggaacaaactttactgataattcttgtcttgaacatacctgagcttttgaagcaaactggtggtttaattgatcctgcctgttaacttgctcttgttgccgaccacttgaagcatgtgctgctttagcttcacgaatgttgtcccaggacttctcttcattagctgccggaggttgaaccgtgcgtgcacgccagtcacggttatctgtctcaccataccgattgtgcggttgcgcctgggtttgtgtctgcacttgcacctgaacaacaaaagactacaatttgagacagaattgtatgcttcaaccagaccaattggtaggattgattaatacgtatggtaaaaccaagtgaattatgatgacagcggaaatagcaagagctcacatctgactcagggcgaccccaaatctgatcttcaccatgaagctctatatcaatctcttgattaattcttaagatggcctcaggtatgtcaacgatctgttagtaagtaaaatcataattagtacgcaaaaaattagtagtcttcacaaggtcgcaatataaatattatatgccagttgaatgttagacactgtctaatgttgtctcaatagaaggtgtagtacatttataaaaccaggttaaaacagaacgaccgaactgcgaaaatagggtactaaaactcaacccccccccctctcttttattgcatttcaagactacagagtaaacaagtaaccaaaacttatatcgaaagaaagctgcggctcttccacttgaggctagtaggtacagtttcacttaaatatcctgtgagtgcctctatttccatcctagatcggagctactttgtatatagcatagtctaaagttaaatcattcatcactgaaatttccaatgatatgctagcaacgcataccatcgaagtactcgtaccagcaaaatttctggtataaccatttcaatgtggccaatttagacacttctacatttattgcagccaaagttggttgtgtttcaactttcactgcacgaatacctaggggacattaacgtggtatatttcgatgtttgtgtgctatgcacctagttgcagaaacaccacctacgcgatattgttttccatgtctgatgtgttgaaaagtattccaaatagaaacttctgctctaatttagctcaaatgtgccagatacgctgcaagcatttttcaacaaaaccaaacgacagggagcacgtaaagcagaacatgtctactaagatattcacagcaaatttcccatccagaaactgatattgaataacacaacagattgcaagtacctcacgcagttcgagaagttgatctcttgtatagcgaacacgctcgcgcacctcaaaatttggatcaccaatctgcagcaaaagtatcagccatgtcagcatatcaaattagaaaacacaagtccacaactccacaaattaaatcacaggacacaacattttggctaataatctgagagattgatccaacaaaaaaatatttgacataaagattacataacacccacgacaacaacaacttgcttgattcagctaaggatgcaatacataaatgctgtttgcagttttaaaacaaacatatatatgtatgaaacttgccgaagaacaaggcagactcagttaacttatatgcacggcccattgtatcgcacaagccacatagaagagcaatagaagccctgaaagctaaaacaacactggaatccactacaaatcctaagtatagcatgctgaaccatgaaatatccaactttaattagcaaaagctgtcatatcacagtcgggactatcagctccttgtctcgcattaaccccctcctaaaactaggtcgagccgtgcaagcgataatcaactacaaccactaacgcccctcccagattggagcatcgatttgagatccgatcctctcaccggatctccccctcccacgcccgccaccatcccatcgaatccacatcgagcagtacatcaagccgccagatcgggcgcgtccaagctctcatcccccatcatccccccctctcaccttggatgcgccgccgacgtgggagcggagcaagtcgccggagccggaggcggcggcggcgaaggcgggggagaagaggcggccggggcgggggccgccgccgccgccgccggggcgcaagctgatgacgggctggtgatccttctccatgcttctcagacggggggatgggagggggatgaaccgaatccgggggggccgcgcgcgagctcgatcgaggcggtggggggaggaatccgcggggaaatcgcggagaaatcgaaaccccttttcccttctccctcttcggcgagagaaggttgcgtttgcgaggggaggaggggaggaggaggaggaagggggagcggaggcgtggacgacgggaggagggtggggttttatcccgggtgcttttagggctgaggggagggtgggtgtgggtccggatcgtagtttccgcacgcttgcgtgggtagtctcgtactttcctatgcgcctcgcggggattttactggcacactctctcctggtgcctggtggtgtgcgctggtgtatttgtgtgcgggccggtatttgggtcgtggtggttttgggcacgagagattgggatatttacgattgggggtatccggggcttagctggtttgtgacctgaggggtgggtattaccgtactttgtgcagttttgctctgcgtgctcgactgctcgcatagtcgcatccggcttacggttacttctgttcttcatcgagttggtattatataccagatctgttttaaaatataataaatatattttctatgtaatatgaattaaacaggtcattaagagagtacattttaaatatgtatctaggcttaatggagaagtctattctgtcctagggtctcgaggtcggagtcttgacccccgcgtcgctctcacgcgggcggctcgggggcgaaaccctagccgcccgcgccgccacaccttcttccccatcctccacctcgccaccgccggagctcggcggcggcaaagccggcggtgagccaggaaggcggcggcgaggcccatacgagtcagcggaaccgccctctgcgtgaggaggacggagatggccgatgatggcacggccggaggtggagtcggccggtcagcttggggcggcggatccggcgcccctgtggcaggatctggccccccacctgcgggccagcgcggtgggcgacacgacggaggcagagaggggcagcgagcggcagcgatggaggacgcgggtctcgatcggcgatgcagcagcgaggcggtggtggccctcggcccggtgatggcggcggccggatccggtgatggcggtggccccttgaccagatccgtcgccctcctggccggctgacgacggcgagctgcctaggagaggtgggggccggtatgccctcgccagcgcagggaaggctgcaggaggccggcgacggaggactgagccgggtggcgggcacgtgacggaggcgggggcctggtgctgcaacggaggcgggg

SEQ ID NO: 16575 - DNA, 4228 bp, Oryza sativa
gctgtgggtggtgggctaggcttggcggctggagtgacgatgtggtggtccggcgacgttcgttgcacgggtggattgggtggttttggatgacgctgacgaaagccttggctggcctttggttggaggcatcgttcccctccttggaggcgtcgttatggcgtctccctcactaccaagaacctttcccatgcaaggatggtcgttcgtggaccccgcgtcgaagctctgtaagcctagcttttcggcgaggccttcgtctcctaggttccattcttgatgtggcgagcgtacaactttcttcgttttcttctaggtgaagtcggagctgctttgttagggtgcaatgaagcttggcaacaataacatgttgcagttttcgaggggcgttggtgttagctgcgttcaagaagtggtgctctggtgatttgcgctgatgttcaaagtggacaatcgatgtcttgcttgttttctgtgatgcatttggcaacgatgttgtgatagctgtggagtcgaagctgctgtgtcgctaggcgacaagcccggcaacgataacatttgcttcacgaagtcgaagcctttgtatcgcttacaacaagctctttatcgatagctgttttgggctccgccatttttcctttttccatggtgtcggtagcttaggttagagtgttgtggttttcgcccagttttcccctaattaactgtgcattgtaaggtttggtctcgttttctccttaaaatgagacaccttcttctttatataaaatgtcggcaatggcctgaccgttcgaaaaaatgtatctaggcttagaaattgtcttagaagcttgaaattctcaaaagcagctgataagaattcataaattctaaaagttttttttactttttactttgaatttattttctagacttttggtaaaaacatgaacagtttgaaggggttaggcattttatataagactagaaaaaatgtctgtgcaatgcaacgggtgaaagctattttaatcttatcgttattacttattatacgatttagttaaggtgaaattcactttgagaattcgcttggatatatatatattttagaaaaccataagttgcaattaggagtccgaccatctaaagttagcacgtgagttttttttaaagagatttcctatacgactccttctgtatttccaaaagcgaacgaactttaaaaaccgactcaaatacagatctgtatttccaaaagtgaacaaacttaaaagccgactcatacacggatggcgtaccaaagtaccgacaaaaacatcttaatccttataatagtagagtgggtatggttgtcagaaactcctcccttaaataacgactaggaatatatagttgagtgaggtggtggataggtcatgatttaaagtatattttacaggtgttagatattgtttttgtatgtttgtgatccccccttgtttaccatactaataacgtttattgcaacaagcccatagactcgattgcacgagtacatatgactagggatgggttaggacgatgaattgagatccaacctcttatggtctatagagtggaagaagggatataagcataattgagacctaaccatttgtagcgctgggaggaggaataagaatggctccgcttttaatcattagagactagcttggtttcaatttatggtctttgctatctttttctcgtttggatttataagatgcaaatccgtattgagcaggtgtttgatactacctcacatattccccatgcccaaatgtaattatgctttatttatttccatatctgcattatatttaaaaaaatcccatctctactgcatctaagtcccactctgatatattttcataaatagaaagttttataaggaaaatgtgagctctattgattatgaaatcaagttacaattgtttaatagaagctcacgaatataagttggtgtttgcacatgccataccgcacaatgcattgtgcacataactagctaagttattttataatgaaaataattattctagcttttgtttcaaagaaactataaaagttgcaggataaatgattacaaattataaatttacggtttaattaaaagcaagacaaccacttaaaatacaacttaaatacatatatttctatatatatggttggtcagagtatatatggtgaagagaagatgcacatcggtggtatgcacggcaaaggacacaaagatgtccgacttattcgctaatagcctcgtcgccattctcgttctcgtctatgtccaagagaaagtcgggtaggggtcagccacaccatccccaccgccggcctcgcgctatcgctctcagtgctcgatgtcaccacatcgttctactatcacaacacctcgtccttaagaacacagctgccgtcctagtgaggctgtttgggatggtgttcaggtgatgctcatgaatcgaaggcgccgattgttgttggtacatgacaccgtcgtcaatgtgttgggcacaagcgacgtggcacaatacaccgtcgtcaagataaagtagcaactgcaccacacgcaatatttgggtgtacaatcatgtgctggtggccactaagaaagagagagaagggatggagggagagaagaggggcaatgatttatgggtctcgctataatttttttgttttcttaactagggcacccactattatgtgggcctaatatttgttttaattttttctaaccagattccaaatgacacgtggatcccactagtgttttttatattttcttttagtgccatgtaataaattttacgtgagacgaagaccaagtaaacatgttataccgacatcatgtgagccaaaacaatcttaatactactgagagactcgacccaatcttatgattgaggaagaaactcgacctatgattaagggacgtaaagtggaccttttcctatacaaattcagccacagcccacgccccacggcgacagttcacgcgtatcagggatcagaaccaaacgaaaggctggcctgctcgttattttggtctggcccattgaaagcattggcaaagatccagtccgttgtctctgcaacagccgcgcacaggcgacaggtgcacgggctcgttccgcggcgtcgcatgcagtgcaggctcgcgaggctactaaactcgccttccactctgcacaatttgccgtctctagtctctacctgtgtatgacccggccgtgccagaacctgtactaccggaatacggccagggagtacatgccagttattttggaatttattttatttttttattttaaattttaattaatctcatattaggttttagatggtctcttctttccatagtttttatttttactaaaaagaagtccgcgcgatgcaacgggtaaaggttatcttattatcatcatacaatttagttaaggtgaaattcactgtgggaattcgtttggatatatatttttctagaaaaatcatgagatgcaattagaagtccgatcatctcaagttagcatgcgaattttttatttagatttcttatatgactccttctatatgtccaaagacgaacgaagttaaaactcgactcaaatacagattgtatttccaaaagtgacatgggccgacatgacgatgacgaagccattagccattaggcgtcgttctccttcttgaaggtgtcgttctgacgttgacatttcttagcaccaagaacctttcgcatgcaacagtagttattggtggactcctacgatgcatccgaagctctacaatcctctataagtttctctgttttttttgggatgtctatacatctattgatagaaaatcccacctcccatctttcaaatgttggaccgttggatgtgttttaatattcgtgcagatgcattaaccctacctctcatcctcctgttcccctcccgtcacgcgtccgcacccctcccatcgctactcctctgcccgatccgccggcaccgcccgcctcgccggctggccggaggacgtcaacggcgccggcgagaccctcccctccccccttcctccttgagccgttggcggcgaggtgcccccgccaccgacgccgggccaccacccttctccagccctgcggcgttgccggcgccttaccggccgcccgatccgccgcccaccgccgggctgccgcctcccccagccatccttctagagccggcgaactcctcccctcccc

SEQ ID NO: 16576 - DNA, 28317 bp, Oryza sativa
atccggtgtcccaaaatctgtaagatttggagatgcaaaatctgtcgaaagaaggttagcaatttcgtttttcttctccaaaataatctaccgtgtaccccgtgtaatgctgtgacgggagtgggtgcttgtttgtagctgtactagccggctagccgcgaccggttccatcgatacctcatatacctatcacgtgtgccgtttgcgcgtagggaggtttgatatagtagatcggacggctctcgtgcgcggtgtgctagatggtgcctgcaatattttgctcgctccgcgtcaaggccatgatgcgtacgcgtgcttctcacacgaaggtccccacctgtcagcccagccacccgagtacccgacaggttctctgctgcactgcgcgctctgctcgccgcggtcgccggcggccgacccgcgtgaaagcgtggaacatatccgagacttagttggagacttgggccgcaagcagattggatgagtttggttgttgccttaattattattaatcacccgtctcttaacgggtcggatcatatgtttgttagcgagaccgagcaggatacctgaattaatgaatttaacaatccacatagctgtacaccctataaaaggcagcagctagcgaacaagaattttcgtgttttgtgtgttgacatgaagataactactggtgacaggtatatacatgtgcagattttttttttcatgaagaaatacggataacgatcgctaatgtgacctttttttttcttttctctttctcgcttatgtacaggaaagaaaaacggaatgttggattcaagattcctaagaagaaatttaggttttgtgttcgtgatgagtatggcacgaaggcattggctgagcaagttatggttaaatccacgtcactgtggcgcgagattgagcttcgtaccgagacaaggatgattacagcatttttttaccatgggtgcggccttcgcacatggtcagcgtacaggcagaacatccctatttttaataaattgcatgccgcattaaacaatatactcagaaggtacaagagtcgtcgtgtggaaattggcctattttatctgcaatcaaatatgaaatgttttcagtttacagtccggagtcctttggacaacaacaacgagtttctgaaaaagttacggaaaattaaagcacacgaatgcaacatgagagaagataatgcggagaaaactggaagcctttcccctataattatggggacattgagattagttagcaagaggcatgtacttggctttatgtttgtgatatttttatcttgtgtaataatctttctatgaaaatataagatatcttgaacatcgcctaatattaattatttcttttacaatgatccttcttcatattcttgttggttttctaggccttgaaaacaacaatagaactccaagaccatagcaacctacttttatattgttgtacaattattcataaaaacatgtaaaaaatattttgttatgtaaactttatagcaagtttttttcctatcctattggtgtattgctggcctaacaaaaaaaacatatattttatcctcgccagtttgttttattgcgcaagcgttttttggtaggcttgcggttttttttgtccatccggttttttccgtcagtgttttttcacaccgcagttcggttttcatccacttgtttttttatttgccttttttttcgccgggccggaccctaatgttgcctccacatcgatctttcttcccatgcatgcgtcgtttcccccatccaattgatcgcaaaaatcgattctatactcatccttcatcattttctccatggtttcccctttcaactcgattttaattcgtcggatttaatctccatttaacattcgtcgatgatggctggccgttgagctttcccgaccattttatctgatcaaaattccttaaccaattttgggagatcgagaaaattcagccggactttatgggtaggatcggctccggcatcgtacggcacaaaaccatattccgaaggttaaaaacggtagtcgactgtgcgagctaggcctgtggctccacttgtccgtgggcctccgccttcctccccacgccgcatgcctccatccacccaacatgcactggtcgtcgctcgccgctcgctctctctccgcccgccggcctttgcttccctagtcgcctgttggcgagctcccaaaccgcataggatgccactccctccctccgcatgtgcgccaccgccgctccctctgccctagcccacggcaactccctccttgccgcctagccatggaactgaactgggttgggactagacaaggtcggggatatggctgatgtgtaataagggctttttgttagttcagggtagtagatacattttcttttgtattctaaatgaatctctaatggtggagtaaatgtatggtcaaatggttattacaattttgaaaagcgggttcattgagcaaacttcaaaaatgatggtcagtttaattgttaggcttcaaaatagggtgttaaagtgaaagacaaatgcatattctcacctgtctcaaaataactttatgattcaccatcttatttatgtaagaacaaactttatgtataagggtctatttggatcacatggactatatttttagtactgtcacatcggatgttatgacactaattagaagtattaaacatagactaatgacaaaacctattcgataacccttgactaattcgcgagacgaatctattgagcctaattaatccatgattagactatgtgatgctacaataaacatgtgctaattatgatattaattaggcttaaaaaaatatcacgcgaattagctctcatttatgcagttaattttgtaattagtctatgtttaatactctaaattagcgtccaaacatccgatgtatgtgaaggcgtgcaatgattgctttaggtggtgtttggatcagcccccctccatatatatatctttgcacataacttgccctgacgagtgcatttcaaccctgtgacatcccggcccaataaggattaggcctgtgtggcccatgtgagctgtgtgcgcatgtttagtaccacgtcgctagtttagcacgagtggaaccgacttataaggcctcttccctccaaccacatcactccggggttaacccttttacacgaagcgaggacgaaagtgtaagtggggtggtgtgtgtaagtgggcccgctcatcggttggctgggctacgcggttctagagggagggctgttacaaacccaatcctccaaaatatccctaaatcagctaaggtttcgacagtgagtcggtgaggttagcggaagaaggccgagaggtagtggttgtgggggttagcggaagaaggccgagaggtagtggttgtgggggcctcagcggcaggaggcaacgcagtgcagcggggttagcgatggcacagtgcggtcagattagcggcgggaggcccatggattctccaagctcgtcctcgtcttgaagtcaccggaagaaggtgttgttgctcaagtgctcgttgtgcgggagatgacattttctttttttggggaagaacattttaagtattttttttttgggattctggtgtcagtatatagttacaaagagatatatgcgacatgttgtgatgtggagggggctaagagcaaaagtgttgcctatgtgacataccatgttggtggtcaaacgtggtcaaagaacgattagactgggtgtgatacattaaaccaagttcacatatctaaacgtgcaattttttagtccacagacttaagtgacaccaccacacaaatttaggggaccggccatgtatttcactctataaacagccataaatccacagaaattttgttcacatctcgttctaatcgtttcaaccatgccccgttctcgccgcggccctcccaagggcgccaactcgtcggtcgccggcgctgcgccgcgcgggggacgcgtgagtggcctcaatcaagcgtacaaccggatggcgaaggccagccgggtgcccaacccgctggccacgcccacgactcaccagggggagctcccgggaagacgtgtcgaagtgaaagaactgaagttctagtcaaaatatgataaataaaaatattgttttttaagaacattcatttgaatgctgtcgtgctctataattcttaagactatttttaactttcccttcaactaatcggcagcaggaagctagtatggtttgctttctctcatagccgtggatcctattctctgcattcttctgaggtgcagcagcccgcggagcagctgggccaccaggtcgccggcgacggggtggacctgcccgtggcggcccaggagcaggcgccagtcatgggccaggagggccatgtgccggcggcgcccgtgcacgcgccggagtccgatcctccggcagcgtgagggcgagtgcaactgacaagatcgttctgcaagcgaggagggtgtagtggcaccgaagccacgcaacgcaaaacaaagcataatcggccatgcaaagtagtatgtagtaggaaaaaggcagtgaatcggctggtagtttgtagtaggagaaggagaatgaacaagaagtatcttgaatctggagacgttaatgagaagttatcctatatgaatttcttctttctactgttgattgaattgctgtttgtttttcttttcttttttgcgtttttgtgatattttctttgggctgggctaaactgttcgaggaagagggtgggctccggcctttcgatcggtgctcaaaggtgggtcttttggcctcttcgtgcctcttgatcttgatctgtaggagtatattttggctgtgtttagtttagtgtaaagtttgaattttgattgaaattgaagatgatttgactgtagagttgcgtgtgtatgatatgttaatgtaatagaaaaagactgaagtttggatccaaactctgtatctaaacacagcctctgctagaaccgtcgtcctcttcgtgcccttgtgtgattgctaatagatctgtgtagattccctcactctctcaaaaaaaaaaaacagtgcagattctgtctcggtcgcgctcctcttcgcgttccaggaatccgccgcttctcgggaaggcgggcgcggcggcgcttccatgttcccggcggcggagcacggagctagggctcggccagcgccagatctaacggcgtcttcctagggaagagcaagagcaccggcagatgcctcgtggtcagctatatcggccgtctgcggcggcctcggggcccaccagatctggcggtgggcggcgacatcgagctgaacgacctccatcggcgccaagcagaccctgccgtatcgtcggcgtcgagcagcttcgccaacgacctccacttctgcgacctcggcggcggctgctcgttcatcccctggtatatttctttgctcttggcaagaacaagaacactctttgttcttggcatgaacaagatgatcgtgcctgctgcaattgtataaacagagaatttgttggatctgtggctgcagcgtcattgttggatccgtggccagcagcagcggcgcccgtctgctggtgtaggagagctctgtccatctgtcaaaggagcagcaaggaagaattggaatggagtattgcttctggttcatgctatagcaattttcttttatagaattggtgctaatgagtttgctaaattggaggtcactggatgtctggattggttgatttgagggtaattgatgttcttgaaagtgcagttttttttaatggtgccaactctacaaatttaatgtataaacttgtcttcttggttggttgatccagatgcggtgagttgacaacaatgggctcttgcatctcaaggaggaggtgacgacagaggtcaaatgtcaatggaggtaatgtttcttcagccaatttcacaatgttcaatcaatatagtttcaggtttttcatagcacaaccatttggactgtatgcaagggagtaggagtacatggattactcctacaagggagtaaaacagtgttcctgtaagggagtattaatactgcaagggggtaaaacagtgttactgtaagtggcaattctgcatcttactgtaagtagcctatttaatccctttcctgggattcaacgtactcgattcatactccattgaacatcatacatgacagaatgacaccatgattcatgtatccattcaatttcagagaccataaaaatgaggcactcaatgaaaagacaacagaatagcctaccaaacttgcaatccaaactttgttttccaaaacaaactttagaacatatgttgtgcatgacaataaaccagaacaacaccagagttactcctttacatcagtatttgtactttcatgtagttttctcccttatatcagcagtatttgcaacttttctcctatacatcagtatttgcgacttttctactctccatcacaatagtgtcctaagccattgctctaaccaacttgttctagacagtccaacgccttctcgtagactctagcatcacatgatagccaagatggtaaccttccttctctttccaaagcttgcttattcatatgtgggattttgtacctatttcctccattatctttcatcacttctagcatgcacagctgtagagttaggaacactctgtttatttttgaagcttcataaccatcaaattcttcttggacagcatgaattagttcttgaatagtttttggacttgagcaattagttaatgattgaatggagctaaagaatcctaaatctaacacattcatatctggtgaatttgagggttgtttcagctgaatgtttagtcctgttgcagccactgcttgtaggaagtgtgggtcatttggagggacatgtgttctagcgttgtcctgttggatataaattgtatccccaatgtcctcttctggccacaatgactgaatagctggaattactttttcaatcaagaattgcctcatgacatccctgttgactatgatagattttgtctctaaagtccctatggttctgttgcgactctttcttatagctggaacctgaaaccaattcataaagagttcagatcagaacatagagtaagtcatttgaaatgatgaactcaaactcacctctttaacaaatggccacgtgccaatcttgccagaaaaagtcacattcccttcctcgtcaaatctgggcctggctattgcagttaggaacataactttaccgattctattcttattttgaacagtccgcaaaggatcttcttcttctggcaggagatagtaggtcttcttccttttagtcatatcaaccacttttcatcaatatggactatgttgtgcatggtcatgaatctaggatcaatatcaccaagctctaacattgaaatgcagaatttcaccctttctctcttattttcctccctcaagtatggcttcaacgtattggagtggcgtcttatcttacccagcttgaatttttggtgcactgttgcaatactcacacccaaagagtttgcaagtgaccttaaattagatcttctattcagcggaattgtagcgatttttgagagatcaatttccatcttgttggggccacagcatctagtttttctgttgtcaacatcaaccttgagcccgagtgcaacctgttcccttgcatgcttccaaatcctttgaataacttgaatacctacattgaaatattctgcaaccttttttgtggtgtccttctctaatctgccacctttgcttttagcatgtaatgctatgtaaacagcatatctttctttgtctgataaccatctccttatctttctctcttgtggttgaacacctacaagggcatgaatgaaacaggacaaatatattaaatcaaattaacaagattcaaaataatatggataagcagttgtactaggactaggagtactagaattaatataggtaatcaaaacatgaattacatatcaacatgtacttagagtagcagaatgtcaaatcaacatgtaccactgttaacatgttactaggagtgggagagtaggagtactaggattctggagttgatggacaattaacatggatagacagttaacttttttttttctttcactctttatttcagttcaagaacttcaggcacagggaaataaacaaatggcagcaggagtatgtgtacaacagtacatgcattcaagtgtacaggcacagcagaaggaaactctacaacatgtatagatcagcttgtataccaacataaaccatgtggaggcttgtcaatgagtaggaggcttccatcatcacaatttgataatgcagtttgtatcttccttttgtaaatgcagtttgtaacttctttttgagactgtaacatgttgggagcagaatttgataatgcagtttataacatgttgtaaatacagttgttgaactattgggagcagaatgaatgaatgaatcgatctgacagtgtatctgtttggcaaattgagtcatgagctactcctggttatatcattgaacctacaaactgaacaagcatgagttctccagattttagaggcaagagtacaacatctactccatttcagaggaaagagtacacatctaggaattgcagaatttcaggggttctccaacaataccatgaatttttttttacagtattcaaaagattttagtcaagctttcagggtttttactccatgatttctggaaatttcagagaatactccctcatttctgaagtggaatacaatgatcaacatccatgatttctggaaatttcagagactactccctcatttctgaagtggaatacaatgatcaacatgtactcatagtattctacggagtaaaaatttcagtattctacagacatttcatgaagtgatgtacagacatttaggaatagtactctgaaaatttcagtatattaacatgatgtttggttgatgattcttaacatggcgtttgaatggcatcatcagttaagacatttcagagtgaagaatacagtacaacatcttcagtactccatttcagacatttcagaatttcagaacttacataaaaataaatgtgaactgtgaataatttcaaacatttcagaacttcaaaaatctgaaatactccaacatccttagcgagatgaatcaccttcacccgaagcaatgttgcctgcattctgagctattacctcgtcagctacagcacctccttcaccttcatccccagcaatgttgactccagcctcgtcagctatggcttcgcctcctcgaagttcgtcaccgtcttcaggaggaggagcgttgaggtcaaagagaggaatcgccgccatggagcttaacgtgatgacgcacacgcgaagcagaaacttgtggaaagggagctctgaaacttgggggaggtcgctgccggacttgtcgggctcaaactagtcgacgtgggcgtgcgttgagaagcgaagcacgccggagtttggctgaagcaggtgttctgtgaggcgaggcgtcccgtgccgtgccgcgtcgccggagtgcgcaccgaggaggctgcgaggcgaggcgttctgcgccgcgtcgctggagtgcgcgtcgaggagtgtgcagtgccggccatcggagtgcgtgccggggagcttggtgccgaggaggtgcgtggccgccgccgccgccggcgacgcggcccctgcgtgtctgcgagctactactacctccgaggctccgagcaatggaggggagaagaaagggacatcgggggcataaaggggaattcatcgcttccttaatttgaaattcaaatcccaggacgtcttataacttgtaacagagggagtagctctttaggccgagtttacttcaaaaatttttcttcaaactttcaacttttccatcacatcaaaactttcccccacacataaatttttaacttttctgtcacatcgttacaatttcaaccaaacttttaattttggtgtaaactaaacacacccttagtgttagtatttattttggcaaggttggttgcatcgatttggctgaggtgagactggtgacagtgagaatctgtgtccttatgttatgctctaaagattaactcctatattgcttctggatgtcatacttggaaaccatggcagtttttcattttcttgcctcattaatgatgcttcaatctatcccattcagatgttattgttttgaaaggtgtttgattgtattcctcaccaagggaaaccatagctgattgcagagttgatgctgcttgttgtcaacaccctgctgctgggccagaccgcccattggatattggtaacctgccagaatgttgtttttcgatgcatttatcacataattttcatactcgtctgaattttcaggtgtccagtcattaatttctgtatgccctgtgttgagataactgctcccatctactccctccgtcctaaaatgtagctatttctagcacagtgtcttgtcccaaaataaagctatttcttcacctacctcctcctctcaaccaatcacaacaattctttttcacctactttctcttttcaaccaatcatacacttcctccaattattctcacctacttttttaatacccatgctaacttcaaaaatggcttcattttagaacggaggaagtagattttaatctgttcagttgtatattcgtgtatccaaagctctctcatactactattcatggatgaaaattcaatgatattgatttgatagcagttctctgtaattggttcaacagagcagatcgtttgaattgttctgaactgcgtcccatcaaatcagtacatacaattgccaacactatcatctactaggttcgcagtgatgatttactcgagttcctttctatcccccgttgtgtgaatcttgattgatcttggttctgatttcactgaattgcgcaatgtttgattgcaggctgggacaaggcacacctaagaaccacacctccgcacaaaacttgtatttgcaggcgcatgcgtcatcctcggctatgattcgtctaccgccgatgcaaccggagcagcgacgactagtgtttttaattgtacaatcaatatggatatgtgcctgagtctttgtaacatgtagtatgatttttttactcgacaaaaatatggctgtaatttgtgttggctatatggatttgttggtaaataggatactctatagtcagggagtaatttatttttagggttaattggatccatgccactgtaaatatgacaaattaaaaatatactactactattcacgttatctgctgagtgccactacaaatttctaaaattggaaccatgccactccatcattctttccgtcctccccgtcaatctttccgtcatccccatcatctctccggcatgttcaccatgtgggtctccatcttgccggcggccatgagctcaaggagggagtcgaggaagtcgctgccgcggctgtacgggtgcatgtgtaggcggtgacgaacatggggtcgcggccagcggcgaacggcggcggcgacggcgaggggacgctctcccatggccaccgctccgcccggtgtgttacgtcgtcgccaaggcggccgtggtgtttggcgcggcgcccgacggggccgggctggggctgcagggcaagggccagctcgtcgccgtggaggccatgttcctcatgtcgctcgcgctcaccgccgcgcacatcgccatggcctaccgcgccagctgccgcgagtgacgccgcctgctcgtctacagaatcaacgtcgaagctgtgagtgattgattcccttctttgcttgtatcgtatcaaaacaaaggattttgcctagtggtagcttgtagtgtggattggaaacatattaaacccaaaatatgcaagctttctagattccaatccgtgttttcgagagattttggagaacaacttaggcatacgcttgccgaccttttactggacatcacaatggccggaagaacccgacgtccccacatgcgaggaaagcaatggtagagcggtggccggtggacgagggcaggaggaggcactgccgcttcttgccgccgccggctgcggcgcagggcgtggagaaggcgaccgcggagtccgcgcgctcgatgcggagctcggcgacgaggtgcaggttgcggctgtacccgtggtcggcgaggtgggcgagcacggcgtcgtcagcgggcgtcatccggggcggtggagaggaggagaacggggagaggatggggaagacggaaagattgatgggaggatggaaaaagtgacgggagtgggataggtccaattttaaaattttacagtggcatatagtaaataacgtgaatagtagtggcatatttttgatttgccgtatttgcagtggcatggatccaattaacccttatttttaatgagaaggttcgagcaatttgtggccaaagcaatatgttcatatgtttttactctaacaatctggaagtaatttatttagttagagaataccagagtcaaatgttgttggtatggttagatcaaaagctatatttactgacataagcaggggaaaatttgatgaagggtaatttttagttactgagaaaaggccaagaagttatatggctagactaaaggtaatctatttacgaagagaaggcccgggtaaattttttggggagtaatttatttattgacatgagtgctacggatttttgtgggaagtaaattctttactgggtggacaccagagggattcttttgctaaaaaaaatatatttgtcagtaattgatttactgatagaggcttggtgtgactaaaagccaataatttatttactaaaagaagtttaggtgcataggtaatttattagtaatctttttactcgtggtttccaagggaaggaaaacaacaggagtgtggaaagggaaaaaaagaaaaaaaaggaaaaaaacgaaaaaaaaaaaggaatggagggagtatggactgcgggcggaaaaagaaaaacaggggagaaacgactgcgggtggaaaaatctcatgaaaaattcgaaacaatgagcatttgagattagaaaaaaaaatcctatataggatttttcgaggatttccaacattaggttggaccttatggccttatgggaaccttttatcgtctccatctctttccaaaaaaaatcgtatacttttcttatgaaacatcaaaataaataaataatcagtggttcgcaaaggatcctttgaacgtagtacggggcttatgttttccatcatgcaatttgatgacaaaatcaaaatgttcgtgcccttgagatttgattcgtaagcacacgcgggaaaactaataaaatctttcagcatcgaattgcacgacaaagataggatcgaacaaataccctgcaatatcgttcattgaattgttcttggcgatcaattaagcatcgaaatgcaagggaaagacagaattcgaattcgaattcaacactgaagtattttagtacaggtttacaactgatcaccgcccacactgacgctgctactcttcttcctcctcttcacaatcccctgctccttcaccgccacgcccttcctcttcgcgtcttccgcctcgccgttgccgccgtcgtcgccgccgccggtgccgaccgcggagtacagcggcagcgcgaccgactcgggcgccttcacgtgcagcgcccgcacgttcctccacttcctcggcacgcacgccgcagccgcctccacggcggccaccacgttctccaccgcctcctcccgcgccatcgccgcgtggcccacccgcacggcgcggcacgtgccgccctccacccgcagctccacgcgccgcgccgcctccctcgcggactccgcccacgcctggtcggcgaggtcgacgggcacgacccgggcggccttggccgccgccttgcccttgccgcccgggcggaccctgaggcggcggtcgacgagcaccaggccgcggcgcgcggcgggcgggagcgacccgagcgcgggcgaggggagcgggtcgatgtcgtcgggcaggtccgccgggaggcggtcggagacgagggagatggacgggaacggcgagcgcgggaggcggagggtgtgctcaaaccggcgggcgggggcgcgcttgagggtgacgaggaggtagatgggctccggcgccggggtggggtggtgctggagccaccggaggagcgccgccaccgcgcgggccacgtcctcgcggcgtacgcggctggccggggcggactccatcgatgacggcggcggcggcggcgggagtttgggaattgggagtggtcgactcgcgggggtttagggtttgtatccactacgcttgttggacccgaagtgggtttggtcctggttgaaccggaccaggaagccggttgggcggctcggatgtgagccacggctggagtgatcggctcggctcggctcagccggtgctgagggaccatggtccatggagcaaacacaacacatcattgacacacaactataccaacgttctatctcctttgatgtcatgacatcaaataaacaaaccaaaccatatcttggccagtatgtcatcaatctggtcacgccataaatctcaaggggttcaagtcttcaagacatggctagatagatatatatcaaacctttctacggagtatttgtatggtcataagtgtcatgatggtccaaaagaggcaaagatgatgttactatgatcaatgaggtctactctaatttgtttgttccccggaggatggttacatgcctttgttgagacaattattccatttgaaaacttcacaataaactcacttggtaattactccctttaatttgaaggaaccctatagttttcacttcaacatcatattacacttgctagtaataaaatgtggtaccggtaactatcgagaaccacaaactaattataggtgcatactttctatttgcgcatctccctgtcctcaaaacaatgaggtccacatatactcagacacgctaatcaaaccacccgaaccaccttttatcactgtgtattcacaacctataaaaacacacttcacggtcggacagttttccttaaccaatcatcattccctcatcccattaaatttgctcaaataattaaatatgacaggcatgggttcttccatcggccgtgccaccattttctactgcgttgctctatccataattgccggcgccgcagcgacacaggtgccccccaccgaagcagagtccgtagaaggtagtagcacatgcctctcctgcaaaaattactgatcagctaactaatgcgttcattttttttggtacacgtactgatcacggcacgcgcttgtggctgcacgtatgcatatcccagcggcagagcttgcgtcctctgccttcaaggccgacacgttgccctcagcctcccgcaagctgatggccgttagtgacgtgccgctaggtaatggcaccttgttgtgttgttgtacgtacatgtgattatagcttggcggtatatcgtctgacatgcgcgagtgtggcgtggtgtgtggttggcagcgccggtgtgcccggtgcggttcgacaagatgaaggggcccgccatcgagctgggaaagaagtgcaagacgacaggggtgaaggtgtgctgtgaggcgttcaagacattcgcatgcccgcacaacaagctgatcaatgacgtcaacaacggatgcgcggacgaaatgttctacaccatccacacctacggccaattgctgccgggaaccatcttcaagaaatgcctcgagggaccgcatgggatgaagtgttgaattcgatcgtgctgattcgacttgctcgatcgatatcgctccgttgttgctagcctccggcctgatctatactacctataacgatgaatgtccctttcgtcatcttgcaatgtaactaaacttacttttattacttcgaaatgcaatgaaccacaaaaggtttattacaattttctcctaggatattggttgaacataaaatgttaaccataaacacaacatttaaaagtgtgatgaagagggcgagcgtttaaaagttgcatgtcgtaatcttgaggcaatggttatacaactgtttaccaattttggatggagattcacaaacagaattcaataattgtgtactccttatcttgggttggtaggtgtcttctttttcatgtgagaaactttttgttttgtgtgttactctgtaataattggctgtaactcgttgagcaaaggccgggatattctattccattatctaaaaaaaaccataaacccaacatatcaatgcaatctctgtatatctaattgttataagggatcgtgacgctttgagagttgtacaacaacccaaacacttttttcccttcctttcccttcctcatcttgcatgtcgccgttttcatgcgttcgtgaatgctccttcgcctcctatggtggcagtgccaacctcatctcgactagcaccctcagctaacctcctccatttcccttctcccctctcttccccaaggcggtggcatcgagtgcccccaccatgccatcttcgttgaatgaggatgcaaccatcacatagaataaggagcaccttctcctcgtgctcaacacagttgtgcatgacgtcttttacttgggtgcatcacctcatctatggatgtattgtacagaaacgttatcatgccgacactgccataagatcgacaaacaccttaataactcaatgaaagtactcaattaatataaacatgcatgtacggcaaatagacaaacacataaatagatatatgtcatattttggcaagaaaaccgaccatctatcttcggctcttggctatatgtcatagttttgggcatggcataagttaaatttaaagggttcatcaacacatagctagatgtacctctacagagtatttgtaattttgcatgtcaacgggccatgtgtttcaaatattcaaagaaaaatgctgtgtgctggaaattgtttcttctccgaaggatgtgtgtttgcttttgttgagaacagtataaataatatatgaacaatggtttaaatggttgctatcggtgtaatcactccgcttcatatttcgatgatatacaaactattcattgtaatctgtagtggggattggtacaactaatggttttattctaaatagtttatggaattcacacacacgttctctctaattaaaaaatcacaggggggcatcttctcctagatgttactccctccatctcacttaaccaattttttcaatgttttataataatataaggcgcatatgcatatatgtaatgaaatagcatatttccctccgcttaattttttttaacattctccaccctgaccagtatctgtaatttcattggttacatgtactttatttgttaagatgatacaaaggagaaggtgagaatgtactatttcttgatttttgcattagtagtagttgcgtcttatattttttatatggagggattaattaaagttgtacttgtagcagccaattctttttcttccgtttgaaaactttactacacatgcaggctcagtagtacttatttttagagagggaaatctgtgtggtctgtagtatgtacttcataatgcgagtatgcatgcatgatttgcattagaaatcattgagaattaatctcgcacactaattataggtccagctaagttggccctggtatatatattggccgcaaattaaatcaccacaactcctgccctcaaaataatgaggtccacaaacagacgctaaaccacctcaaccacaatttctcatggtcagtttcactaatcaaccgatcattccccctactctcgtatatatgctctcgtaaaggcacgaacacacatctctagtcctgcagcctgctgggaatcgcaagctaggatgggttcttccaccatccttttctactgcgtcgctctgtccgtggtcgccgccgccgccgtcgtgtcgtccgccgccgaggaggccgaggggccccaagacgaagcaggccgcttcctatcaggtactatagcacatatgagtcctgaaacgttaatttcctagcttttgcaacgtaaaaaatggctagctagctaactccaattatatttttgccatcgtcttttggtatacgatcctcttagcggccaccctggcgtcctccgattccgacgcaaagacgtcgcgcagggcgctgaccagccaagaggagataatcgcaagtaataacacgcacgcataagtgtttgttgtatacgtactgtgtgccggcgatgatatgatcgtcgtacgtcgtctcgatctgacacgcacgcacgcacggtgctgcggcgtggcgtacgtttgtacgtgtgcagagccgtgcccggtggagttcgagcaggtgaaggggttcggagaacttggggccaagtgcaacgacaagcagacgatgaaggagtgctgcgagctgttcaagaagatcgcgtgcccctacaaccatctgctcaacgacatcaccaacgtctgcgcgaacgaattcttctacctcatccacaccaagggcaagctgcagcccggaaccatcttggagaactgcaacgagggccctatggggatcaactgctgaacgcctcgaagtaccgtacgttgatcaatatattcaccatttcttaatttgatgacaaattttactatagtacaccaaaagtttgtgaaatttacttgtggatatcgaaaaaaaagtgtaatggttagaggacaccaaaaagctagtaatttgccggagaatagtttggcacaattggagagacaaattcttcaaaatacgaattaaaacaagcttatgaaactttctcttctcacacacatcacgctggttggagtctgtgaaatacgaattaaaatttatcctgcgcacaagaccccagcaaagtgatagaatgatgtaatcttcagcatagtgatatagaatgatgtaatcttcagcatagagataaaatgatgtaatcttctacatgtaataaggatcaatggatcactggtggtacattggtgcatttgccatgtagtttataggatttttttctctctaaatgattcggaaatcagaacacacacatcatcattcatcagttgagcctcttgatggacacgatgcgaccgagctcctcgcgcaccgacacgagcagcacgaacgcctccgagccctgcacgtccaccatgtgctgcaccgtgccggtcaccgggtcggcgtagcagccgcagccgaccacccgcagcacgccgccgccgtcgggcgcgccgacgacctccgccacctccttctccttcccctccgtcaccgtgagcagcagcggcgccgcgggggagccgcggcgctcgccgtactccacggcccgcaccacctttccgccgtggagcgccacctccgtctcgtccaccaccgggaacagcctccccccgatctccacgcgctcgcgcgggtcctcgtcctcgtcctccttctcctcctccttcccggcggcggcgacgacgcggtcgtcgtcctcgccgcgcgacaccaccaggtgcaccttcccctcgtgctcgacgacgccgcgcgagacgccgcccagcgcgacgcgccacctcgtcagctgcggtacgtacagggacgacgccatcttgacgctacgcgggcctccggctgcggctgcggcgccgccgtccccgccacacaagaagatcaggaagctagctacggcggcgcacaggatcagcaagagcgatggggaatgcatgagctcctcgctagagccctcctcctcgatatataaaggagcgggatctggatcggagttgctcgatcgtgtgtgaaacgggaccagaggggggttagttcattgttgtaagcgagcgtaagccggtaaaggcaaaaagttaagccggctgggaagcatggggtggcatgaaacggtcgagtactagtagataacacacataccatcggtgatcgcgagccagttcacatccaattaatgttttttttgcttccttttgtcactcataaatgtgtagtactaatgcattcttgccaaattatgtttgtagccaaagtcctcaacttttgcttgtcattcctactgctctctttaattagtttatttagaaatactttagaaaagactactgtgcgagcgagcgcgcgtgaatgtccaattcctatccggattaaagtccccgcgtgaatgtccaatttcgatgtagtacaaactatatatatgatatttataggtatcataatcagacttcgctctaactttcagtgcaaaaacttgtagacttttcttgagatgagattttaaaccacgcccatgagcttgtctcatcccgattcgtttttaactttcaatgttgaagttttgtagtttatagaaactttatttacatagaaacatgtgctgcacagaacatgctcgcaccatgcgaattttcacgcattggacatacctaactaatacgtgttcatgttagaaagttcagccgcgagggaaggatcggagtgatgttaattatgcaaaaaagttcatttacttccctaaactatttcattggatcagttaagcaccctatacttatttttattagtttacactgaaaactactaaaaatattcagctttactttttaatatcatttatatattttttcctctttatatgagttgtaatttaagctaggaatttgagccatagatgacactattgtcaaagttccgaaatatttttaaaaaatttcacaactattgacttgaaatttaaaacctagatatttaaatcaatctcggtgcttccaccctatgtaaacaatgtagaaaacatctaagaaatgttgagagctgagttataatacatctatcaatactgcaaaatttcaatgtaaaatatgacatatatagacaaagaaaaatacctttacgaggtaaggtgaactattttaaatagtttgggatgtaaaaatgagccgataacttgtttagggaattataaatgctctagcgaaatagttcgggagagtaaaataatgattttacttttccaattatacatatgaaccaggtgcggatctctggatttttcatattttggtccttttgaaaaacttatttcgtaaatagacccctgaaaaaacttatcccagaaatggtcctttttggggcgccagagtacgggacagcgccagcctctctggcgccgtcctcctgccaccgtggcacacgcgaaccgacgtggcaggaggtgctggcgccgcccgagggaggagggcgccagcacggctggcgccgcccccccccccccaacccctcacctccattcctgtttctctgtatagagttacaacggtgtcatttttgttttattttttcggatgttttttcacacttaggatcacgatacaaccaaatttaaactcgaactaccacttagctaagtctgaaaatagctagcataccacttagtctactttgcaccttcactaaaattagaccataactcctttagtaaaaccctttgatcagcatgttataaataatgcactctatcactatatgaaattacttaatctaattcaaaatataaccacatgaaataatagccataagttaaacagtacagagagatgcatttttttgatttttatttcatttttttgatattttttcacacttaggagaacataggaaccaaccatatataaaaaataaactcaaacggacaaaatatgttacttgtagaattttccaaaactctatcgaaacggacaaaatatgtcatttattaaaataggcgtaactttctcatacggactcggaatcaggcaaataatatatccacggacatctacagaaaatgttacatccgattctcccctgctttgctgggttcggcgatattaaaacctctaaattccgcttgcaagattgtattttcgaggagagaagtttctcggtagagctttggaaaattccacatgccacatattttgtccgtttgagtttattttttatatggttggttcttgtgatttcctaagtgtgaaaaaaatatcaaaaaaataaaataaaaataaaaaagttacacatctctcctctgcactagttcggagagagaggagaggagaggaaaaattctacaggtcacatattacgtccatttgagttcattttttctatggtgggttcttatgtgtccctaagcgtgaaaaaaatatcaaaaaaataaaagaaaaataaaaaaattcgggggggggcgccagccactctggcgtgctccccctagtcacctcagcatcgccccgccacgtcagcagggggacggcgccagagaggctggcgccgtcctgttggatgacggcgccagccactctagcgccccaaaaagaaccatttctgagataagtttttccaagagtctatttgcgaaataagtttttcaaaaggaccaaaatgtgaaaaattcacgtgcggatctagcccacgtgccaacttggccacgtcccgtggactagggcgaaaaaagcccacagagatatatcttcagccgttcagcgtatgtagtttgaagtgagcccagtatgtgttgggttgccggggcttgatcatggataactcatcgcccctgcttgatacatgcggtgtgcagcgacgcaagtaaaaagaggaggaataagttcacttcgtgaccctcaactgtgatcgaaatctaatccatgaccctaaaccacaaaaccggatatctcgacccccaaactcctaaaaccggtgcaatttgactccctaggtggttttgaagggcagttttgctgacatggcgtcacgtggcgcctacatggtgatattgaccgagtcttcgttccacgtggcgttgacgtggcacttaggtggcattagaattaaaaaatatgtgtgggacccattagtcattcacacataaagaaatatgggccactgacatgtggggcccacatgtcaatcctcttcattcttcctcctccctctctcccttctctctctttctctccctttttccccttcagccggcggcaggcggcgagaacgagcggcgacgacaggatgggcgagggcaggaacggcgagccgtgcagccgcccccgccgctgccatactcctccttccgaggcgtcgcagccgccgccaccctgacacctctccccgccgtcgcagctttcccatgctcgtttgtagtttcaactgcctgagaagagcgccatttatattttttccacgaatatctacatgtatgttcacataagaagacaatctacaagaaacaaataacagatatggtgtaccggcttaaatagactttctacctggtcatataaatactggatctgctgagcttgttgtagaacatgtgttgacagttgacatgagatgattaagtgctgacatctctattatctttgtctctgtttcttggacagcatcaagaagatttgtcaactccacctaagatacgagtgccggcggctggggcagcacgtggagctcgtcggcggcctgctgcgggagctcgagctcgccgagctgatgcggcgggaggccaccaggcggcccctcgagcggctccaaggcgcgctgcggccgtgctgccggcgctcgcggcgcccatccactgacgacgcgtgctcgttctcgctgcccgccgcccgccgttggggaagaaggggagagaaagggagagaagggagagagggaggaggaagaaggaagaggaccccacatgtcagtgggtccacattacttttttgaatgataaatgtgtcccacacatatttttaaattctaatgtcacttaagtgccacgtcaacaccacatggaatgaagattcggtcaatatcgccacgtaggcgccacgtcaacaaaaccattctccaaaacagtcgagggagtcaaattacaccagttttaggagtttgggggtcgaaatatccggttttgtagtttagggtcatggattaaatttcgatcacagttgaggggcatgaagtgaacttattccaaaagaggacgcgcgggcgtacacgatcactcgctctcgccgtgcggcccgttgcccgttggtggtgagcgggtgcctcggcggatgacggaagcgcgcccggagcggagcggtgctgcgttcgggcggagcgcacggaacgacatagcatgccaacgggtgcgcaagggcgcgctcctgatcgtcacgactcacgcgggtcgcggcggggcaggctgccgtgccgacctgccgggccttcttctccagcatctgcctggtggatcgatgcatattgtctctcgaccagaactcttattgctagctgagctggtaataacggtaagataccgtggcagccgatcgatcgatcttctgtgtggaggtacgggccggcggtgtctgatttggggctagtttattttattatcgaaatcaatctgactaatatttgatgttattaaaatttggtatgttttggttctatcgaaagtttggtaacgttagatatgttagtttgaaacccttctaaagtcttgtatttgtttttgtgagagaaaacttttaaattccaaagtttagtaagttaattagagattgtaaaatatattttattttgtaaagtaacataaaaatgatagggttaaaatagtaatgaagtgaaacatcggtttaatttggacctgcgcgacggctgcgcgacgatggcacgatcgagctcatagttgaatggagacagagagcagaagccacctggacgtggtaccggccgaccggtggcttctcggtgtcagcttaactatgaattatgaaatgatgaaatagtttgtccttctgttatcgaaaaaggaatgaaaaaagatacacttattttgtcacgacttatttggacgttagaacgtaacatctccgaactttatcctggacctctactcgaagagatcggtttaattcccgttctttatggattccaagcaagacggaagggtactgtaaaaaaccattttgtacgtcagtaccctcatgtgcagcacacctgtcttcagaaatgattgtccacatatggatatggataggttaattttcagagaccaatttttacgtgccctcatgtgtagtagaccaaattttcaaaatgcatttttagacaggactgtaatattgactactaattatgtcgggttccaaaactaatgattcggtaaccaacatattaaaattgtatcaagctctggatcagtagattgatacaagttcaataatctgtatcgtctttgcatacatttagacatagctttgaaggagatattattacataaagtaatagggtatttacaagattgtggctaactattacagcagaagctttagaatgacctaactctgctgttttactatagacttaaaccatttaaattacctagacttgaagactaagttaaaagggaattaacttgtgtgattgaactcccatcatcaacaagaactccaaaataattctgaaaaaggatgttgaagcaaggatgagtacaacgtactcagcaagctattatatcaaataatgaatgcatgaaatagtatttaagtagatctaggtttactggcagaaagctgagaataaagaggaagaaagcctggtatgtctttatgcaacagtatttagtaaaatcttgagttaagtttctaaccaaatatcatatgagtcccgatactcaattccgtgagcacggctattcgaatagtttcatgaatactctactgcagtagatgtacgctttactcgtagtcgtagcccagccttaggttagtcgtagcccagccttaggttagtcgtactcgatgttgaatactctacttgccaattttcattagcttagtcgtagcccagccttaggttattaacaatagtggcacctgttccatgaactctagtccccatgcgctctgaacgtaacgttatcagcagcgagaggagttcttgcgttcccgaggtttttagagagaactggatgagagaccccacgtcatctcaaccaggtttttacaatatacacacacagcgatcgcaatataatcaagatatttacctgcgcctcggtaaatatcacatttgcccttcgcggcataagtttgcctccttcgcgaggacttagataagaaccactgtacagaggtaccacattgttaattaacctaataactaggtctgtccctattctaaaagctgcggtcatactcgttcgtttgacataagtatttggtggcaattatatcgatagagacagtactagccacccggaaatcaactaattcatgcgtactgtcccaatctaagttcattatatttttatgcagtctaactaggcagggctaagcaaaatctagcatatatctagtttgctatatgttcaagttatgaattcaaaatcatgaatggctaatgcttagaataaagctatagagtataggataattatgctcaaaggagaggaataataacttgccttgctccaacgcaaataaatccaagataggcaacctgattatccgatgctcgaaatactacaggttgccatccagaataaaatagactctattaaagaagaggaagaaccaaattcaataaaagccataaaacaacaagaaagcaatgaaggtgagaaaggctaggtttgaggggtatagctatctccttaatgggttattgagctagtattttatgcgcaggctctaaggagttggaggctaggttggagaggggatcaagcaactgatgtcgcttatatctcatgtgtgggctttggttgaatagtggctagggtttcgatgctgaaatgggataacatatcggctcgtatttcatgtttaaactatgggtagttggagggtaaatagctggtatggagtttggatagcaggctggctagggtttcatttgattaagccaatatcgaggtaggatgaatatcggctgagatttgggtgtttgctagtcgtcattagaattgggtagtatgacgactaggtttggtgtctagccgatgtcaacagacaatataacggctagagggataggaagtttgtgtaggtttagtggggcggatgtgttactccgacaaccgtgagtggcggcggagcggctaggatcacacagagtctgagagctaactgtgcggcgtgctgtggaggtcgagagaatagtgaagctccgactgctgtacgcatcgaggcgtggggtgccaggagcagcacttcgaccttaggtttaggttttgccgggctttacaaccaacggttcgacgtcggggatagtaaaccgcgagcgtccccatggaaagcgtaaagttccaactggtggctttttagtggctaaagggtattttggaaataaacggaaatattcgaaaagcaaatataagtttaaattgtaaattcaattataagattatatcaaatatttattcaaatggtatttgaataaattaaggaaattcaaatgaaatattaaaatagcaaatttggtgtcaaaaggtagggtttgaatttagatgaatttaggtccaagtttcatcggaatcggatctacggtttaggagatatgggcttctaaagattgggatttgaattaaatctagaaaatatgaaaagttactgtgcgggggcccacctgtcagtatcttatcttatttttctttttcttttctccttcttcttccttcttctcgtcttcctcttctctgttccagagagagccgagagaagagagaggagaaggggagcggggtggcggcgctccggtggctggagggcggcgacgtcggaggccacgcgtgttcccgagcgtcgcgtatccggggaaggcagtagctggcggagagggagagggaggaggccggaacggcgacggcaggagcttgaccatagcaataaaaggagtggcggtggtggcttgctgtggtggctaaaagataggggaaaaggggaaaaatgagttcacctcgtcgaggcaaacacgatggcgcaagggcttggcttgtagagctgtggaagaggagatcggccagtggcaaggtggtggtcggcatgggaggagagagaaagctcggtttgatttgggaaaaggaaggggtgatgccggtttatttataggagggggaggtcggtttggaggaggagggcaagagggtcacgac

SEQ ID NO: 16577 - DNA, 4143 bp, Oryza sativa
gaagaagaattcggcccaaagttaaaaagaaggaagtctaattttcctagagattcaaataatagatttagaggaatttggatggctagattttgaaaaaggatttgaataatttgaatttgaaggaaaattgactgagagagagtttagaaggaaattatattttaatataatttccaaaagaaatatttctctagttggtttgagtgcaatattttggagagggagtttatttaatgcactcaaatagaaattcaaaatattcaacaccataaataatatttctctagatttgaatatttttgagtatgtggagggaatatgtagggagtagagtaaatagaattttagcccaaaatatgtggtatgaaatttagagaattagatatgggctaaatgaggttttggatttgggacggagggataaagtctattctcttagcacaagagcaattactcacaatatttgtaataatattattcgtgtgccgagaagaaaatcaagctacagaaattaaattggtggaatttagatatttggatcaagaatcaaaggatgggtttaagatcaaaggatgggataacaattaattccaataaaattggaagtggaaaggatttggtttggaagattttcttggaccataattcgaaagggttttaaatagaagaaattttagtcgaaagaaagttttagataaaaaccaaatcaaggaatatttcgagataaaattttaaatgagaatcacaaaggcttttgaatatcaaagggggatttttatgcaggttagctttaggaggtctcactaattatattttcctaagtttaaagaggttattaagaatataagacccggcatgatgcaaaattagaaaatagctaatttttggtatgttacaaattaataggacaaactaatacggaaaaaaattgattgcacaggttagaacagaagtgtcattatgttttgtttctattgatccttcctttttatttaacttacgatgtcgagcatcactgggcatgaacgtacaaagttcaagtcgtcgctgcagtcttttctagttcttgttctaggctgtacttttaaaattttaaggttccattatatatttatatgtttcatagtaggttttctaattcttagatacagtatagctcaggggcaattgcttaaccgtatgtgaagagcagcattttaaaagcaattggtctaaacgttttgtgtacatgtcaattaccattggcaattcttctcttcagccttcacgtccaggcaaaataactgaggagaagcgagtgcgactattgcccgttactactcctcagaagacagagtcaggtagtctgctatagcgatcaacgcgcgcgcgtcgtcgtcgtcgccacgtcgcacaacttccttgtccttcgacgaccgactacgccggccgtgcgagactgcgcggcacgaattgagtccgcgcacgcgcgcctcctttgtttgtttgatgtcgaaccgtgtaaatcatcgtaccaacatatcctaataccctatttattcggtctacgggtatacccgttgacagttgatgtggcgagtagtatttcaaagtgacaattattttgagataacttttgaatgctataaagacaaatattgtagaacggaggaagtaataaaagaacatgtgatgagacaaaatgtgtgggtgaacgaataaaatagtataaaagttagtaggtggaagaataaattaggcatggtttagtttccaattttttcttcaaactttcaatttttccatcacatcgatcaaaattttccttcacacataaacttccaacttttttcttcaaccttttaattttagtcaaacttctaattttggtgtggaactagacacagctttaatataaaagtagataatagagaaataaattagtataaaagttggtaggtggagaatatcgtagtactaagaaatcctaaaactccttatattttgggatgaaattgatggagaaaaattcctttacattcacggacgaagggattactccctcctctttcctgtttaaattcatagaacatgtatcacatatatttaaaatcttgtatattttggaacgagaggtgaacgttcatagcgaacactacctaccgctaccgctacgatgtaacagttttaatgtagtatcttgaaacttaacgtccgctatttagacttaacagatagcggatacaattcaatttagcggatcaccatatcctgagcctattttatataaccacgaacccataacaaataacgagtttgttagtgttttgtctcccaaaactttgtattcttgtgaatcttaacatctaataagtaggatattatgtttgttgtttaatttgatttaagttgaaacaagacatcaactcttcgagtgctactaaatatctagtattctcatagcttatacgtgtattgatctatcactaatttgtttatcagttattttgttattgttttataatattattatctatgatatgaactcttaaatatatgtgataattaaatgccgctattgattaagctcgcgatccgcgatcgactatatagacaccaattgatcattaccacctgctatattctattattacctttccggtactgtctctcggcttaaaatgtcgcgcgcgtccgaaggcgtgcgccaagatcacgggtgatgacgatggcatcgatcgtagaagctgcctcttgactgcgggtgagcgtccagcttatactgaagcgcggtagatcgcaccaacatttcagcaatgcaacgccaaaagttccgtgcgaagcacagacttcaattgggcgtaggtacaagcactactacggctacagttactaattaggattttcggaacttcgttttctcgtgacaaagctaacccccacgcttgttcgttcaataagttccacgataaattgaaaaatctatactccaaagacgtttgcattaagcagcaaccgtgtactagttcactgacccaacgacaacgacgatgacgacgctgatatccgccgaaccacccggcaaccccaaccccaaccaccccggtcgattgggacacacgtagaatcaccgcttgttaccgcgctggataacgtggaggcacgtacgccagccccagcgggcacaccacggcgtcaaatctcggtgtagtactactactcagcatcagctcatcatgacctgatcgtggccatcggattacttatatttaattaattgctcgacagatgtaatatccatcggaaagcaacgtgcagctgcagtgacacgccgtcaaacgaccgaagtccactacaaaacatacagatcggtggcggtgtaacctggttaccaggatgatagtggagcgcatgcttgtcagttgtcaccatgactttgtcctttttcctttcaagaaagctgagggacggttcgccattgattaataccgttcattcaaaaaaaaacaataatgacatatattgtacgtagtttcattacatgtattgtaatcatatccgattaattatatatccacccatcaaacaaacgagaaaattaaaaacgttgaaatgaagtgcgttcatttatgtatatccatctggcaactgcaattatattttttttctcgagtatacaagccagacacactagcacgcgcacaccacacactcacacatccatctatatatatagttgtacatatcctagcacaagtctagctaaagagattaaaggccggcgaatacccatgtaagtttaggtctagtttgaattcggataaacatattctaacacaaggtttgatgaattaacttaactatcaaaatccaataaattaatgaaacatacaagtgactactacaatactacttactgcctcacgttccacaatattagaatttccaagttgttaagcaaaaaccatggtaaagggaagagacgattatcttttagtcactttgatcagtggtcaaattttaaatcacttatattctctttccaaacatctcaaattgattagccaaaaatgtataaattaaattttcgtatattgaaatcagtgctccatagctgttcatatgggaatacacaaaatttgcgtcctataaatacttata

SEQ ID NO: 16578 - DNA, 566 bp, Oryza sativa
tcgtacgcttatttgtttgtcaaaatatttaccgacaaaatttgcagattttgttcagctcagtttgatttactgactaggctactttaccaccatgtacataaagtcattttgtacagttgttgaaccggtgggtctaattcctttcgttagtttagtgtgatgatagcattggagaggtcaaatgtctgcacctccctatatatgggttcggatgctttattgtgtccagatgactattaacttggtggcatgaatttcagtttcacctgttcagttcgatggaaatgaccatcgaatatatctaatttatatcataaggactaaacttgaagttcctggatgaggaaattatttatgaaacctgatggagtggtgataggaatttcaccctgcctgaccattactctttgacacaattaatgtaacttgcagctgtttgctctatatttacatattttttttggttttgtagggatgtcttggcaaaccagcagtggttgattttgtacgccttcacttaaacaatgtgagtgacattccccgccccctctccagtgatacac

SEQ ID NO: 16579 - DNA, 7009 bp, Oryza sativa
  unsure (1)..(7009): unsure at all n locations
actagatcacaccgtcacaaccactcaacatccttacttccgtgacttaggtaatctatgaaagcgagacaaacttaatacttatcatgtcacttacctatccctgaaactagctgtcaggttccaggaaagcatatactttcctcaagtcaaaaaggagcacatgctttcttctttcttccacccgttctgtccggatctccaacctatgaaggaactgcgtgaatgcacctggtgtttaaacaggtagcaaaaacattcaactcatttaaaagttcaaggaaatcacctcaaatcggtgtgtatccagagctgtatccgcgcgaaacaaaggaaaaacaaagactgttcaactttgaaattccagagtcgactaaacagttgacatcctaaaaaaacagtattagaagaaaacatcagaacaggccatcatccnttcacttgtcangcgagccgataagaagatgngataatgcagtttagagtactatagtaaatacagtagccttactttaggcggctaatcccgtcaaacctgaccaaacccgtgcaacgaattcctccgggctttgtatctgtattcttggctgttcatcgcaaatctgctcgttcaaacttcaaaaggccagccagcaagcagtagccagtgtacataaaagcacagtgattttcttagtgcatctctggatggacatggcccgttaaggagatcagctctaagcgtggtcatttgtggaaacaacacctagcacagggcagtagtgtagtacaagggtatttttggcaaaaaatattgtggcattcttgtaattcaacactaatatagggtgtaatccgtaattgcacacgtcagcaaaggccgtgggagtcgaccagatcgttattttttttaatcttcgaccagatcgctactgattaattaccagcgttcgtgtgaacaataatttcatggattagttagctcctggacattgctgaactacaaacagtgttgagatcaacagtgtgaacaataatttcatggattagttagctcctggacattgctgaactacaaacaatgttgagatcaacagagcattagttccaggccgtatcattgtttcttgccgcggtttttttcttctcttaatttcgcatgaagatgtgcatttcccagtttcatgaaacagacaaacaaaagttaaaagtttacagttttattcccagtccatctgaaatgaatggccaaagctcctgccatccgtttcggtaaaaaaaaatgtcagcgcaaaagttagtgaaatgcatattagattctgtttttagaagagaattcagagcactgaaattcaatttccatgggttttgaaaatacagggcaatgaactgaagggggaaaaattataagctagcagtgcaatatccagtactgtcagaattgtgatcttattacatttaaactaccttacccttttatttcttctacggttaaatttgagggtacaaaaatctcaaggtgtaatcatgaagaacaaaatatgagccaccaatgcaattttcagtacgactactttcatgcacttccatgccttctgtaatactgaaaatctgaatcacagaaactgcaacgaattcgaaaccaaagcaaaacacttcatttcttctcctcgcagagattctcaacatcaactgatctcctggcgacaatgaattcagagatggcaatatcaactgttcgtctgctgcaacataggaaatatatgatgcagttagactgtgtaataattttcagaaaacattgaatttaacatccatcatatgttaattatagagtaaattgcaccaacggtacaacaacttggtagatgggtgcgatatagtgcaagaacttgagaattgaacgttcgagtgtaacaacttgacaagtgggtatgttctagtataagaacttgacaatttagtattttggtgcatcaacttagctaagaatatgctaggtgagtttttttcacgatgtcaatatgccattacatagcaatcctagggatattaccttataatattgaatttaatctttaagaattatactgtacatccaattaccttaaagaatttttgttttcttcatcttccctaatcttaaccgaaatataataatttctacatccagtttaattgactttcagttattagttattaggataaaaatataaatatgcttatgtacacatccatgccagtatattgtcaaaataattacttaaaaattgaatatgtataaatagtgctccaaataattaagttgtcatataacttcttaacttattgtatcaaaatcatacatatcttgcaagtcgttgcatttaagcgatcacttatgaaattcttatactaaattgtacttagctgccaagttattacactagaacgctcatttctcaagttcttgtaccaaattgcacccacctgctaagttgatgcaccgtgtgtgcaatttactcttaattatataagcccaagttgaaaaacagtgcatggggaacttacacagtaattacaaaatcacaagaagtctcacctttttgtaactctaaagatacatctagttttcaagaatatatcaacaaagggaaaatcattatagaacttatatccttctgcctcgcttctaaactccttggttatcacactttcattgtttgcaacctcctccaaactaatgtgattgtcagccattccaaatttctgcaattcatatttccaaagttcaactgttagtcaaaccacaaaatttaatacaaccaaaatgtacttatatgggcaaatgatgaatcttaaaaattccacatttagagtcatctagtatactaagcttatacggctgttatgtgtacagtgatggcagaagtatacagtaaatcacagtttaagggctacatatatgcacctgatcaggtaagttcagggttaatttcctataaccaattatacccatatatagatttataacacaactacattcccaataattgaatgattacactccattgtgaatctgacaatttctgttttcataaataacattaagttataagtttactgctaataaatccaatctaatagcatatatagcatcaaatttaatctagcacagttcacaccattcaaacattattgtatttatgtaatcgcaggaaagatcaaacaccattcaaacaatcctgtattcctctaatcaatagcaaatacttcagacctgtctttctctattctatggcagctagcaaatcctgaagaccttaaactacgacggtaattaatcgattagggaaatggataatcttgctcaaaaagaagccttcctaaagttttttgctgagcagctgctgcattacctgaataaaaatagagaggtggcaatgactccgattccaaatcagacgagggtcggcgactccatgcaaaacgagggcaggcggccgttggggagatcatcgagaatcccggcgtgggtcagcgaggtgtccggcgggggaaagcgaagggaccggcgaggggcaatgaagcgccaggggccgcgtggtttgtcggcgccggaccttgatgactaaggtggacggcagtggagggggacgacgagggcttttcggcgctccggtggagggacggcgtggcagcggcaccggcggagcgctcgggctctggtggagggggggcacggcggcgcgctcggtttggtggatgagggcgatggaggcggcgaacagaatcaacagatggtgggggatcgggagaaacgatgaggaatactgtgcgaacgcgaaattaccgaaatatccttccaccgaaataaacataaagactaaaatgcccatgacaattaacggtcagatataatcttactacactactacacgtataagtgggggcactgtaaaacgtccccgcaggcaggaaaggcaaacagctggggcctccagaaggaagaaataaacacaggagaggacaaggagatgcacagccattagcagagaaaaaaaagggaaggagtaaggacaataatcataacacgcataaaattgtactactacacctagctagctgcgcggaggaacaagacaaagggcaagtggtgaaaggaatcatggaccagaaggatgatcattgccatacggttgaaaaacgccggagatatatatatcgtcagattatctatccacccccatccatattctttgggtttttaaattacacggcctcggagaaagaaattaaggtccgaagttaaaaaagagtgagaaaaaaaaggatcgcattttcttttgtgagagctacgaggatccacccatgcaggaaaacccgatctgatctgcagatatatgttctggtgatcaacagttcaacacatggagcgatctcatgcacgcccacacaaattcgtgtggttttgggcaaacgcagccgtgagctttttttttttttttccctgaagctcctgtgtgtcatctctctttttcttttttgagctagaattggcaaaacttttttaatccggtgtcttttcatccgtgttcctgtgaaagcagcgccgaaaactacccccgctttgcaaaaagaaaaaaatcctctcgcgctttgttttttttttttttttttttgcctttgcgacctcatcggcatccgctttgcgacccggccgatgaagagggggaccggggagacggacggacgctgtgagccgcgaatcccaccagcgcgtgtgggcccacctgccacgggtgacgcgccggccggtccagcctccacgcgagcagcgggtcgggcgcgtcccctctccttggcggtcacgaacactgaaaaacccgaatccgataagcggccgctataaataccgggccaaatcagggtttcccttccccagccgcaccgcacgctttcttgcataagaactcccccccctcctcgctccccgccgccgccgccgttttcttggagaggagaaatccgtaggctcagaggatttttggtagtcttgtttcgtgatattcgtgaagagggggggagctaaggggggattcgtaagatcagaattggatcacgcgggggcgcgctcgggatcgggggttccaaacacagcttcttcgttgaattgtaagtttcttcgctgaaaccctctccgtaggttggtacttctgatttttttttcctttacagattttgtggtttgtagggcgtattgctatgtgttgctattgtttatgatgggaattttggtttgttggtgtagataagcttatctatgtaaaacaaaaggtcagtaggttacctctttgatcttgcttgtgcagttaggctatcctgtttgagttgttcgtgatttgcagattactgcaaaagctatcctgtaaaatttcttgtcgtggtaaagattgtactaagaatttttgtgtgttcagatcctaagacatagaaaaatagttttttttcgtctccccataggaatataacaaatgttctttttctgtgacaccatgatcgaattttgttttttaatgcaaatgtatggtattatcattaacataggatgggatcagggacgaaacatatgtgaatataggaacatttgcatatgtccaacggaaaagtctcaactctaaatcttaatccaaatgacatcacgattgtaaatccgaccagatcttaaatctgaatccaagtgagactcaattgtaaatctaaatataagaaagaatactgatatatgattcattgtaaaggacgctgtggcttgtaggaattgagtattactggaaaattaggaattgaatcagattgtgagatattaattgacctgtcctgttgtggcatatttactcctagttagaacttggaatctatcatattgttatgtaactgtttactctttggtatcgttttgatagcttcttatctcagttttacttttttgcattaaagactcagatgcttcggtctggcacatatatcttctacaaacatatgcccttattttctctttgggccatatatatttgtctgaacctgatatttaccttgttatatacttgtgcagtaagtggatgtactaatggagtcaaagggtggcaaaaagaagtctagcagtagtcgttccttgatgtatgaagctccccttggctacagcattgaggacgttcgacctgccggaggcgtgaagaagttccagtctgctgcttactccaacgtaagcatcaaatacagatttaattccctcctttgtatcttccgatgtgttgctaatcatgtcaattgttccttttgttgcagtgcgcgaagaagccatcctgatagccctttcggcttctccatcctagtagtttaggatttcttgcaattccattttggcacttttcttctgacctatttctctggctgctgcttcctgataatcgaccagttctctagtcttgctccctgcactcctccctcctccatctccggcacagtgttctgaccaacctgctccaatgggtgtcttgtctgctgctgaccctcccccagtctcagcaattgggtttgagggctatgagaagcgccttgagatcactttctctgaggcacctgtctttgctgaccctgatggtcggggtttgcgcgccctctccagggcccagattgactctgttctggatcttgcacggtgcaccattgtgtccgagctgtccaacaaggactttgactcctatgtcctctctgagtccagcctgtttatctattctgataagattgtgattaagacctgtgggactacaaagctcctgctcacaattccaaggattcttgagcttgctgaagggctttctatgccacttgctgctgtgaagtactcccgcgggatgttcatcttccccagtgcacagcctgctccccacaggagcttctctgaggaagttgctgtcctcaaccgctactttggccatctgaaatctggtggtaatgcttatgtgattggagatccagcaaagcctgg

SEQ ID NO: 16580 - DNA, 2051 bp, Oryza sativa
  unsure (1)..(2051): unsure at all n locations
nnnnnnnnnnnnnnnnnnnnnnnnnnnnnnnnngaggatgtcaagtctcaaatgagtttgaaaaaaagattcatgtgattaagaatactaacaagccgtcttacattcattattgcctcggcctgcttttctctgaacctgatgcagccatgcagtacaacgcgtgaatgctgtcaccgtgtacacttcaaaatacagtgcatcgcgtcatgtggtcctgtcatacagtcatactcctatgcaaaatgaacaaagtcaccaattatcaaatcttggaaatcctagcagaatactagtactagtacagtacattgaataatccctccgtgaaaaatgagaaatgtaacagtaggtcagcctgaagtactgtataatttattttcgttttgcaagctgcagtccgtattccgtaagaagtaacaaagctcttgggcagcaattgctagccaagattcttgggaagatataactgcagaatgcaagtccacttgtgaagtcatgaggttgcagcaaaaccgaatgcgttagctgacggcagttcgattagctgctggatgacggtttactgaacatcaggtttcaagcattctgttatacagttacctgttatcaaaagaaggagaacatccgagttacagtttacctgcatagcatcattagcatatatcagatgcataccagatagaactagttaacagatagcagaaaactgacctccctgctcgggttcgaagttgttcttggtaacaatgaagttgttcttgtaacaatgaaggcaatgtacacgagtgggcctgaataataccaaaggctcagctaatcagctttccttctccgagcacactgcgttcaaagcctcaaatggcccaacaactagtgggctggtagtgcaggccgcatgtgcaggatgacgtttcccactgctcatgacggcccaatgactgagcaatttcaacgttggaataagttcacttgagttccctttatttgtcgccagtctaattttcatccttgaaccgcaaaaccgtatacgacccatccccaacttacaaaaatcagtcaaacgagatccctcggcggttttaatagcggttttggctgacgcgacccctacttggccatttttggccattttgactcggtctccatcccacgtggcgctggtgtggcgctgacgtggcaattatatctcggtaaaataataaaaatcatgggcccacatgtcagccccaaaaaatattttaaaaatggtgggtcccacatgtcagctacacaaaataaatatggtgggcccacgtgggccccacatgtcgttgaccgaatccaatatcttcttcctcctctctccggctctccccatctctctgctccctcctctcgtcgggcggcgtccagcacggcggcagcaggcggcgcgacaatggacagcgcatggccggcggcgggcgacggcgcgcgcgaggcacgtggggacgatgtaggcgtcgatggcgacgttgggccgcgcgaggaggcgacggagcaagtggaacttcttgtcctcaccaccaccaccaccaccaccagaagcagcagagccgccatggcgcttgcggagctcagacgaggggagggcatcggcgcggccgtccccggccgcggcggcgaggaagtagaggcggcggcgccggggggggggaacgggagggcgcggtggagggggaggacgacgggaggagggccgcggcggccgagggacggggagaggcacgtggcttcgatccctcttctcccgccggcgcccatcggggagaagggcggcggactgctaggcgagcgtgcgcaagagagagatggccgccgccgccccaggcgcctcgcgcgccgtcggccgtgcgttgtccatcgccgcgagggaggaggcgagctcgtcggggcggccggcgggagaggaggcagcgcaagccggccgacgggagggagggagaggagcggtggtgcgcgggcgtcggcggccggcgggagaggagcggcagcgcactgggactagcgcggggggggggggggagcgg

SEQ ID NO: 16581 - DNA, 14557 bp, Oryza sativa
tgtgggtcccatcttttttattattattttatgtgactgacatgtgggtcccacagattttattatttttctagatcggattgccacgtaagcaccacgtcagtaccacatcaaatgaagaccgagtcaaaatggacacgtaggcgttacgtcagccaaaaccacccttaaaatcgtcaaggtacctcgtttgtccggttttcgtaagttggggacgggtcgtaccggttttgcagttcagggacgaaaatcagactgggcgacaaatagagggacctaaaatgaacttattccttcaacgtttgtgtgctgacagagtgacgagcctcgattttctaaaaaagaaaaggttacaggcctcgaacaagatgctgttaccaaagttagccacgaatttggactagaaaatagctaaacatgacggcttgatcgaagattacgcaaagttttagttcgactttcgaacttataatagttcaaaataatcatctgctgtcatcatctactcaataaaaaccgaaatcctctgtcaccatcaaaacatagcaaaaatcaaatgccattaaaaagtgccaaatgacagttgacagcccaaaataaaaaagaagaaaaaaaaaggaacactattatattccagatttccagctgcaatatcaagctaccaaatggatccccaaaaaaattgcaatccattccatgaactgagcccaccatgcaccacacaacccccgctcctccacgcttctcgggctcccgtagaccgggtccacccgccaatccccccacacgtcgatatctccagcacccaccgcacccactctcctcctcactccgctcccctcctctcctcctcccttctcgcggaggccgccgcaaccaaaaaaaaaaaagtctaaccctagatccaggccccgcgtctccggcgatctcccggccatggcgactcgccgggccctctcctccctcgtccgcgccgcctccaggctccggggggcctcgcccgccccgcgcccgcgcgggccgctccaccgaccgtcgccatcggggtacctcttcaaccgcgccgccgcgtacgccacggccgccgcggcgaaggaggcggcgcctcccgcgcccgcgacggggaaggccacgggtggaggtaagatcaccgacgagttcaccggcgccggcgccgtcgggcaggtgtgccaggtcatcggcgccgtcgtcgacgtgcggtttgacgaggggctgcctcccatcctcacggcgctcgaggtgctcgaccacaacatccgcctcgtgctcgaggtggcgcagcaccttggcgagaacatggtgcgcaccatcgctatggacgggactgaggggcttgtccgcggtcagcgcgtcctcaacaccggctccccaatcactgtaatgcccccccgcccgtcttctcatccttgtttgcgatcgtacatttcatttcgtgttgtctccgaccagatctgacgaaatgtggatctactgctgtcagatttgatctaggtgtacagttctgagtggcgagcgatcgcccttccatttcgttcattttatcggtagactgttggctgctttgtggtggtctgttcgtgctagtgaagaaattgactttttttcccctataaagtgctgccttttggtttgtggtggtcatctagagtctattagaattcattatgttcaccagtgttgcatttccgtattggcgtattgtgaggttaacatgcattggttggtataacttttccactgtttgcttgaatgaaaattgtcgtcatagtctaggaatccattccagtttttgtttatttaatacccttgccaattgtttagcataaaatgggcattactgaattcagagaactgctgatgcattcgtgtaaattctgattataattagagttgctgaaccttgtatctgtagcattgtcttggaagttgaaactaatcatatataatgtgttctactatgtttttgacttggaagttattcttctttgtaggttcctgttggcagggccacgcttggacgtatcatgaatgttattggtgagccaattgatgagaagggtgacataagtaagttactatatgttccatgtcttcattattcatagttatttaagaatttgtgtgtccagttcttatttatgttttgttattgatgctgacttctattgtagcaacgaaccacttccttcccatccatcgtgaggcgcctgcttttgttgagcaagccacagaacagcaaattcttgttactggaattaaggtataattgtcccacccttctctgatcctgtggttatctgaagtatttgaatggtaaatagttgcaaccatgatttagagtcctaattgctgtacattggtttaattttataggttgtggatctgcttgcgccctaccaaagaggtggaaagatcggtctttttggtggtgcaggagtcggcaaaactgtccttattatggagttgatcaacaatgttgctaaggcccatggtatgcatctatacatagtctcatgtgtgatattgttcaaatttcagtcacttgttctatttgactgatgatgatttgtttgccaggtggtttctctgggtttgctggtgttggtgaacgtacccgtgaaggtaatgatctttacagggaaatgattgaaagtggtgtcatcaagctaggtgacaaacaggtaattttagttgatatcttattttctgtgggacgcacacatgtgcaagctacttatatatcaattttggttgcagagtgaaagcaagtgtgctcttgtctacgggcaaatgaatgagcccccgggtgctcgtgctcgtgttgggttgaccggtttgactgttgccgaacatttccgtgatgccgaaggacaagatgtgcttttgttcattgacaacattttccgtttcactcaggtaatttatgcaagacatctcttcttttggtatttctactctgcataaaaaagaattactagtagtatacgtagcgtaggtgtttctactaagtcccattgttatggttttgattaatcttgaatcttgatgtcaggcgaactctgaggtgtctgctcttcttggacgtattccatctgctgtgggatatcaaccaactcttgctactgatcttggaggacttcaagagcgaattacaactacaaagaagggttccattacatctgtccaagctatttatgtgcctgctgatgacttgacggatcctgctcctgctactacttttgcacatcttgatgctactactgtgttgtcacgacaggtttgtccaactgacctaatacatcgtgttaataatgtcctcattatgacttgaatttgctatctgtgcagatctctgagcttggtatttaccctgctgtcgatcctctggactccacatccagaatgctctccccccatgttttgggtgaggatcactacaacactgctcgtggtgtccaaaaggttcttcagaactacaagaatcttcaggatattattgcaattttgggtatggacgagctcagtgaagatgacaagttgaccgtcgctcgcgcaaggaagatccagcgtttcttgagccagcccttccatgtggctgaagttttcacgggtgctcctgggaagtacgtggagctgaaggagagcgtcaacagtttccaggtcagaattgaatatgcatagtagtttttggagttcagtaccactacggttacagtattttgcaatttttggggttataattgatgaatcagtatgtgcctgcaagaatacactagttttaccagacagtacaatccatctacacttttttaatcctttgttcagtaacacattttgctagatctgtagttgtagacacgcgatattacagaacttcattatgcttattagtaatgtatattcatgtttgcttgtgtgctctttgctaaagtttctgttgatgtgcagggtgttttggatgggaaatatgatgaccttcccgagcagtcattctatatggtgggaggcattgaggaagtcattgctaaagctgagaagatcgccaaggagtcggcttcataagatctcttcattgttaagttctgtacaagttaaatttttggattctggtttctatatgcccgttctgtagccaggacgtgattacaagcaggggtgacatcttctgatgagcgatgtttttttgtcttccttttctccttttacccctaataaggaaccgcagtgacattgtattgtgctgcacaaaagtactcggaacttcgaaagcatgtgtcctttataatgcagatccatgaagcataggatcattgagttcttgtttttagttggtaattctttctttattatttccatatccatgctttggttgtggctattcgcttctccggcggaagaatttgcaatcagaatgattgtgcttaattgtaaaattgattttaggatttttcattatagtcaacttctcaaccttagcttttaaaccgtaatacagatacaaaatttttacctataaattatttttaattgtttcattaactctttttactgccccactatgtacttctactagtttggttctcactactcaccactcagcataatctgcaacagctttatgagttgtttagcctaggcccatatcagtaaaactttccatctccagcccaattcaaaataaaaggcccaagagtgactagcccggcccagtatatctatcagcctgtgccgcccaaatccggtgatccaaaatcgtttccccctctccctcccattttcaagttgtttcgaacaattctcttcaatccctcatcatttcccccaaaatcgcgcggccgtctccggccaaatccacgccgccgccgccgccgccgccgccgccgccgaggacgacgcagcggtgccctcgtttcggcctcccgtatcgccctccgtcgagccgagccaccgagactggtgagtgaactcgaggccgtaggcgttactgctggttgatcgtgccaaccctaattctgacgccgatcaatctctccccgtttgattcccctgcaggctgcgtggtatcgtcctcacgaggagcggcaatccgaaggagcgcctcctcccgatgaagaccatatgcggatccctcatgcacgagctccaggtgcgcctcgctgtcgactgatctgctgttgccgcgatggcggtgacaggttttgttggtctctcgctgattcagatcgctcgtggttgcaggtcatctgggacgaggtcggggagcccgaggccgcgagggacaggatgctgctggagctcgagcaggagtgcctggaggtgtacaggaggaaggtggaccaggcgaaccgctcccgcgcccagctgcggcaggcgatcgctcaatatgaagctgaactcgccgccatctgctccgccattggcgagacgacggtccacgtcaggcaggtctgtcacttttgcttctgttttctgtcgtttaagagcttatgttttgatggttgatacgatttactgtgttatggtactataatggtttggggcgcatcagaatttagccgtttctccgattcaaaaacactacccacaattgtattgtgatattatcgaattattattaggctatgaattcatatgttcttcgtatactacctttcgcctgtattcaagcatggtaacttcatcattttccgttagcatattttccgaactggtaaccagtgtgtgttttgcaaaaactttttgcataaaaatttattctaaaaaacaaataaacccaatttttgagtttataataattaattcttaattaatcatgcactaatgacttatattgttgtgcatgccacggagttgccacacccaatagccggaaggagcacaaccctctagattatatcccatctagtactggttgctatatcttgagacggaggtagtatatgattacagtcacagatgggctcatttaatgtgtattatttagttatccaacttgaaaggtagaagtatgctgtagcgaaataggatctaccagtaaggcagtaattagttctttgtttttgattgttttatcagtctaatcagaaagcatgtggattacgggatgagctcggtgcaatattcccatacctagaagagatgaagaggaagaaggttgaaagatggaaccagtttcttgatgtcgtaggaaggataaagaagatctcatctgagataaggccagcaaattttgacccttttaaagtgtctgtggatcaatctgatctatcattaagaaagcttgaagagttaagggtggagctgaagtcccttgaaaaggagaaggttcttcttgaagcttttagctctatgtattatttgaattccttttcaatttctattttctaatgtattctgattcagttattaaatttctgaattctgatagggtgagagggtaaagcaagttatggaatatttgaagactttacattctttatgtgtagtacttggtgtcgacttcaagaaaacaatatctgaaatacaccctagtcttgatgaagctgaagggccaaggaatataagcaacactacaattgagatgctagcatgggcgattcagagacttcgtgaaacaaaaatgcagaggatgcagaaggtctgcatcttactatttcaattcagggaatggccaaatggtatatatctgctttcaactaactgtattagctctgccagcttcaagatcttgcatctaccttgctagaactatggaatctaatggatacgccatttgaagagcagcaggcataccagaatataacatgtaatattgctgcttcagaggctgaattaacagaacagaacaccctttccattgagttcctcaactatgtgagttaatgatcttttggagaacttgctttcgtgagtcttgtggttgtcattttctgttttctactgagataatgatactagagtcagaggacatgatattctttgatccaggtggaagctgaggtattaaggcttgaacagcacaaagcaagcaaaatgaaggagcttgttctcaagaagaaaacagaactagaagaacatcgacgacgggcacatttagttggagaggaaggttatgcaactcagttcacaattgaggccattgaagcaggtaatatgttatggaatgattccctgggtgtgttcgcttttcctagatcccaaccggatccctctgcacggaaaatggagtggttcattagcgcgtgattaattaagtattagctattttttttaaaaaaatggattaatttgattttttaagcaactttcatatagaacctttttttttgcaaaaaacgtaccgtttagcagtttgaaaaacttgcgcgcggaaaacgagagagagaggagttgggaaaaggggcatccgaacacacccttagatttctgtgcaagttcttgaaggtagtttcagttaattgatcctcctacctcctttgctcatgcattccgttgagaggatgtgtcatgtgtgttaagctgttaatgctgtttatttagtaaaatgttttattgcccaaaatatgtcttcactctttccatttcaggggctattgatccctctttgttgctcgagcaaattgaggcttatatttcaacagtgaaagaggaagcttttagcaggaaggacattctcgagcgagttgagaagtggctaaatgcacgtgaggaagaggcttggttggaagattacaacaaagtactgtcctatcagaacaatttatatgaaaagattttttttccgcacctgctgctgattgcggtgtccgcatgacatgatcaggatgacaaccggtataatgctgggagaggtgcacacattatgcttaagagggctgaaaaagcgcgtgttctggttagcaagattccaggtgacaatcaattattaaacacaatgttatgctttcattcttaatttcttatcatttctgctcctgatttgctgctattgtgttgtggacaggaatggtagatgttcttgaaacaaaaaccagagcttgggaaactgaaagaggcaatgagttcacatatgatggcgtatatttctctattcatgccgtttattttatgtattatttacaaagccagttttgagaattgccaaaactcgtgtcgtacaatgtttgcaggtccgacttatattgatgcttgaagaatacatggttgttcgtcaagagaaagagcaggaaaggaagaggcaaagggtactagctgtatcctaatttgtgtgcttttgttaccatcttcttacgtggtaacgtgggtgagatctgaaatctgagtaattgtaggatcaaaagaagcttcaagatcaacgcaaagctgagcaggaggcactttatggatcaaagccaagctcttcaaaatctcacagcactaagaaggtacccagaaactccacacctggagttcaacctcctaaatcagagatacttcattcaaagactattcgtgcaaccaagaaaacggaagatatcaacactccttcccctggtaacttcgacttaaatatatctgaagcaatatttctaaatttttacttagtatgtagtacgatctgactatctctgatctcaaaaataaactcaggtcataaaggtttagacactgttggtctccctatcaggaagttatttccatcttccaactcgagcactcttcttgagatggagacaccccggaagcccttctctcagattacacctggaaacatatcctcagctcctgtgcgtccaatctccactggtggtactgaagagaacaggactcccaagacatttgcaccagttcctacgactccgatgacagtgagccctcatatgcaaatggcagtgacgcctgttcttaccgcaaaagctgtttctgtactctcttatgacgaaccggagctgacttcacaagaggacaccgagtactcatttgaagagaagcgtcttgcagtctatcttgccgcacaagtggcttgactgtcaaggatgctgatacatccgttgtgtagctgaaagtctgaacctttgatagcatttctcatgttacagagacttgtgtaggtcgacagcagtcggccttattcataaccatactttacgttttcatcccattgttaaagtagttaccttgttactgctggcacttgtcacctgatgatgtgaaccattacctttcttcgctatgttgatggttatcattaggtggctgagacaatgaattgaactggcaggtgcagccgtgcaggtgatgtggtttgttatttggaaaagaggtttttaccgttgtggtaagaaagctaagatgcggccggtgaactagagtttcacaaagcaaccaggtaacttcccttggagttcagtcaataatcatttcaagtaaatgaaaggcaggccagttcctggtgatgcactgatgctgatatttgcatcgcgttcagatgacacacttcatgtctgaaagcaataggaaagctagacagataatttatggctataatacaagcagctgtcaatttgttcatatcgtaattcacctggattttcctgcaaaagaggtcagggatccgggacattggtttgcaagtcagaatactataaacctgaaattccgtataggccaaaagttgagctaaaatttgtcttcgagttaaaggcttaaatgagtactctttgctaacctctttcattttctgcgcatatatttcttaaattgttaaatactgtattttttaaaaaaattctaaaaaaacatatcaatctattttttttaaaaaaattaactaacattagaaaaatcatattaattatttttttagaaatatattaactaacattgaattaatcatgtgttaatcccctgcttcgttttatgtgccgggaagagttccctgcgcacctttggatggaaataaacgcaagcttagctgttaaaacttccctgaaatttcactctaaaaaatacttccctgaaattcctttgttcatcctcaaataaacaatacattgttcaatgttatagagattctcagaaagaagtatttgaacaatgctagtttctttagcagttctgctatgggaggctctcaattttggaaagggctgcatcattgcaagacttgggttgaaagacttgtggagaaacatgttcataagggaaatcatgtatttttctggaaagatgtgtggtgtggtgatattcctctcaaaattaggttccctgacctttttgagatcagctaccagtaaggggctcttgtgagtgaagtgttcaatgggagagactgggatctagaatttagaagaaatctgaactctcaaagagaaactgaacttgcccaattgaagcaactcattcaggggttttgtttggatgaaggagatgaccaaattgtctggcctcataataagaaaaaaagttttttctactaaatctatgtataggatcttgacttttgggggtataagggatgcagacttatgggagatttggaaatgcaagctccctctcaagatcaagcatttcctttttctggttgggaaagggaggttaccttgtgctgaacaactagttaagaggtactggaaggggggtgataaattctgtaaattgtgtggtaatgttgaaactaccagccatgttctcttctgttgccctttggcagtttttgcttggtgtgttatcaaagaggccctgaatattcagtttcatcctgccaatttctgggattgggttaggatttgggataaaaagaaagaacatagactctggattttcctgttagggtgtatctgttgggctctctggataattaggaatgattgggtgtttgaaaataatttggtttcctctcctctgcaaactgtttacaaagctttgtcttttgcacagaaatggggcattctgctaggaaaggaggaacaagcagtgctgggtgattggtgtgaggcgatcctgaagaagcttaatcatcttagaatcagagatttacctgcatccctgtagttccaattttagccagtgggtgcggttttgatgttgatggctgtctgatgtttttgctgtgccgaatgtctgtaagctagaatttccaaccagtttagtttcctttaagatgtaaaagactctgtttggtgttttgggctttctccaaaagctgggtcaatatatttgatctgatttcaaaaaaaaaaaaataaacaatacattttgttcgtgactaacatggagcatatactaataaacaagcagataccacacaataattccttatttccaagtgcagaaacatcatttaaaggcacatcgttgactaacctcaagtcaactatccctgaacagatcacacttctgttccaaatgacggtgcagcatctatatattttttttaccaaacagctttcacaaagctaacatgcgtagaaaagtcactggtcgtttgccatctggttgcagtgatctaacaccacacaaaaccacattagggttcgtcgctcgagaacgtgatttgtgattccacagtccacacggccacacagcgtgtgctagctcagcctgaattattcattattcctttcacgccatcgccgtcacttcactcctgcaggttctgggcagcttcgccggcgatgttcttgagccaaaggatcaatgtcagctaagggtgtgcttagttcacgttaaaattgaaagtttggttgaaattgaaacgatgtgatggaaaaattaaaagtttatgtgtatagaaaagttttgatgcgatagaaaagttgaaagtttgaagaaaaaatttggaactaaactcggcctaatactacgaaaagttcgtcctgtttcccaggtcaacctgcacttatccttttctcaaactgatgatcaaatcaaactaagtactgtttatttcgcaagaagacccgctctgtcagttcattggttcaggcttcttctggatctcccaggcgccataaactagttttacgcttaattagtgaagactttgcttggtagaactggtcatattggatcgactgatctcatttttatacccagtcgattaattatttatccaggttgatagtttggtaggtttcagcgaacttacacggggttttacctcatcttggtaggtagatgatgatcccgtgtcagtgatgcactaattaattggatatgcgctaattgagcaaggcaactttgggaggacaggtggccatggttgaaaagcaaaaaaaaaacatcttgtgttcactgtctctctctagctattagtagatcagtaaagtaacaaaggaaagggcatctagctttaaccggaaatggttaagaacactgaacacggagtagacacctcaaagcaccaaccaagctgttgttgatagagcagtacactgggcgccaccactgcacacacatatatccatcacctaacactctctccatcttagcgactaacagattgtaaactagtggcagcagcagtaggtaaatgggctaatggcagcagcgagcactggaagtctggacacacgtttaaattgtggagtaaaaggccagcgttgagatgtcgactgaccagccgaactcttgatgatagagcagtccacagaaaatgacctccaactccaataaaaacaagagatagaaggtagagtactcctactctcccagcccaacagaagactaatcaaagatgaaatgtcgacgaccggactcgtgccggccaaacaaaattggaacgttctgaactaaaaacattactaaaaacaaaagtggaactgatcagctagcttgtgtccctatggagcgcaacccaggacatcatgctaaaccaaaatgagtcggatcacatcgtctggaagctctcgaatcatggagaatactcggcctcttcggcatacaaggctcagtgtctaggaacagtcggcaccaacttcaatcccctaatttggaaatcttgggcccctgcaaaatgcaaattttatgcgtggcttgtgattcaaaatagagtctggacttccgatcgactagctgcaagaggatggccaaatagtggagtgtgcccctatgccgtatgacgaacgagacggcatgccaccttttagcttcctgtagatacaccagaaggatctggagactgacggccaactgggtggcttatcagcaattggatccgagcaattgggagccatgccaaagcgtacacgaatggtgggaaatgctagccaacaaaagggaagtgtccaagaaagggctgcgatccttaatcctactcatagactgggaaatttggaaagaaaggaaccaaaggatcttcgagcacaaggaaacggcggcccccaatcttatggcaaaaataaaggaagaggcaagaacctggatgatggcaggcgcaagacgacttggagaattcctaccaacttaatcatagcgcttatgtaattttgtacagctcttttttttgtccttaggggttgtatatttttacgcctatatctaatgaaatagcacggtctcgtgctgattcctttcaaaaaaaaacattactaagagtatatattgacacaatgtttaacaaatgataccggttagtgcttcggtactctctccgtttcaaaaattaactaacctaatgcatatattttttaatttagttcagattcatagtaataaaatatatcacattctatactaatttgttatttttaaaggactgggagtgaaaacggtcggaattcggaaatgataagaatcgttagcatctcttcaaaaatgatgctcaattgcatggtaattgatcatatttatcagctaaactactcactgccgacattaatacgatacagaaagaaattagaaaaataaaatttatatatagaaaaaaaagatacggtcaaaaacggtaccccttataaaaaaggagctcggtcgatcaggaatttccatgatcgttttcatccctcagtggttatcgcctagatttgcatacgcaccacaccactcggtgtacgtagtttatacatgtgcaatttacttgcacgaataggtgcagggggtgtaagtgggttagccacgaactcccttatagatcaaagtaaatgggtttacagcttattttagtctataagtggattttgtgggttagccccttacattacgtgcagccccccagcggccctcgcgagctgggtggagaaggataaagccacctctcggaatggtaatggaacggaaccactttctccgactccaacccaagccacggcaaacccaaaagccaccaccgcgttcgcggctcagccagctctcgccgccacggcaattcaccgcacccgcccgcgctatcatcccacgccacacacacgcgcttacggacgaacacacccgcgccacacgatccatcgccaacccaacaaaccactctcccggtggtctcctctcctctcgcttcccatcaccgtcaccttcccccacacgcgttcccaagcccgcgcgcctcctatataatccgcgg

SEQ ID NO: 16582 - DNA, 16138 bp, Oryza sativa
  unsure (1)..(16138): unsure at all n locations
cagcgagcgctcacggaggccgacattggagaccatccaagaggagaactacatgtcgacaaactaaaattatcaagaaatagccagcagctcacctttttttaattttctcttttatgtgcgatattgtttctattatcttttctgagatctgaattggaaaagatatgtaatgaaacagagaaagatgttcagtcaatttttgtaaagaaatcaagaacacgtagatcaggattgtctttttttaaaaaaatgattgggtgcaagcacaagcgagttatccattttactgcttatttgcatgcatcccaaattggaacactgtataaaagcttttgagaaaaatgaatggactgtgaatataattgagcatcacaataaaagatttattttttatttttatcttttgctcttcaatcttgatttgattttttagtggtacgatagatagagtttgtaccatttctgtctattttaaatatttttaatgatgatttactaaaatctgatcccaacatttgaaaagagtgcaatattgcactttaaagtgtggcaatagttctcatgtgcaagaaaaagaaaaaaaacacacaataatgtttcttacagaagtactgttcgtctatctctgttatgtaaatttataaaccaaacatcagttttgattagagttcttttttaagaaaatatatattcatgattattgaaacgaaactaagttttatataaaaaaaactatattgtactaaattaattagagtcttagaccactttattttagttattattaagtttatttcaaaaataaataattcacggtagtagttcgctcaataatatataatcgaatagggccgagaagatggcatattgtactgtcgggaaagagaaaatgaaacctaccgatcgttgctcgttgcttacaagtttagtacgaactacgaaaaggacattcgaaaaacggtgtgaatacttcaaataacagcctagtaggaaactgtgttgttttttcagcttaggaagaaaagcatcgatgtgtcgatttcgcagactttctttccaacgtaaaaacaacttctttgtcctatatatattttttattttttattgtaattattgaactgctgccgcgttttcgtttaccctatacctagaccaggtgattataaaattcagacaattcgatcagcagtacggagtaacataaaagccatttgctgtctaatttgatatatgaatgagcatttctttgtagaaaaaaaatgtagtgcgcctgaaaacagggcaaggaggtgaagattgatcgatgaaagcaaaggaggggtgatcaaacaggtacctgaagcaacgcagacagatggttttctctcggcggacagaatgtctcgtgtacaaggcgaagaaaagcattcttgtccgcacgaaataggcaaaaaaaaccccggcattaatcagcacgaaatcggcaagcaaaccgcgcgatggtcaacccccaccctcgtgctgatccggggtcgtcgtagcagctacgctacgtgcataccttggctcttctacgttttaccgctgaggcgcaaaaacgtgtcgcgaaattttcacgctgcgccgaaccgtgtttcgactcggagtcggcggctagtcagccgcgctcgtgcacggccaggccacggggcgagttggatttcgtctaggtacgtgcgtggcccgtgtgccggtctgcgtggctatgcgcctatgcggtacgcatcgctgcacgggccgcgtgcagcaggtttcgagtcagaagcctgcacgcgcgtcgcggacgagcagtacgcacgccgacgacgcgcggggattatcccgtgcgtgcgtagcgtagggtgcgcacgatttcgcggcctccatccgcagcagatgaacgggccgggggcactcgcgctggcagatttgcggggagcgcgtcgcgcgcggttttgtgaattttttttatttatacttttttttattaaaatatttacaaaaataatttgttgttttgaaaatttacaaatctaatcgcctgccgccctttccacagggcggcaagggacctaaatgtaaattttccagcataacttgttagctctatgattttacaatttaaaattatattatataaagtcagatgaaataaaactttatatcaaaagtgtagagctcaaggagatctacaattttgtagttaataactttttcatttaagatgtccaaatattcgttacaaaatataaaacacattttaaaaaatctcagatctacatttcaaacgacattggatggagataaactttatataaaagttgtagatcttgatgagatctataactttgtagtttatcacttttccatttaaaatcatttggagtatcgaataagcattattagtttttaagcaattaaaaccggtgggaagggtttgaacacaaataaaaattttgtatttaggtcccttgccgcccttggagagggcgatttttaaaaatcacccttctagagggcggcaggcaattagatttgtaaattttcgaaacaaaaaattatttttgtaaatatttttataaaaaaatgtataaataaaaaaaattcgcggttttgttaggctctcggcccgtgatttttgcgcgggccgtacgtgcggttgtcgtgtctgctttgcaacgaaactcgttaggaataaattcatcggtggttccttaactttgtcgacgaatctgatttccgtcctttaaccgaaaaattaaaccaaatacaacagatcccccaactatcaaaaccggagcagatgagattcctcggcggtttagatggcggttttggctgacgtaaatcctacgtggctaatttgaatcggtcttcatctaacatggcattgacatgacgcttacgtggcaattcgatatggaaaaataataaaacccatgggacccacatgtaagttttacacacaaaataataaaaaatagtggaagccatatgggccccacatatcatcctctttctcccctttatctctatcctctctctcaatctctctgatgggagaggagcagggtgcgtacgtgctcagtctattcttgccaccgacctgctttgtcggccgcccgtcccactcaaccggccggagatagagaggacagagataagaggagagtagtgaggatgatatgtggggctcacgtgggtcacactattttttattattttgtgtgtgaaactaacatgtgggtctcatgggttttattatttttccagattgaattgccacgtaagtaccacgtcaatgctacgtcagatgaagaccgagttaaattagccatgtaggcgccacgtcagtgaaaacctccgagggatctcatctgcaccggtcttaatagctgagggacctgttgtatctagtttttcggttgaagaatgaaaattggatttattgacaagttaaagaaactcgtatgaacttattctaacacgttacagccggtgcagcggccacctcggtgtgacggcccagggcgtttcgggctttcggccccgttagctatctggaagactggaactggaacatgttacgtcaactgcacagttgatagcggctgctcgaggctcgcggacccgtcagtttaattaatcatccgtctgatttgggaatggagaagatactctgacgggatgagatgacaaccgatcgatttttaagggattggatgctccgactaccgtccacgccatagaatctcgcccaccacataatgttacccaacttattgatagatgcttcttctgaaatggattattaatttggaagtttttattttctgtacgtagataatgggattgtcctaaataggagtatttctttaagctcaacaggataatccgattcttgtgctaggcattatgagagtttgtagctctgttaaattcagaaagagaactggttagatagtatagctattgtgttggacatctttatggggaaataaaagtctcttccaaactctgtttgcttggatattgtaaaaaaaaatccattccagcaaaaaattgtgtgtaaacaacgaatatgagcagaactgctcagattcacagcctgaaatttattccttttcaacgaagaaagtatgtagaatatatggtggtgcggaaagacacttggcataacaatcttctctactatgttatagccaatcgcgttaggatgctagtggacgataacattacataactaatggttgttttatactatctttgttttaaaatgtagctacctactatacgattggatacaacctatactacgaatctgaacagggcgcatatctggtttcataatattagaaggcatccaatcaattatactatataactacattttgaaatagaggtagttctatgctatacttcaaatgctagcacctcaagagattagaaagttgcttcgtcagtttgtctcccttgggccatttggtatgctccacagtctacgcgagtaggggtgtaagtggctaaccagcaaaacccacttataggctaaaataagccacaaacccgcttattttgatctataagggcacccacaatggttatctatatgctctctacaagagatccatgtcagcatatttttctacttagaagctattcaatgaagagagagagcaaagctatctactaacttatagatagtctatagagaaaaacgaggcaatgcataagagagatatagataccaatgtagacatactattaaagtgatttactattaatcgagtctattgctgagatgtacatgttttatatagagtgcaccttactttaccattaattgcgggtgctctaagtgggtttgcggctaagcacacttccacccctacacacgaggctttgcatgacgacactagcttgcaactgatcgcgtgagataagatcactgcaaagatgacaagacggctctgctttggctggcgggaaactacaagtcagaggacatccgaccaatgctttggaacttttgaagcagatcagatgcgcgcagatggcgaacgggctccatctgtccgtgacgagtcccgtgtcgctgtccccgtgcgttgtcgccgtgcctccgccctcgcggttccttggtccaaaacatacaggactcggcagtgcggccaatgttgcactctcctgtgccatcctctcccagagtcccagctcgatctgtaatctagactctagagtgtgcactcaccttgccgtttggccattatcggtacaacttgctgattataaaccataatattattattgatacataaaaaaatttataggtgaaacttttatgtatatattcttaaggattaagcatatgtttggtttttaatgaatgaggtgggtcgggttgtgtcaaatccatatttaggatgttgagttggagcagtcccagaaaaataatagtattcttcaaagatctgcgccagcttcacacttaaaaaaatggtggaacaatccactttctctttctcactgacacgtgagccacaccctcccatctaaccctcccatctataaaaaacaagtaggactactcaatccctagtatcaaacggataatgggatcatcctattctaaaagaaaatcaggatcagtacgtacaggacgcttagataaacgaaaatcagggtttatctttttttttatggagggagtacgcttcaatgcggcaacaggatcagtacgtacaggacgctgatcgatctgatctgtgcatgcatcaatgcatgcttctgacttctgagggctcgcctaggcctcagcctcaccaagtttgatccgatccttgcattggaacgataagctcatgcatggtgtccggccgccctcgatctccctgtcgacagcaaacatgtggaggctaaactactacggagtactcctgttcttcttgtaataaacaaacaccgttactttttaatgatgtttgaccatttattctactgaaaagataactattagtttttttcgttacgatatgtcactactagaaaaagcatttttctcaacgtaggggtattattttcgtagtcggacatgacctttgaagccaaacgaccgcctacaaaaatataaatcggggtgaagttagctgtccgcctgcgaaaatagaccacttaagtggcgcctgcgaaaatcattttcgcaggcggaccacttaagcaacgcctgcgaaaatcaattttcgcaggcgcatgttaggtggtccgcttgcaaaaatcgtacctacctgcttatcctctactgccccatacttatcctatcctcacctatcctgtccaccactcatttgcctccccacctctctctctctctctctctcacttagaaaaaatctcctctccacccccacctccgccgccgggctttcttcccacctccgccgcggttggctccatcctcggctccccacctccgccgccggcgacgacgacgaccgcgacgcccctccgcgcgccagcgacaacgacgaccgcgacgccggctcccctcctctccccacgtccgcgcgccgccggccggctccctcctctccaacgtgcatgcgctgtcggctccccacctccgccgccgggcggctccctcctcggngacgacgacgaccgcgacgccggctctacgcgctgatggctcccctcgggcacgacgacgaccttcgcgccgccggctcccctcctctccccacgtgcggcgngggtgactccctcctcgggtccccacctccgctgccggcgacgacgacgaccgcgacgccgcctccgtgcgccggcgacgatgacaaccgcgacgccggctcccctcctcttcccacgttcgcgcgccgccgggtggctccctcctctccaatgttcacgcgccgtcggctccctacctccgccaccggccgggtccctcctcggcgactacgacgaccgcgcgccgccagctcccctccctctccccatgtccgcgcgccggcagctccctcctctcccacgtccacgacgagcgacgacgacgacgacggcgccgacgcagcagctcggctcctccctggccggcggcttccgtggtgaggccggcggcagcgcccgtgtttttttttattttttttgagatgattttcgcaggcgggccacaggtccgcttgcaaaaatggtctattttcacagtcgatgtgatagcggcggtcctcctccccgcctgcgaaaatggttttgggccgcctgcgaaaatcctttttctagtagtgtgtttcacaattaaagaaacttttaccatatgtactttaatttttaataaaatgaatggtcagaagagttaacggtaccatttattaaaagatggatatagtactatcttaaatgggggatgtctttcagctgatacaaattgaagtttggatacgtggaacttgcacaataactatgcgaatgattctgttgtaaaaaatattccagtacgttttaggctagatcaagtactacgttaggttaaactggtttttctctaaccaacacaagtttcataaaattaaagtttgtattaaaaaaactgtacaaatgattctctttttgaaaaatatttttgtaagctttttttttcttctctctctatctctaaactatcatatagccacttggccagcaaagctagctgtaagttatactatccacatgttattcagagatgatataccagatatacattttcttcccttttacccattttctttttttctttgacttgtttatttatcctttctatatataattgagcgtgtataaagttttcttttatatgaaaaagcaatagagttataatggtgaagtcattgacacaaaacactatatgctattatttgaatcctgttgcctacaattatatacacacaagtgccctttcattaaaaatataggtcatgtttagtggagcttaaaattctgagaattagctagttgatagccagcttatgagaatctaaaaaagctgggtttccagcttctggcttctattttgttttctggattctacaaatacaacttctcataattttgaccaaaagctatactgtttggggcagcttctgattctgggagaagttgcagcagctagaagctccccaaacaggcccatagtagggttcaccaatttaccctagattcttcgtatatggagctttgtgttaaagagtcatgttatatgtgtacatatgtgatgatgatccgtgtgtgtatatatatcttccatataatcggaaaaaataagttttatgttacctactcccccgttccaaaatataatcattttttatttcaacacagtcttcaagatgctacttaatttgaccaacaacatctataaaaataatatgttttcaataaaatgttttacatattattatagtttgtttaatgataaatctagtaacatcaattttacatgatttgattttttaaaaatattttactattaatagtcaaagttaaaaagatttgtcttaccactattctaaaaatgattatatcttgggaaggagggagtaagagctaacacctctttttttccttgggctgcatgcataaaagaataataaacttaaggtatagttaggaactgaggacttcgtgattatatatgtgcgtggaaaactctcctcgatctgcatgtataaaaataagataaaacagaaatctaccatatacgtaacacacatttacgtgctcgcgaagagcaccgattgtttttggtgcgagtgtgcgttgaaagagaaatgattcacgatgatttaaatatttgttttcgcgctattgattggacatccgcaaggtacttattgttgtccacgtggtcgataatcacgctcagcacagtggcagagctggacagaaaatcaaagggggacagctggcttttggcagtttaaaaaattagcaatttctctttttttttcatgcattggtaatacataaaagcgaatagtttgcaaaagtcgacgacaaagatcagctacagacgtcagattttaaaatttaggattagtgggtacatcaagttcatagtgacgtacggagtaattgacatctcaaattggctctctcttgttctaaaaaatcatcaggatagaactttgaagctagagagcacactttatcaatgttgaatgaactgaataaatcacttggatccaaagatgtacacaaagtgagaagctctgttgtttgttcactgaatctgctatgatatatgggggtaataaaaaaatttgtttttattgggaggggccatggcccctgccagccccccctcagttccaccactgactcagcatgaactgcatactccctccgtaatcataaagaaagttgtttagaataatatttaagtcaaacattgatataaatcataaataactcttgtcagggttatggataccacatacctaatagtagttgactaaatctcggcaggacccaccacataccatgtcttatatggaagcaacctgcagatataggaggagttccggataaggaaagacaaccagtgttctacatggaaacgacaaggactactcggattgtattcatattggtttccctagttctacttggacaaggggacacctatgggtataaatacaaggccccctaggaggagaggggacaataaacactcaccatagacgacacggaacaatagatcaagacagaagatcaacatacaagccaacatacgccaagacaagacgctggatatcgacatcagagatatgcctggatcggccctatccagtacctacagaggccggccgtagggatttagcgctgtctctgatatcgtcgggcacgaactcgaggaggaagactacccgttgttgactacgagttagaccttcagaccgccatatcgacaacagttagataggctatcccaaatattgtactggtgtaattatggtgaataagagcaataccggtttcggccaacaggatgtagggttattacctgacaattcaggggcccgaacctgtataaaaatctctgtctccatctcttttacctcagtctcgtatataccctagtaccaacgatccccatactatgcaaataccggaatcgcgacatcaaacgtcgacatctcttaagtattgagtttaaaaatgtaaaaaatatatgaatagacttgtcttgaaaaatactttcataaaagtatacatatatcacttttcaataaatatttttatgaaaataagaagttaaagttgtattttggagaccatgtcgctgtcctaattaaacgacttataaaacatggtagttgatacgtactcatcaactatagagaaatgcgacatgcatttgtgtagactaattatttggataataagattgtcgaaagtaaatcaggaaattaatgtcactgatgtaacactgatgtaacttgagttggcctagatacagattaattattaatgtatcggatgttttttttaatatgtaggagatggttttatgttttttttataaatttaatcaaactaaaaaacgttttatttaagacaaactttgtttaatttatgttgaaaattgtgttgcggttttttctataaatttattcaaacttgaaaacgttcaacgtggagataaaccttaaatattttacattttattttaaaatggagagagagtagcctacaaacaatatgatagattaaatgcgcatgattctcgcaaaggaaaactgttgtttattgaaaaacaatgctccgatccagtacactcacgtggaaaattcggcaagaacagtggcactgaggcagtgttacaactaacgtgttgcatgcatgcaagacaaccaccggcctattaaccgtccggagcagggaccggccggccgggcggaagcatatgaatttgaagaatatgtacaaattcaaacttaaaaattactatatttgtttcgacaggtttttaatagtatttggccgtatttgagataacttaagattctgaaaaataactgatgagaatcttaaaaaaatggtttcccagcttctagtttttgattcattttttaaactctacaattacatattcttaaaatctaggagaaaaatattgtttggaggagtttctaaccggagaagctgcagtgtcagaaactctcctaaacaagccctttaattaattaactatcttggcaactcctaaaattttaaattatggcttaattttttatatgataaattggcaagcgattaaacaaatccaataattcgacgacgccggtatttcaaacactgttgcaagtgtgggcacagtgcgccgctattcacacagagatgcctctttccctatatatatatatcgaccgaacgcaaagaagcagctgaactagcaagtaaacctgcggtgtttccaacacaacaaacgctacaacccttgtaggtttcagaggaaaacacacgacacgagccggaggcaacaaggcgctcaggtccatggagcctcacgtcctcctcgtgtccttccctatgcagggccacgtcaacccgctcctccgcctcggccgccgcctcgccgccacgggcctcctcgtcaccttcaccaccgtccgcctcgccgccggcggcggccgcctccgcgacgtgccggaggacggcgcgtgcgccgacgtcgggctcggccgcctgcgcttcgagtacctgcgcgacgacgacgacgacggcgacgagcggtgccagcagctggcgcccaacgacgtgctgtcgcacgtcacggccgtggggccatcggcgctcgccgagttcatcgacggccaggccgacgccggccggccggtgacgttcgtcgtgaacaacatcttcgtgccgtgggcgctcgacgtcgccgccgggatgggcatcccgtgcgccatgctgtggatccagccgtgctccgtgctgtcgatatactaccacttttacgagtcgcccgaggcgttccctaccgccgccgaccccgacgtgccggtcgagctccccggcttgccggtgatggccatggtcgagctgcctttcatggttcgtcccgagtacgcgcagtgcctgtggggcgacacgctccgggcgcaggtcggggcgatcaagaggacggtgtcctgggtgctcgtcaactcgttctacgagctcgagcgctcggccgtcgacgcgctccgcgcgcacacgacggtcaagctcgcgcccatcggccctctcctggagcatggccatgacaacggcggcggcgacgacggcgcgccggcgccggcgctaggggccgaggacaacgaccgctgcgtggcgtggctcgacgcgcagccgccgcgctccgtggtgtacgtggcgttcggcagcctcgtgaacatcggccgcgacgagacggcggcggtggcggaggggctcgtcgccaccggcaggccgttcctgtgggtggtgcgcgacgacagccgcgacctcgtgccggaggccgtcctcgcggcgtgccgcggcgacaaggccggcaagatcacggcgtggtgcccgcaggggcgcgtgctcgcccacggcgccgtcggctgcttcgtgacgcactgcgggtggaactccatcatggaggcgctcgccgcgggcgtgccggtggtcgggtacccgtggtggtccgaccagttcgcgaacgccaagttcttggtggaggactacaaggtcggcgtccggctaccggcgccggtgaccggcggcgagctccgagcgtgcgtcgaccgcgtgatgagcgggccggaggcggcggtgatccggaagagggcgatgcattggaagcgagaagcggcggcggcggttgccgacggcggttcgtcggatcggagcctccaggattttgtcgaccatgtacgacgttccaaaggaccggaggagctagctcgattagctcaagacatccagattatgaatgggccggtcaatccggtcctagtttaataaatctagcacagcccatgtacggtcatgtgggggctatgacgctatgtagtgtgttaatctatctactccattaagttgctgtcgagtctaatccttgttatcataggattccaaggcttacataaaaaaacggtgtaaaaaatgtaagtttgaagtttgaacactccaagtcaaacacgattacatcgtattatacgaattcaatttcgtaaatcacaacagatcatataaaaattgggaggtcgctgtaccacaagatcgcgtccggtgagatgacaccaagcagattttgagacctatcgatatcagaacttgtaccttattggtaccgctagatatccgacaggtactaactgatgcccattggtacccgctaatacctatcgatactaagaagatactcaatacgagacttgggtacccccatcagtatcaattgttacctcaatactagcgcgaggcttcttgatggcacgacgaaggagcgtgtatcccttcactggcaagcctccttctctcccccccttcttcggcaactcataatgtcagagaggacaaagcttgagacaaaacaaaccatggcagaaagaataaggagacgatgtgtagcctacctctgatcttcttgctgatgtcaatgtagatacacacacagtgtgcaggacgatgacgcaccggtaggatgcggagagctccttgagaagcgccgcgagtgggatatggcttgcatcatagtccattcgaagctattggtgctaggtgctagctggaccatattcggggacacaaccaacttcaccacgcggagcaagtcacggaactagatatagttggccaaaaagcctgaaacccgatggcccggcccacggcatggagatttggcccaacccaagcgcggcacggcccgcctattgggtcgtgcctgggcctcttccttggcacgacgtgctggccttgcatggcccggtccaataagagggaggcaaaatagacttattccaaccatataagcgtaactcaaagagatgagggatgcaaaatagacttgcttgaaccatataagacacggtccaaagagatagggtgggggggggggcaaatagacttattacaaggtggagcatagtgagcttgtcgtgccttcagaccgacccggcacgtttcgagtcttattgagccgtgccttagccgttggtgtagcccgtggcccgtgggcgggcacaacacgactaggcgtgtcggttggacagtgcctgctagactgatctcaggccgtgcctggtcatgcctgggccgagcggtacatttgaccatctatagaattagatctccgcatcgcggagctgctcacaagggttgtggtgccgctggaagagagctctaccttgagctcgagcctaggagagaggaggagggatgtatgagagaagagggcgagcagctaggtataggtagctcgtgcagtggtgcaagagttcaagctcaagttttcgctgttagatccggcaacaatataggatggtttggactcaacatcaataggaggttaaacgacgtgcacggtacaaccatccgcccatgcacctcttcctcctccgatgccactctagatccctagctcccgcccatccggttgccgacgtccacctccaaaggcagtggggcagcaacggcggctgcaagccccggctctagctccgactcggtgtcctgctctaccttcgccaacatgtgcgcgtctatgctgcgcgtgcgaacgatcgacacaatgggtaaggggagtgggtgatcccgtgccgatgccgtggacgggataccgtcccctaatattcaggataatttttttgaaataatatggacttaacagttataaaacatatatgataaactagcccatgcgaatatgcacagcgcctttatatagtacttgaatatataatgtgatgtataacaggagttacgtataatttgacacggttacatgctgaacatggagtacaaattgatgatcagggtccatctggatcgtgcagacgcggacgccgatactaattatttctcgagaacttgaacgctgcgagagagcaaattgtcctacttcttgcacaccaccccgacgccgtcgaggccggtggagcacttgacgtcgaccagctcctcggaggcaacggcaacggcgccggcatcgccggcgcgcccgaaccgagcgacggcgcagtcagcggcgaaaagacccgacgaggtgaactgcttctcgcctcccatgacgggcatcttcgcggacacgtcgagccggttcacgtagctgctcctgtacgtctggcccagcacgccatggacgtcgtcggtgagggcgtagaacttgaacgccaggtcgaggtgggcgaggcagtcatcgtcggtgaccccgtacctgtggatcctcgagtcctccttggtgatgggcaccacgttcgcggtgatcttgaacacgccgtcgagctcgacgaggacgccgttggccgccttggtccgcgtcacggacaggccggaacccgactcccacctggcgtgcgcgacgcgctgcagctgcacggtctcgccgtcgaagacgacggcgaggcggtcggagtcgtcgtcccacacggccgtcctgcgcgcgccgacgtagaggcggtggccgccggagaactgcacggcgatcgcctgcacccaggtcgggtccctcttgaggcccgggacgtggttgccgatgaagtggccgttgatgtgcaggtttgcgtcggagagcaggcagaagtcgcggtctcggcggccgtggaagtagaacgtgttgccgtcgccgccgatgaaccgcgggtcctggcacaccgcgcccggcaggttgcagtctgcaacgcacgtacgcgacacgtacgacacgacacaaaaccattaatcaaccgtgcatgaacactagctagctggttaacgtgcacagatatgcacttaccgcatacggtcttgcaggtggcgcagtccatgtggcaggatttggggcacctgctggggcagtacgccggcgaggtgcacgtggggtacctcgtcgtgttcgtgcagtagaccacgtcgctggccggtggaggaggcgatgacaccggtgggg

SEQ ID NO: 16583 - DNA, 55730 bp, Oryza sativa
tgccattgttaccgttgttcccaccgttaccattgttcggagtcgatgccgacgcgccaccattgccgccgccgccggcggcgagcgcagcgggcaccaggagggcgacggcgaggaggaggaggagagcccatcttgctggccccgccattgctgcgtggatgctggtgtgtgctctgcgctgctctgctgggtgctgcgtggctttgccgatttatagtgcaggatttgcaatacccgcatgcacgatgaagctgagaccggtcaggggattgactctgctgcactcacatgtccaattgcagcatgttcccgtcgccggcaggaatggaaagccacctttgcttggcttcatggcgattagattagaacagctaatcgccaccataattgtgctcttttgatttatggatatgtctggattgtgttttgtctctgagtttctgaaactaagctgctggatgcgtggacagagcaggcacagaagagaataacaaagaatgttcagagcagtgtttgtctgaattttgctgttcttccttgttcatcgatgttggttttacagtgatcttactgctcttgtaaaaaatcgaaattttcacaatgacgactgaaacgaccacgtacatacttgcatgcgttccgttgaaatactcgcataagaacttagttatatcatgagatcgatcgcttcatcgctggtacatgtcttattcaagagaggaaaatcttcagcacgctgtgcatcacgtgcaggctacgaattcacgtcatgccatagaatgttcatatatgcagttgccatcttgttcagtctgcttctgctgtttataactgttcagcagttgacatgattagtaaaatcccttttcttttctgcagccaaaagcccagatattgggcaagcaaactgaagccatggtgtctagccatatagggatggtccagatggcctctatgaatcactcttttatgttggtccaaatggcatagcttcgaggttgctcaagaaccatcaggcaatctgacagatcagattcagtcattcagagatggatgaatcggtggcgcgaagtgcgacagatcagccaattaggggaagcctcgttggcgtgcacgcgtgctcgttgaatttgagcggaaagatagtatagtactcctaccttcatttgtaatcagaacagttttcaaaaacctgcacaagatgcatgcatgcttcagaatgaattcaaaatctgacagatcacttgtttgtaaatcgttgtgacaagcatctggtacaacatgtcttcacttggttgaatattgtcatagatggattggtgatttggtggtagagatacaagataaaagcagagaacacggacgaaatggcaggattttgttggattagaagtgcattgcagtgccagtgcatatggccagatcatagagggtttaactacaaacatgaaacatctatggttgagtcaataaaaacatgcattgatcatgagagattactggtggatgttcagttcttttgtttactgtgcactgagaggctgattctaggaagttcatactaacagatatataccaccagtccaccacataaagcgtatgttattggtgagttgacgacctcactggaatcaatgcggggattttttcatatatttttaccaattgtcacaagtcaaaaatatatgagcaaatgggaataaatacttggagaacagcataaggttgtagtggtaattaaccatacacaacttgatagatgtgagttgaatacgcagcatagactgcagtggtgattaaccatacacaacttgacagaccaaggtggtttttttctctatcggtgatgccacttgtttcttgacatgtcattcaaagctatggaaaaaaattaagaaaattaagggcccgttcagattatagccaaaataaaccttaccaaatttcggcaagatgacaatattgctaaaaaccatcttgctaaaatttgggcaggatttcttatgtatttaccaaatttggcaaaaaattaaacgtagacatttttttgataaatttaccaaaaaatggtatggttgaaaatggcatcaaagtgagcaggccctaacatgggaaaatttatagcacatggttaaatttatacttgttggcatatcacatgttggtctactctataaatttttcaataactagtataatgtccgtgcgttgcaatgactttttttaattgtttaatattttatcattatgctaattttgctatcattttataaagatgaaaatttcataatattctattgtcatattttcatgtcgacatgatctatagcatgtggaggctaagagacaagcaacttacaattcatgggtctcgcatggtagttgcctggtggtggtgaccaccactgccatcttttatattagtatagacaattaagatgagaaaaaaaataattgaagagacgttctctcttgcaggacaaatgtctttcctttcacagataagtattgaatacgcactatagaccgtgtaaaatatccgcgaaaaacatgactgttctctagcagtggtattctcttttgatttaacgataaaattatctatatttatattactttaaaagatagtagttggtacttgtgtaacacatgtcggtacttgtgtatatgtcactaaaaattaactatggtatttatttctttttgttttttatgatgaataatcttgtttcaaccaagtagaatccattttttttaacaaggacttcaattatttgctattttgaataatctgttgcaacagttatttgacaagtaagttgtaactcacgcaaacctaacatgttaacactgcatactacagttgacttatgtatcaaatcgtcgcatttgtcttgatcctaaatttgtccaccaatatttccaaaaagttccaagaaatataattaaagtgaaagctcctaccaaattttgatatagcaaacaagattcctgctctaaatgttaaactcgaaattaggtaaggaaaaaaaaaacaagactagaagtattatttccaaagaactcttatgttcaccctgtttgactctcaaaaagcacaacgtagcataccacccaacccagcaacacatactagagtcagccagccactcagcccaactacagcaactgcatgtgggccctacctccctccaacccgtatggaccccacctgtcagcgacggaaagtctcactttagcatcgttagcttccacgacaagcataaccccacgcccaatcagagcgcgcctctcgaaatcgcatagctatttgcgcgaaaaagcaatttcttattaaagagagggaaaaaaaaaggaaaaatctaaaccccccctctagcctagtcccaccactaggactcaacgagaaggggggcaggtgtccgaagcggatcacggcggcgggagagagatccggtggcccgatccatggctgcggcggcggtggcgcgccgcgtcgtcttggtgctcgtcctcgccgccgcctccctcgccgcggcgccgcgcggggcggccgctcgctcgctcggcggcagggagggccccggggaggtgcgacgccgacgccgccgtcgacctcaacgccaccaacttcgacgccttcctcaaggcctcgctggagccctgggccgtcgtcgagttcttcgcccatgggttcgactctcgcctttgactcgtttttttctccccgattcgtgactgaggcgttagttgtagtacttggtagaatcgataagtggatgagaatcgtggtagtccgatggcgtgagatgcgactgcggggtttcgtcgtcttccccgatgtatggtttatagaatcgaaatgatttactcgtttcgtcgtctgtgagcaagtgaatgccaatataatccacaatttttggggtttcaagcatgtagggttgtgtaggtgttgcaaggtctgattggtgggatggatgcgtgttgttttttttttttttgaacgaatcggcaagctgccaatttcattgaatagagaaggagtaaggatgcgtgttgttcaaaactcgatgagagtaaccaataaatgcttcgctcgtactaccttgaaatgtcatgtgaggatgcgaccctgggagtgttgtccgtgttgtagtactgtgacctgtgaagttgtgagctagaagaaaggtgcagacatgaatgagccccgaagcttggaaatttgttatatgtaggactaaatcggatgtaggccagcagttaattatggaaaatcagtggagcatttactgtaatgatgaaagaggaattgactgggttgtaagtttatcactatatagtttctcagtgttgccacttactcagagtattgcttcgatgcgatatttcttgtgtgatttggggtgtgcggaactttctcaaaagcataagtacggtcatttttgctctatgtaagttccactgttccccacattgggctataaatgccatgccgtttaattctaatttgcagagatcatctctttttgaaattttagcttcatgagattgagttatatttaaatgcttcttttggatgttaacaggaaaaataatacacttatatgagcattgatactgtacctcacatgatttaatggaacttgacgatttgattaatacacatggacctgtttatggggaatcaaggacttgaatgattagcatccttttgttatccttttcactctaatgtccatgttctggtcttccaaatattccatgtcaagttattttgatattatattccattggttaatcattataagtcgtcactattcagaataggttagtccatatgcattagatatgaactatgaagtggcgtatagtttctccagagcctcaagttttcacttactcgagataattttaattggaatgaacttctattggtcatatcggtattcttttttttttcttttgaggctgcctagatggcatttgttttattgttgaattgatgctaattgaaatacgtaccgtgtttgctcaggtgtccagcttgcagaaactacaaggtatgaagcttattgtggtagctgtgtacttaatttaaaaaacagtggtgcacagtgtatttatgaacagcaaattgactcttgctaaattcctttcttacatccagcctcattatgagaagggtgcaaaactattcaatggtcggacgctgcacatccagggttaatactgatggctagggttgattgtgcatcaaaggtatagtagctctggtgaagagtgataactttcgtcagtctcctaaatgtagacaactaaagcacttacaaaagggattaggtttgatggaatggtccagttaaatccttaactggatgatgagattatccacaggagtatatcttcaatcctttgatatctatttttcgttaccaaactgaaagctatattgcaatgaagctttggcacctcttattttgactgattttagcttccatgttttgtcaaaatgtccaataatttggtaatttcaatggagtaatactttatttcttttgattgtttgacagcacaggtgaacatcgatctttgcaatagattctcagttgaccattaccctttcctactttggggtccaccaacaaaatttgcttctgctaagtgggatcccaagcaagagaataatgaaataaagttaattgatgatggaagaacagcagaacgtttactgaagtggataaataatcagatgaaaaggcaagttattatcctagtctttcctgctctacctaaaagttcagtagatatggaaacaggagctacctgtactatgctcatgcctctctctattgactgttacctttttggtttgtttgaccattataggcatgttggtattttattgatgcattgtttatttatggtatctgcagctctttcagtttagaagacaaaaagtacgagaatgaaaatatgcttccaaagaatgcttcggatcctgagcaggttcaattatcagatatttctttgaaacaatttgcttgagatactgctatgtgcactatgtttcaattttctttaacgtttgttgacttaattcgatcttttgttttagattgttcaagcaatttacgatgttgaggaagcaacagctcaagcgttacagataattttggagcgcaaggtgagttaacgatgaaatttcacagcagatgtgatgtttgctcttctttttctgactatggcctaataatgttacttgcaaactgtagacgatcaaaccaaagaatcgtgattcgctcatcagatttttacaaattttggtggctcgtcacccatccaagaggtacgagtgaacctttaaattcctagtagagaaaatgcatataactttctttgtgcatttggttgattctttaggtgccgaaggggatctgctgagctacttattaacttcgatgatcactggtcatcgaatctgtcgttaagttcacaagagggttctaaattgttggaaagtgttgcggaagagaaccactggatctgtggaaaagaggtgccacgtggatattgggtatgttgtctaatgctaggcctagcggttggcaatgaattcttcattaggcattcttttatactaaactagaaaatgcaacttcatatgaatcattcttaattttgattttgagatattctcattaaatgttgcagtaaatccgttatatgaatgatagcattaggagcaagcaacatcttgtatcttttgacatagtttacttcaacagcagcattatttgcatgtagcttctttagtactgagttaatctagtttcattgcagacagaggatccttaaccactgtagaatgtttagtcgacacacgtgatccacatattttagatcccacagcccatatttatttacatatcttgatcttatcacaagtaatatctgtacctagcaatagttattcccttgaattttctcttcttatttctgtgtgccaatgttgcagctgttctgccgcggcagtaaaagtgaaacaagaggatttaggtgacgcctctctctctctgcaaatgcttcgaacatatatctttacagcacctttactgaaaggccataggagttgataaactataacacacatacatctttttttattgtatcagctgtggtctatgggttttgatgcattcactaaccgtccgaattggggatggagagagccagtcaacctttacatcaatatgtgattttattcacaacttcttcatctgtgaggaatgccgcaagcacttttatgaaatgtgttcaaggtttggaaaactaactttgtgttgtaccatcattcaaaaaatatatctacgacatgcctgactgtagccatttacctgtagcgtgtcagcccccttcagaactgctcgtgagctcagtctctggttatggagcacacataacaaagtcaatatgagattgatgaaagaagaaaaggatatgggaactggtgatcccttgtttccgaaggttacctggcctccaaatcagctctgcccatcttgctaccgctcaagcaaggtcaccgatggagctgtggactggaacgaggatgcagtgtatcaattcttggttaactactatggaaagaagcttgtatcatcctacaaggagacctacatggagtctcttcagcaacaagagaagaagatagtttcagaggattcatcgatttctaatgctgcaagcgtcccaattggagctgccctgggtgttgcgattgccagctgtacatttggggcgctggcttgcttctggagggcccagcagaagaacagaaagtactcacaccatttacgctctttaaagaaaatatgattaggaaaaaacattttaggttggtagggtaccattgttaccgcgtgactacgtggaatttcatatcacagagaagtgattaggttctatttgtcaatttttttacaggcaaagaaagaactggaactgaaaaatagcctaccagttgctcaccctgcacttcatcagaggggctcatcaatgaatgtgtatttttctggacggattaaaatcttggtaagtgctccaaacagtgtgggaaaggaaatggtcgggcagtcagttacagatgaaaaactcacagaagtacgatgattaactcaagtgtattttttgtgcaacgatgtgagctttgttgcatcatgtcatagatcaacgtgtaatagtttgacatatagatttcggatgattggtgtatacgttcggatgttactatccatttaacgagtgaaattttgaattcagttcgtagctttctactaacctttatcgttctcagatatttacctgcaattaaatgctttgtgatcgatttatgaagtggagtactagtactactgacgccaaactgtttcacggcccgttgcgtcagcgcctcagcgagtgagcatctgtccgtcgcggcaccgggatagctaattagcggcagccgtggtgtcaaaacacacctcttttaaaagaataactttaatctaaaaaaaaatttgcatgggaaacttttatctgaaaactttggcctcaaaactttaatttcagtttgtagttaagcaatgcaaacctgaacttaagcaagcattggcaacggcgaaagtgcctattttatttctgaatcttctgaatgtgtttgacttcgaatttttagtccaattttagtaggatgatagaaagccatattccgcgcatcctttcttcttttgagaatttttcaaggtgatttcgtgagtcaaattcggaaagatgggagttcggagaacaaaactccgaccctcctgatgaatctgatcaaaggtggcctgtcaacgcaccgtcatctacttccggtgaaaagtcaaagcagtcttcgccttcgcttactcacactcctctcgcgccctatggtaaatttagttactcatccaaaaggctgatgagatgggggaaattgctcgcagttttttccaggagctgtacacgaaggatgagagcatcaggccgacggagcttttaaatatgtttgagccaaagatcacaggagaaatgaatgacaacttaactcgtccattcactgacgaggagattggagatgctctgttccagataggtcctctcaaggcgccaggatcagactgttttccggcccgattttttcagaagaattgggcggtcatgaaaaaggatgtatgtgaagccgttaagaagttcttcgagaatggtgagatgcaggaaggagtgaatgacacagtcattgttatgattccaaagaagaattcggcggaggagatgaaggatttcaaacccataagtctatgtaatgtcgtatataaagtggtcgcaaaatgcttggtcagcaggctccgaccattattgcaggacattatctctgaatctcagagtgcttttgtaccggggcggttgattacggataatgcacttattgcgttgaatgcttccacgccatacataagtgtaccagggagaatcagaatttctgtgcacttaaacttgacctgtcaaagacatatgacagagtagactggggttttttaaatggggtgatgcaaaggatgggttttggagatgtttggaggaagtggataatggcctgtgtgacatctgttcgttacagtgtccggctaaatggtaatatgacagagcctttctgcccaacaagagggttaaggcaaggggatcccctgagcccatatctgtttctattcattgcggatggcttgtccaaaattttagagagaagaaaggtggaaggacttatacagcctttgaaggtctgtcgtgctgccccactgccccaggtgtgagtcaccttctttttgctgatgatagcttgcttttctttaaagctaatattgatcaagcaacaagaataaaggaggctttggatctatttgagagaagcacaggacagttaatcaacccaagtaagtgctcccttctgttctctgaattttgtccacagattgcacaggaggaaattaaaattgtgcttcaagtcgaaagatccagtttcgaggagaaatacttgggcttactgttaaatatgtgatccaaattttgggtccacaatatattcggattagttttctagtagaacttcatatctatcctattaggtgtccttctattatcccctatatatactcttgtaagccatatgggaaggggtgacgttcccattgttattcccctacgtttgtaatcatctaccctatagtgatcattaccggttggcgtccgtggttttttcccgcaagggttttccacgtaaaatttatatcttcgttgtgcatctattttcataacaagtggtatcagagcattggagatcgatctactacagtcccggccaccggcgattttttccgattgaagaaatcgatctaatcgacggcacgcgtcgtcgtgttcgtcgttccgtcgaaattctgttcagcgaaatccaatccaaagcggagtcgacttcgtccttcctgccgtgcgagaatcagagcagcagcagcgcacgcgtcaggagaggaaaagcaagcagagagaaacccttccatctgcagtgcacgttcaccgaggaaaagtagggcagaagccagaagccatcgagataggagcagagcgctcctgtacatgtgaatttttattcacgttgaaattgctacgcgcacacaagcttgtctaccaggaagtttcagatctatactacgtgcacacgagaagtgtaccaggtttcgtgttttttgatagtttaccctaatttcttactagcaaatttcaggattaattcccatggcgagtttgaagtatgatctaccgctcctggaccgagacacaagattctcactttggcaagtgaagatgcgagccgttcttgcacaacaagacctcgatgatgcgctttctggatttgacaagaggacacaggattggtccaacgatgagaagaaaagggatcgtaaggctatgtcatatattcatcttcatctatctaacaatattttgcaggaggtgcttaaggaggagacagccgctgggctgtagttgaagctggaacagatatgcatgactaaggatctgaccagtaagatgcacctaaagcaaaagttatttttgcacaagttgcaagatgatgggtctgtgatggaccatctctccgctttcaaggaaattgttgctgaccttgagtctatggaggtaaagtatgatgaagaggatttaggccttattctattgtgttcattgcctagctcatatgcaaacttcagggatactatactttatagccgtgatactctaactttgaaagaagtttatgatgctttgcatgccaaagaaaagatgaagaagatggtaccctctgaaggttcaaattcacaagcagaaggcttggttgttcggggtaggcaacaggagaagaacacaaacaacaaatcaagagataaaagctcaagtatctaccgtgggagatcaaagtccagaggcaggtataagtcatgcaaatactgcaagagagatggacatgatatctctgagtgttggaagctacaggataaagacaagagaaccagaaaatatataccaaaaggtaagaaagaagaggaaggtaaagccgcagttgttactgatgagaagtctgatgcagaattgcttgttgcttatgctggttgtgcacaaactagtgaccagtggattcttgatactgcatgcacctatcacatgtgcccgaatagggattggtttgccacctatgaagctgttcaaggtggtactgttttgatgggtgatgatacaccatgcgaggttgcaggtattggaacagttcagatcaagatgtttgatggctgtattagaacattattagatgtgcggcatattccaaatttgaagagaagtctcatctctttatgtactcttgatcgcaaagggtacaaatattccggtggagacggaattttgaaggtaactaaaggctctcttgttgtgatgaaagctgatattaaatatgccaacctgtaccatctgcgaggtacaactatattaggtaatgttgcagcagtttctgattcgttatctaattccgatgctactaatctttggcatatgcgtcttgggcatatgagtgaaattggtttggcagaattgagcaagcgaggattgctagatggacaaagcatcgggaagcttaaattttgtgagcattgcatctttggcaagcataagagggtgaagttcaacacatctacacatactactgaaggtattcttgattatgtgcattctgatttatgggggcctgctcgtaagacatcttttggaggtgctcgttacatgatgactatcgttgatgattattcgcgaaaagtttggccttatttcttgaagcacaaatatcaagcttttgatgtgtttaaagagtggaaaactatggttgaaagacaaactgaaaggaaggtgaaaatccttcgtactgacaatgggatggagttatgttctaagatatttaaatcatattgcaagtctgaaggcattgtgcgtcactacaccgttcctcacacacctcaacaaaacggcgtagcagagcgtatgaacaggacaattatatcaaaggcccgttgtatgttgtctaatgcaagtttgcctaaacagttttgggcggaagccgtttccactgcttgttatcttataaatcgatcacctagctatgccattgataagaagactccaattgaggtatggtctggttccccagcaaattattcagacttaagagtatttggttgtactgcttatgctcatgttgataatggtaaattggagcctagagttattaagtgcatttttcttggttatctgtctggtgtaaaaggctataagttatggtgtcctgaaactaaaaaggttgtgattagtagaaacgttgtcttccatgaatcaattatgttacatgacaaaccttctactaatgttcctgttgagagtcaggagaaagtaagtgtgcaggtggagcacttgatcagttcagggcatgcaccagaaaaagaagatgttgctattaatcaagatgcacctgttattgaagattcagattcttctattgttcagcagtctccaaaacgttctattgcaaaagataggcccaaaagaaatactaaacctcctcgaagatatattgaagaagcgaacatagttgcttatgctttgagtgtggcagaagaaattgaaggtaatgccgaaccttctacatattctgatgctattgtttctgatgattgcaatagatggataactgctatgcatgatgagatggagtcacttgaaaagaatcattcttgggaattggagaagttgccaaaggagaagaaacctatccgttgcaagtggatcttcaaaagaaaggaaggtatgtctccaagtgatgaggcaagatacaaagcaaggctagttgctaaaggttatagccagattccaggtattgatttcaatgatgtcttttcccctgttgtgaagcatagttcaattcgcactctactcagtattgttgcaatgcatgattatgaactagagcaaatggatgttaagactgcatttttacatggggagttagaagaggacatttatatggagcaacctgaaggttttgttgttcctggaaaagagaacctagtctgtaggttgaagaaatctctttatgggttgaagcagtcacctagacagtggtataagagatttgactctttcatgctttctcagaagtttagaagatccaattatgatagctgtgtttatctcaaagttgttgatggttcagctatatatttgcttctttacgtcgatgatatgttgattgctgcaaaagataaatcagagatagcaaagttgaaggcacaattgagtagtgaatttgagatgaaggatttgggtgcagcgaagaaaattctcggtatggaaattactagagaaagacattctggcaagttatatcttagtcagaaatgttatattgaaaaagttcttcatcgtttcaatatgcatgatgcaaaactagtgagtactcttttagctgcacatttcagattatcttcagatttatgtccacagtcagcttacgatattgagtacatgtctagagttccttattcaagtgcagttagttcacttatgtatgcaatggtatgttctcgtcctgacttatcacatgcattaagtgttgtcagtagatacatggctaatcctggcaaagagcattggaaagctgttcaatggattttcagatacctacgtggtacatctagtgcttgtctgcagtttgggagatctagtgatggacttgttggttatgtggattcagattttgctggagatttggataggagaagatcgctcacaggttatgttttcactgttggaggatgtgctgttagttggaaggcaagtttacaagcaactgttgccttatctactactgaagcagagtacatggctatttctgaagcttgtaaagaagttatttggcttagaggtttgtacactgagctttgtggagttacgtcttgcattaatatattttgtgatagtcaaagtgcaatatgccttacaaaggatcagatgttccatgagagaacaaagcacattgatttgagatatcactttattcgaggtgtgattgctgaaggtgatgtcaaggtatgcaagataagtactcatgataacccagttgatatgatgacaaagccagttcctgctactaagtttgagctttgctcaagcttggttggtgttacagtatagtcctagagactatttggcgcgcggtgattttacctacatgaggtatctttggtgattgatgtttttatgctacaagaggaaattcgtctcaaggtggagattgttaaatatgtgatccgaattttgggcccacaatatattcagattagtttcctagtatgacttcatgtctatcctattaggtgtccttctattatcccctatatatactcttgtaagccatatgggaaggggtgacgttcccattgttattcccctacgtttgtaatcatctactctatagtgatcattgccggtcggcgtccgtggttttttcccgcaagggttttccacgtaaaatttgtgtctccgttgtgcatctattttcataacacttaccaatgccggaagggagaatgaaggcagagcaatttcaaccaataaaagaacgatttgcaaagcgactaacatattggagtgaaaggtttctgtctgcggctggaaaagaagccttgataaaaagtgtggcccaagccctgccaacatacacaatgggtgtgtttaaaatgccggaaagattttgcgaggagtatgaacagatggtgaggaacttttggtggggacatgataaaggagaacggaaggtacactggattggatgggaaaagttaatgagtcccaaactattcggaggacttggtttccgagacattagatgctttaaccaagccttactagcaaggcaggcatggagactgctcgacaatccagatagtttgtgtgctcgggtgctaaaggcgaagtactatccaaatggatcactaattgatacggccttcccttcaggttcatcaccgacttggaagggcatcgagtatggactagagttactgaagaaaggcttgatttggagaataggagataggcgtcaaattaaaatctggaggagtcaatgggttgcacatggggaaaacccagtgattctgcagaagaaagcttggaatcgtctcaagtatgtacatgagctcatgttgccggaaaccaaaacgtggaatgagcctttaatcagacatatagtccaggaaaatgatgcatctggaattctgaagatcaaaatacctagaagggagatgacggactttccagcatggcaccttgagaagacatgaattttcactatcaggagcgcctacaggttagcatggaatcaatcagggaaggttcgtgtggaagcttcatctggtacggcgacaaatggtgaaaggaagatctggaagaatatatggcaaacaaatgttcaaccaaaagtgagaatttttgcctggaagcttgcccaggacagattgcccacttggggaaataagagaaagagaaagataaaacagagtggcatatgcccgatttgcgggatgactgaagagaacggttttcatgctacggtggagtgcactctagctagaggcttacgggaggcaatgagagcacattgggtgttgccggctgaaaggagttttgcatatacagggccggactggctattagtgctgttggatagtctgcagagtacataaaaggagcatgttatgtatttactctggagagtctggcacctgcgaaacgacatgatccatggcaaaggaagtgcatcaattgctgaatcagtcagtttcttggttagttatgaaggccaactgttgccaatccgacaacgagaagatgacaagaaaggaaagggtcctatgtacagggaaccgaaccagatatctctatctacaagtatcaacaaactgactgacaaatggtgtccaccgccggagcgcttcgctaagctgaatgttgatgcagggtttagggaagaaaccggggatgctagtgtcgggtttatattcagagattgcaggggtttagtgctactggcggcccatagaaccctgcatcaatgtggttcagctgcctaggcagaggcgctagcatgtctggaggggatcagagcggcggttgacttgattcacatgcccattgtgctggagatggacaatgcagaaattgttagagatttaatgaggcatgatcagttgaaatcggcctgggcgacgacgattgaagagattaaaggagtgatgcaatgccttcagcaagtgcaagtgcacaagataaagagagaagcaaatagggtagcacctgttttagcacaaatggcaatgtgttctaggtcctgcgcggagtggaggttgtgtgctcccgcaagaattctagatttattaatcaggagtgtaaccctttatttaagcattaataaagctctctctttaccctcaaaaaaaaatctcatgttactttcaacttaagcaggtacatcagctgtacccattttcatcgtgtattgtctgtattcttcttatgtacagtaatctcacttcatcttgatttacttaagaagcgagtggccgcttacgcatgcactttttttttcacaatatttacaaagagcaactactcacacatcacaccaatgtcttgcatatcttcgtatcttgatcgcacatcttgagcccaaaacctcatccaagtgacatgcctttgtatatacacgtacacatgttccatctctgaacttattggatgctgatgacatgctgtcgccgcggtgactgtggcgcctgctggttgatgttcaccgcagcagcagcgtctgaaatctggcaattgcattttctgacggttagattgcagtgtgaaacaagctgcatggattgttcagcagcattgaactgcagattgtgtcttttatatcaagaattcagaatgaggttggtgaacctgccgctggttgcgtcgatgaagcagttcagttaaggacagcaagatgatgtacacaggtataacgattccagccgttctaagcatcagcagctggttcagaagcatgattttggctcaaataatcaatcatcaaagtagtagggtaatatcaatatgtgtgctattatctgagaattcagagaattacagtgatcattgcgacggtgtaagcatcgtgatcaccgaggaaaaccgagattgcgtcgtggagtagcaagagtaccatcagctgatgaatttgagtgtgtctgaatgttaatttttggtggtggcacgaaatgatgattcttttttttttcaggcacttacagttagagcaactatgcgacaatagattacaccttttgggttggggagttcaggatcgtagcttgttgaggcagcagcacttcggtctgtgttttgcatgacctgtgcttgaatgtaaccaggagttctgcaaatgataaagcttgagatgatccatgtctaatcagaagctcagaatcgtgcttcttttgtgatgatacatcaattacctgaagaaaattgagtttcttccatgttgaaacaactttgcaggtgctgtgtagtttggtgtgtattgctgtatccacagaaatacaggctactatatgttaatttctttgtaggagcaacttgttttgagatggccatgagtactaggtgttcggtgaaaatttcacctgtaagcatatctcacatatggtgtctcccttctcatcacaccacctctgaatgcatttgcgatgagcatactgaaagaaacatgtatatagcactgttacaaaatttatttcgcagcactactacagattaagaggtctgaaatacaggaacaaaatttatcataagcctaaaaatatcctgtgcagaagcaaaatacgttgatggcctaaatagattccttgaccaataaagttgtttaacaactaaatctggcataccccgaattgcagaaacggaatttaattagtttgatactgaattttaccttcaagctgcccctgcaggagcaaggggtctccatgtaggtctgatcatcctcttcctggcaaattctacattctacaagaacaccactcttctccctctcatcttgaacatcattatgttcagaagcaatcactgaagaaggcatggcagcagcagaggcctcatcaatggcagactgaacagtcgattccgttagcaaccggccggccattactgcaaagtggtccgccatccctgagaaagttaagaaaatccaagcacaataaagatcaaatcagaacacatcgtttacaaatacaaatatgaatgtaatttgcaagaaaaaaaaagcaaattgtgtatctgaacatgtttatctgacggctcaagatgattcttttccatttcacgaagaagtgagcaattgagcatagcaaacgatcattacctgcaattgcagttcaaaacagagaaaaatcaaggcatgagcttcctcgacaattcgaggaggtgagcaaatgcagaggccaagaaaggccaggaggaaatagcagctacaagaggaggcttgcaatgggggatttggatatctgaagactgaaacattgggagattgtatagagagaagcaagagatggagtagttgcctgtattattattgcctctttgcttgcttctgagacttctttttttcctgattatgctttagcttctgatatgctttagttgttcatgcagaaagggaaccaaaagcattagagaaatttgacagcaaaaacggaatgatgcttattgactcaagaaagctattcttttcgagcaaaactcaaggaatgaaggcacttgaccacaattgcaggggaaggtttgcatcatcaagtcatactatattgccatttgctaaggctcaggattaccctctaccaacgcaaacctatcttacaactgcagagttaaaagaataaaaaaaactcgttgattctgatacatctttcggttgcctttctttctgaattttgacatcacttttgcaatgtgatttgctggtttggatagtggagaagttgacaggtgcagatgttcaatggtggattaggcctctctatggcttttaggaatttattattatttacgtatatctaatcccaaaagcgaggattctcttgcagcttctactgctagtatgatttcacagtgtttatctaggtgtattattccacacgtgttgcaccggattgtaattgaagctccagagtgacgtcagacggtcagagtgagaaccccgcaaaaaaaaaaaaaagtttcacggcgaaacatagggctcttcaccaatccggcccaatgagcccaagcagaagaactcattggtccaccaaagtcttcgatatttcggaaagaaaattaagatactgcaagcctgcatcgtatttttcaaatttcaattcacactatctctcacagctcacatccaaattgaacagtcctatcctaaaaaaaaaattgaacggacacagcatcacttgaaattctgagttgaatggtgcaccttgttttcaatgttttcatagtttgatccgcactgtatttttcacagatacttccatcgtcaaaaaaacgaatttaaaattggatgtgacatattctagtaatccattaacacaataaaactatgataaaactactgaaaaaaatatctaaattgaacgggcgcagtataacttattcaacgaaatacccgattatttagagttcataggtcgacgaaagaaaaaaaaagaagacatacactcttggccgttcgatcccatccgacggtcaggatatcccgtccacgtctctagcccagataaaccctacccccccactcctcccgactataaattcctcggcttctcccctccgccgcctcctctcctagccttcccctcctccgccgccgccatctgccgtcgagagccccggttgcccacccccgcggcgacgatggcgggccaggagtcgctcaccctggcgggcgtcctgcgcggccacaacgacatggtgacggcgatcgcggcgccgattgacaactcgcccttcatcgtctcctcctcccgcgacaagtcgctgctggtgtgggacatcaccaacccgtccaccgccgtggccacggatcccgaggcggccccgccggagtacggcgtctcgtaccgccgcctcaccggccactcccacttcgtccaggacgtcgtcctcagctccgacggccagttcgcgctctcgggatcctgggacggcgagctccgcctctgggacctagccaccggccgcaccacccgccgcttcgtcggccacaccaaggacgtcctctccgtcgccttctccgtcgacaaccgccagatcgtctccgcggcgcgcgacaacaccatcaagctctggaacaccctcggcgagtgcaagtacaccatcggcggcgaccatggcgccggcgagggccacaccgggtgggtctcctgcgtcagattctcccccaaccccatggcccccaccatcgtctccggctcgtgggatcgcagcgtcaaggtctggaacctcacgaactgcaagctgcgcaccaagctcgagggccacaacggctacgtcaacgccgtcgccgtgagcccagacggctccttgtgtgcctccggtgggaaggacggaaccaccctgctctgggatctcaccgaggggaagatgctgtacaagctcgacgccggcgccatcatccactccctctgcttctcgcccaaccgctactggctctgcgccgcgacagaggactccgtcaagatctgggacctcgagtccaagctcgtcatgcaggacctcaagccagaagtccaggccttcaagagccaggtataccttttgcactttgcctctctcgttagccttgcttgtcacatgtatcgtgcattcgttgctgcctgaatctgaataggatgtaccgcgtgatgcatgttctgtcgttctgtctgattaggatgtattgtgtgattcgttccatcgtggttctcgcgtgttgcattttggattcctggtgctattattgttacgcccttcaatttatcaggatcctctgtagtaggatagggtagttttgatgcttattaagctcattgcgagcaggttatccaatttaactcacagcatcatgttcatgtggtcaagcatcacatgtacgtatgttatcagcaggtcatatacataattagtcccgctgatttatatttctaggtaccgaatcctctgttctgtgttgatctaatgatctaatcagttttatgatctgttctcagtaatacgtactcatcaatgatgctgttgatgtttatgctcatcccttctccactgaattgtatacatgtatttatattactatatactaagtagatataaaatgctgcattttatttgtttacatgttagtttcatcaaccatggtgctgattggtccctcatgtgcctgtgtaactatttggaaaccagcatttcggtatacctctgcatatccttgtagagctgtagcaatattagtctctgctataagtaattcaatttaacttcaaactataatttgaccgcaccttctcactagagtggtacagttttgacaaagttgatctttacaccttgaattttgtgttagttttgcaaacttttcttaatgtatgttttgttattttctaccacggaaaccttttctgttacagttctcataccccttttgattgagcacatgcaatttgttatagaggatgtgcattctccttgaaatctcaatagtccttaaattgttctattgtgcactttggctgtttccccctagacttatattctactgtgcaccttgtattaatatgtattcaattctttaactgaacttgattacgcatttattttccttaaaaagaatgtgtactgacacctgccgttacatttgcttagatgctgtactgcacaagtttgagctggagcgctgatggcagcaccctcttcgctggctacactgatggaactatcagggtttggaaggtctcagggtttggcggctatgcaatctaggtggtgaatttgttgaaaggcttaggaatcttaatttaaacatcgtgatgcctatcaagtttttgacagttctgaggcataacatttgcctggtactttctacttcattttcattaattaatgattagatttgccaatgagcttatcggtactctggaactatggaagaggatccttatgcatattttttgtttttggctaagttgaaaagatattagttatgcaactttcggagcctcattgcctagatgtaaataatgcttcatcaattgctattttctgatgattttgatggtgctaattagcttttcatctgccgctgataccttaaatcttccatttgtttgccttattttttattatctttcattctgtggtttttaccgtcaccatcaggttagtttgttctggacatgtacattggatgttattgcgtttgtaatatgtgatgtttatttagcccctaaaagcctcttaagttaagaaatagtatgtggtataactacgacagaccgaatcacctggtgtggctgtcatctagcataagcattgaccgtattatctgcatttcataatcaaccacagtgttcttcagttggataatcaactgtcacctgccttctgttttcaactgtgaccatcgtcgtcatatcttgcctaacctctatcattttttaatttcatcgtcttctatgattgaaattttctcaatgcttagtttcttattaaatctatgattggaatttttctcgatgattaattacttatttaatctcaaacacatggttatgcaatccttcacgcaaactgcgtcctcgaccaatccagtttcacgacgaagtcgtcgacccgaacctggtcaattattcttcttcagattcagaaatcaccatgtattagcaactctcttaactcgtctaaaattgcaccaattcattctatcattgttgccgccatgtcgtcgtcttcctcattgtacaagcagctcggcctcggagccggctctcccgtctccgcctctcacctgcttctgctcgtcctcggcgccggcttcctcgcgctcaccgtcttcgtcgtccaccccaacgagttccgcatccagtctttcttctccggcggctgcggccgtcctggcacggacgccgccaccgccgccgttgctgcctcgccggtcaagaatgtcagcggcggcgcaagtgatgctgctgccgcgaccacggcggcgcggtcgccggacaacgacgtgagggtgctcatcggcatccagacgctgccgagcaagtacgagcggcgcaacctgctgcggaccatctactcgctccaggccagggagcagccgtccctcgccggcagcgtcgacgtccggttcgtcttctgcaacgtgacgtcccccgtcgacgcggtgctggtgtcgctggaggccatccgccacggcgacatcatcgtcctcgactgcgccgagaacatggacaacggcaagacgtacaccttcttctccaccgtggcgcgcgccttcaactccagcgacggcgagggctcgggctcgggctcgccgccgccgccgcggtacgactacgtgatgaaggccgacgacgacacgtacctccggctggcggcgctggtggagtccctgcgcggcgcggcgcggcgcgacgcgtactacggactccagatgccgtgcgaccgcgagaacttctacccgttcccgccgttcatgtccgggatggggtacgcgctgtcgtgggacctcgtccagtgggtggcgacggcggaggagagccggcgcgaccacgtcgggccggaggacatgtggacggggcggtggctcaacctcgccagcaaggccaagaaccggtacgacatgtcgccgcggatgtacaactaccggggcgcctcgccgccgagctgcttccgccgcgacttcgccccggacaccatcgccgtccacatgctcaaggacgccgcccgctgggccgagacgctccgctacttcaacgccaccgccgcgctccggccatcccacctctgaaccgtgttcttcttcttcgcgccttctctctctcgatcgttttcgtgacggattcccgttgaatttggcggttgttggttggtggcgggtagttgttgcgcgaaagcacggtggattgcccctgtgttcctagctgatttgttccaaatttctcgagtttaaaatagatatgaaatggatatttgttcgttagtgcttacgtgttctttgataaaccaagtatgattattacgctgacgtttgcagcgagagaaaaaataacaggtgtgtgacatcttcagaggaaaatcacgtctgatagagaatgacacacggtatggatagaacgagcaatggtttcgccacaatcgggattggattctaatctcgaggggatgtcccttcgggtacttttttttctttcaaattctatataaatgattatgaaaaattctgaaaaaaaatgtagagtatagtgatatctattggtccaccaaaaatcaaattaaaattctacctacacatcaagaaaaaaaaagacaacttcagatattatcatatgaacaatgcgctactattaatatggtgaatttgtcttttatatatctgaacgtgtgagttgagttttatcgttgatatggtcccagggtactaagctcaggagagaaggccctccccgtatgacgcgtgtcataagactcctgaaggagtcgcgtccatgcattaggagcggccgtcccccccgcgaggggggggggggggctcagagcgttcccccgcccgaggggttgagccaccccgaggctctcacccgggcgccgcatgacgggagtgttggggtgcgtgagccccgcccacctaaccacattcatggttagctgagcagccacctcccatcgcatttaatacgacgtagggagcgtagtgggtgcgcctgtaacccgtctgcgaccggtctatgaccaggcgatagacagatgggatagcggcagacgcacccacgcctcaagctcctgttaggcggcgtggggacaggtatgccctgtcccatcgtggataatgaggagccctatgtcccccatccggtcagcagtaggcttgactgaaagggacgtgaccgggtccaatgacctggtgtgtgtgtgtgtgtgtgcgcctatggagtcgccgagcattaaataccgagtgacggggggctgtccctcgtgtcaaccggagaggtttgatgggacccgcatgacggctggcgtacggatcgcctccggaccaaggcgcaagatatgtgctgaatataaacagtatccactctctccccgaggaagtggggggtggcgtgtgtagtatccccttgaactataaaaggaggaccacgcctagcggggatgggggatgaaaaaaccgaagcttgtagactagagattcagagactttgtaagcacaaaagaatcatcatgcacataggagtagggtattacgctttatagtgggccgaacctgtataattctctggttctcgctttcgccaagggacctagtcttcgactaatccaccgcactcgcatcctaaaaactcctcaagaattcacccgtgccccccgccgaacttaaaaaaaaaggggggggctcttagttccccgctggagggaatcactcttcgataattttggacttgagattttgtgaagttgtatagatatattgtatgagtgttcttaaatttttttcagaattttttataaacatttagatagtttttttaagcaaacgagggaatatcccctcgaggggatccagatagtttctagccacaatccgttagcagccaatctgcatgggccgtacattgagcccaacgtctgtaaagacgcaatgaggcctcacacgacgatgtatgcagcccaacaaaacaaagcccgatattgcagcaagcgtcaaacatccaacatccagagttaatcaagtcgtcacgtcactgttccagcctagctaagctagcaacaaacgggacaccacccaatgcgatgatgggtatggacgaatgatgccgctggctgccgagacagacagaggccacaagaatccgtcgtcgccgccgtcgggtcggcgagcagatgagatgggggcgaaggaagaagtgatctgatcggcatctgctcgggcgccgctgtgctcgagttgaatggcaaccgctatccgatccgctgccgcatgcgacccgcggagcgcctcgggaccatacgttgtgatggccaaaaacaccggatgatacggagaaaccaatgagagctagtcgcgctcatgtttctgcacgaacagccagaagagaattactccgcgaattatgggtgacacgccatgtgcggtgcgatcctttgcctctctcaaattgattttaggagtacgacttgtgtgtgtaatttcttttctcctaagcccacgatgttgtgcaaattgtcaaactaattttgtgccggtgatctcaagtgctagggggtactgtttaggtgaaaatgagacccccagggttgcttttgtttcaagcctagtagcgacaaagttagcaccacccccctccgctcgtctccatccgccacacagacactctctcccggccgtacgctgccgatccgacggctcccacctcccccaccccgccgtacgtggcctcgactccgcttttcttcccccctcggctccggtttcttctccacacgtctctcctctcctcctcctcctgacctcgccggcctcacccaccacccgctcccgccgccggctttaatgcctccggggacaagccctctcaagcgtcaacgactcatccactgctccacccgcgtgggcggcgcgtacgtagaccctagccggcctctacctgctcgctacagagctcacgtacgtacgcgcgcgcggtggtggttggcgcgcgcgcgcgtgcggtgaggcgtggtactagtattatttattcgctcctgcctcctggggaggtggaggatgctggcgatcatgagcttgctgctgccgtgggaggaggaggaggagacgacggaggcggcgccggtgttttgatccgtcgcgcgcgcgcggcgaggtgcggatcgggcggtcggttttgaattttggagcgggaattgcgcctgagatctttgtatttatcctggttgttcatgtatttttcttcttaattgcttcctttggttggtggtttcagtaggaagaggttggagacgtggagaggagtggccgtctcgtttcagattcttctgcgcaaattctggttacaactagaagttgcaggacgcgagagggttgattggtaaggtaattctatggcgttcgtgtgttcctctcatgtaggttgagtggtttcttgtgttatgtttgtgcattctagatctgattgatatgcgtttgtcatctccatgaattctgtgttgttttttacgctagcctgactaatctgccaagttaatggcactgtttatgttttctgaatgaacactgctacacatactaattttttcttactaaatctttactaacaatcatctcaaccgtttgatttaggtagatggaagttatgaaaaatctagatacattcatagcatgacacatcagtgttagaatttagtaagaaaaagttagtatgtatagacttttcctttctgaatagtaatgtacaacaaggtgatcaactgatcatgtactaatagtgaacactttatgatgtagtaactttttttaaaaaaaaacgatatgatatggagtaagtaactttcctttgttgattcctcgccgttgcttgaattctggttttctgctcagctttggtacagtatcattatcatcgtaccatctctgcatctcaccagcaagcttgtcggaatgtttgctgcttcactatagagttttaaggaaccaatgtccagagctcacgtgttataggtgcagtaaagtcggatgaaatcatgaatatctgtttcggtctagacacttttcttttaagaatggtcaccgggggcgaaatgcccacctgaatatgttacttcaaacaatcttacacagggcaggcttagcttatgcaagcgtaggtggccctggaggataatatggaagaatacacgggatatacaaagaagagaatacaaacgtatcacaacctcccccacctaacacaaagaggcacaatagatagaagacagaagctttgacgtttgccacctgcaaaatcacccaacaaaattccaaatcaagcaaatgctagaacccttgttcgacatcatccacttcacatgcagtctggaaacaccaggaatcgaaagtgtcggagggcctctccgccatacgcatgcggctcggtaccctggcagtgtgaaaggctgtggttgtcgaagaccacccgcatcatgcaatcagaataatgacttagtcatgttgctgctgggatcaatgcctgtcggcgtcctttgggggaaggaagccccaaaggagggagggccactgaaagattgaggccataggccatccgcatcaagtcatcttcaatcagtctttaacaaattgctactccctctgtcctaatatattgcaacctaggatgggataaatttatcccattctaggacaatgaatctggacataccatatatccagattcatagtcctaggatgggttgcaatatattgggacggagggagtagctagtttaacgccctccaacatccttcgggggaaggaagcgccaaagtaggaaaggccgctaaactttgcggacacattgatacactgttagtcttgatctcgtctaaaaatttaccatggtaacagatcaaacttgtactacctccgtcccaaaataagtgcagccataagtttccgcgctcaactttaatcgtccgtcttatttgaaatttttttataattagcatttttgttgttatgagatgataaaatatggatagtactttactcgtgacttatgtttttaatttttttcaaaaaaatttcaaataagacgaatgatcaaagttggacgcagaaaaccatggctacacttattttgggacggagggagtatttttcctttagaaagaagtacagtatataccttcatcttggaaatgacaaagttctcagtagtgtgtgtgtgtgtatactaatattttttcgaaacgttcgtcatgatatgattatctatgaaaatgtttctactgcattatcatatattcatatttttcctcgacatattgtactatgaggacaaacttatcagttaattgacaggctgtaaagttgtaatgcgcttcttacatttttgacagaagaagaagtgctgtcaactttgagataaaggcaaaattacgagaaaaaagactttcaagttcttttgaggatgagtgaccctggagagccttctaagcattcccaatggatgtcacactggaccaaaggaagcagcagtgcagagccccaagttggcagaagtaatgattctccggaggatgcgaaatatgacatttgcgaggacaattctgggccttcaaactttgagatcatgaaatctagattgtttgaaaggctaatggtaggaatcagccaagaaagagcttcgttggagcatggacagaagttaaattctaacatgaaagtagtggtaaaagatgctcgccgacacgctgtgcaaaaccaaattgatcagggagacgggccaattcaaaaatctgtgatgcaaaaagatgtcttatatgctaaggctgttgtatcaaaatcactttccattcagaagctttcagagttatcagtggattgtcagaaacttgcaggttcagatgacctgagttcagagtggaaccattttcctatgcttgcaatcaacagaaaaattgactccattctcaaccctaagaggaagtctgcaaagagtactggacccaatgacgtttttgtgccaaaacaaactctgaagctaaacatgactacagctaatctgatggcattctcatctcaggaatatgagctgcattctcatcgaacaaccgacgagacaatggatcactgcaaacatgcaggaggcattgtatctcgcctggaagatcatgctggtgtcatgttgaatcctgcagagcaaaaattaaaaggtcaattattgccagcaacgtcatgttcgtgtagcaaggatgacagtaactcatctgatagtctattagatgagcagcatacaagccgctacattgcagattcagatcaggaaccaacctgcagatctcgtgaaaaaaggttgaaatcttcagaaaacaatgacacgaactgtaaaattggaagttgctcccagaatcagaagtcaagagcacctggacatcataaacacaaaggttctgcgggagtcatgtttcgtacgtcagtacctggtaaagaatttgaagctgctgaaattaattgttccgacaaaattaatcagcgacatctgaatacacagagaatagtatctgcagcgaatgtcactggctcctgcatacctgatccagctgcagacatatctacagtaaatggtaggggggaggcagtgacccagccatcgagcatatctggagattcaactaaacgaaaagctccatatttatttgaaatgctaaccataccttccaaagctcaaaatatgaatcctgaagattcactgccttcaggaaactcgactgcttttggagttcacatgtacggcacaaatattggcagtcatctatttggagcaaataacaaatcatcaactgaaactgaaatattatccggcgacagtcaacatgtttcaaaatcctcagcaggtaggagagaagaagctcagataatactcatgcgacattcttttagcttatattgattaaaaggacttgtctctttccaatgttgtttgagtcgagattgatttattgggtatgaaagaaggcaataaaaaccttgaataaaatataacaattttctttattccattggtggtatcactcacagttttgttctctcttctttcaggcatcgcctcattgttggcacaaaaggtactagtgtcctatactactctcatgtttggtcgttatcatataagtttatgcaaatttactttaaaaatgtatataatattgtcgatatgcattttttttctgcaccatcaacattgttttccatatttaagattttgatcacatatataatcatattagcttggacatagcccatttttctcttcttatatcctcgcaaacaagttacttcatgctatctcatttatatgaacatgccgcggctaattcctatatggttgcaggcaaaatccgagcagctcgcgactctgtacatgaaaggagcatcaggatgcaatgtgaatgaacatcaaggtgtttcctccaaggcaattgtcgccaataagcaacaatgctacaatccaagaacagcacgcatggacttagatctcatgctttttcagttgagcagaatgagaaaccaagaatcacaagcgcgaaccgaaccaggcgacagatggctaaaacgcctacagattgacagcaaggaccctcatcatcttccttgctccaagaggtcaaaagctggagacggatccggtcgtccagtcaccggaggagcaagcagcatggcaccccgttgcgacgggagcaacgacgacgacgacattgttgaccgtgatcataaggaggaacaaggattggatgaaggggtggaaattcaaggcggccgagaagcatctcctgttccggcaaagagtgatgaccggtggattgggagatggtgccagggtggtgttcctgtgtaccatgaagatgatcatgatcagaggaaggaagtaacaaagcctgatcttgccgccggtgactccggaggacttgaaggtcagttcccaagcatcaaggcgatggcgatgatgggacgagcaatgagcaaggttcggccgtgtcaggaagagaggaggggatccttcatggtgtggaaggcgtagtaggagagatcctgatcacgtacaggtttttttttcctgttttttgttctgtgtaatgtagactgggctgccctctctcctcccgtggcagctggcttcagatccggtggctatcttatagggtatgtttaccaaagtatctttgtgccagcttggactccctaatcctcttaatctcttggcatctatggaaggaatgcaactctagagatttcgactctgcgctcttttttatcagtggttcagtgtaaacgatgtctggttttcaggtttatgagggtaattcggttgaccgtgatagtttgggagtaattcgtacttttttcatttctaaaataaatagttgtaaataaatggatctacgtgttataaacatctgcatttataatgttaaaaaattagtacccctccgtttctaaatatttgatgccgttgacttttttaaacatgtttgaccgttcgtcttattcaaaaaatttaaataattattaattcttttcctatcatttgatttattgttaaatatatttttatgtatacatatagttttatatatttcagaaaagtttttgaataggacgaacaataaatatgtgctaaaaagttaacagcgtcaaatatttagaaaaacagagggagtactctttttgtaagaaaaaaaaacttagtatgacagcttaacggatatattatgtttgttttttttatgtactaaaagggagcagtaaagtaaataaatctagcactgcaacttaatggatcgtcttttactagagctaatgacagaatggacaggacgatttgccttttgttccaactatctatgagactatgacatactcattccatcccaaaatataaggcttaactactcataacataaagactaagaaaatatttaatctcctgcttggttggatcaccctaatacatacaagcaatgtgattggaatatttgatggtataggatttaaaacaaatcaattctattggaaaatatttaatctcctgcttggttggatcaccctaatacatacacgtcttatattatacatgagaaaaaaatggttgtgtggaagggagtagtaagtacgtaaaccatcatcagtcatcaaatgaatctagtagctgattctaattaacggttgctatatgcagatcgacgagatgacattaagggggtgtttagatccagtagtgtaaggttttggcgtgtcacgtcggatatacggacagatatttaaagtattaaacgtagtctaataacaaaacaaattacataattcgcctgtaaaatgtgagacaaatttattaagtctaattaatccatcatcagcaaatgtttattgtagcaccatattatcaaatcatgaagcaattaggtttaaagatttgactcgcaaattaatcgcaatctgtgtaattagtttttctttgcctatatttaatactttatgtagatgttcaaatgttcgatgtgatagggtaaaaaaaaattaaggtggaatttaaatggggcctaactcctagtaagacacaaggaaagtgactccagctttacgagcaattttactgtctttgagaagataccatgaggtatcactttttggtacgaggtatcactttttggtacttagatactatgaaataacgaattttacactaaatttttgatatctcatggtgtatcctcaaggaccataaaattgctccaagctttagagccttttgttccgactatcgatgacgtaggtacgtaaaccatcatcagtcatcaaatgaatatactgaagggatggatttgtccctccaaccaaacatcacctattaattctaaacagttgctatatgcagacaaaaggaatgtgactccagctttacaaaagttcgtcaacgtaacctgtcctttggatagctgcaaaagctcaattatacacgtaggagtagttcctttggctgcaaaagtagtttggtgatgtggatgtgatgtttacatttgctgctgcctttggtgatcaagtggaatatggtagtactaaaaaatttacattagctgactagccattcgtgatgctatgtttgttgatttttccgatggagagaacggtgatagtttttttttattatttatttattggcacgtctcgtgtctatatatcgagaccgatcgtatccaggcgcacgacacttgacaactctgtactacgtagttcgtgcttctaaagagcgcgggggaacccatcggcgatgccggcgcagtcggagagacttcgcttgccagcggcggcgccgatgccgcgcggtgcgcacgctctctacggactactcgcgctgctcggcgcgtcggtggtggtgtggtccgtcgccggcaagccgcccgccgcccacgccgggcacgcactcgccggcttcctgctttggctgctggggatgatagcactgctgctgtccccgtacgccgcgcagccattgttcccggttgcaactactgccaatctcgccgtggagaaactgaagcatcgcttctccaacccccggacgccggcgcaggcgcaggcgccggctttggcttaaaaacccaccgacatgtacgcgacgcaacgcaagcggcaaagccggtcctacgccgaccaagccgcgccgtcgtttactactactactactactcgtacatagcaagtgaagtggtttgagactttgaatctgctcgtctgtgtgtgtgtgaataaaataagttcagtttggcgataattcgactcaaagtgcaagcagttggtttgatttactgatccagttttagcattcgcagctgatcacgcgttgtaaatataaagctttgttctttccttcattttcagtatacaagtttctgaagctactgtaacttccaaaaaaaaaactaaaaataacgaaaaaggctggacgatactagtactactcgttattactactaataatttactgtactactactagtagccaaacaaaggggacacattcaatttacatgcttctcatttaggagatttggtgcgaaaagaatagacatattttcagaagcaacgaactttcaatatcacaactagtgacaaaaaaataaaataaattgtatgtggggcgaaagatataacgagaatagcgccttaccatgtcctctgatgtagtttgttttccttctcttttttggttttttctcttcacccttggtgattgtgtacggtttactcccctacctaggctgcaatccatattgtagttcgtttatttatgttcctaaccttcactctcttgttttcacgtgtacaccttctaaccgtaaatgatgtgttttttaaaacgttctatggaaaaagttgctttaaaaatcatataaatttattgttttaaaattttaaactaatacttaattaattatgtgctaactcaccattacgttttcagaattagtttcgaacacaatcttaatattaaaccagtagcgtctgtcattaaaattactagtagctcggtttgagaaaccagaccattgattaagggcatgtttggagaatttaagattttgagaatatgaaaattttaggtttgtcagcttgtgtcttttaattcattttctgattctaggcctaaaacggtttgaatccaaaaagcccaaacccgcgaagaaatatcccaacccccttcgtcctccccttcttatccgccaccaccaaacccaaaaccccaccttcacatctcatccttcccatccatggcgccaccgcgctaaaccccccaccacactccatccatggcgctctccgagctaccgcttcaccactccttacgcctctcctgccgaccgcacctccgactcctgccgctacgacttctctactcccggcacgcctactgctgctactacaccacctgcgacgagtgctcctcctcctcctccggcgggaaccgcgccccttcggctccaaatccaacccgaggcgcgccgtggctgcagaagtgggggcccaccgaccccgccgggccgccggcaccacctccggctccctccccgacctcctccatcgaccgaatcgtccaccgcctccgcaacctcggcctcgccagcgacgacgacgagcccaccggcgccgccgccacggccaccgcgcctcccgacggcaacgagcgcctcagcgacctgctcgaccgcagctgggcgcgccccgaccagcagttcgccgcctccagcttcgacgagtccgtcctcccctgggagagggatgaggtcgcgcgaggaagagagaacgaggaggacggggtgaagaggaggagggttagggcgccctcgctggccgagctcacgatcgaggacgaggagctgcgtcgcctccggcggctggggatgactcttcgggaccgcatcaccgggcccaaagggggcgtcacgcaagccgtcacggagaagatccacgacgcctggaggaaatcagagttggtcgggctcaagttccacgaggacctcgcgcacgacatgaaaactgctcatgagctagtcgaggtgtgtgctatattagccctttctatcagcattggcagcttgctcgttgtaactgtttaatctattatgtttttttttggatatcagttcagtttagtgatttctagtggcaattgaacttgaattattatgtttgttgctgtgaattcgaggttttcgatgagttattagttgtgccatgataaatggattacttacatgacgtttgcctatcgatcagcgacggacaggaggattgatcatatggaggtctgggagtgttatggtggtttacagagggagcaattacaaaaggcctttgaaatctgaaacattggatggtaactcatcagcggtgaaaggggcagacggtacattgttcatcccggatgcatcaagccccacagagcatgatagccaggggaaggatgtaaacacccaacgtgagattgcagccagattaaatatgcagaatactgaggacatgactgaagaggagctggagttcaatcaaatgcttgatgagttgggccctcgttttgtggattggtggggaacaggcattttacctgtggatgccgacttgttgcctcaaacaattcctggttataaaacaccatttagacttcttccaactggaatgcgtttgaccctaaccaatgcagagctgactaatttgcggaagttagcaagggatcttccatgccattttgctctaggtgattatttcgacagtgttcatattgtttatcccctattatagcttttatttgttggtggcaaacgcctgactactgcttgataaaattcatttaagggagaaaccggaatcatcaaggccttgcagcagctattgttaagctctgggagaagagtttggtggtgaaaatagctgtgaaacgtggaatccagaatacaaacaacaagctaatgtcagaagaaataaaggtttggacaccatgctgttgctgttttgactcattgactggcatacctacttacttcacagttcacagaatttatgccaaggaacattgaaaactatggtaattgccagattatatctaaatatacaattgcttgtcatagctaagctgaatatatgatatatctagtcgtatttgaggcatgaagaaattcaactaaaaatcctgataaaaaaggggcaactataaggaatactcagtactcacttactcagcagtaggttttgatgaagtccatatttgtcctgtgaatattacaaaatccatgatttgttaaatcatccaaagcaacaccaggggtttcggaaaataataacaaaattgtgctgcactgcttgctctaatgaatataacttgcttaatgtaatgcttttatttgtctaaacaccatcatagacaatcatgctttaccaagatcatgatggagacagcttcatatagtttagttctattccttgtcgaactttcatagagttccaaaggtgtgtttccatgaatcaactgtgttcaactgttcatgcactatatttgatttaacctgtataggatttctgaatcagtgaagccttatctttttaacattatttcagaatctaacagggggcaccttgcttcttcgaaataagtactacattgtaatatatcgtggaaaagacttccttccaacatctgttgcagctgctttggctgaaagagaggagttgacaaaagatatccagaatgtagaggagcagaaaagatgcattccggttgtgcactcaatggatgacagtttagatgggcatgctcttgcgggtactcttgctgaatttcaggaggctcaagctcgttggggaagggaagtaactgctaaggagcaagaagaaatgaaagaagcatcttctagatcagtgaaggaaaagcttttcaagagactagagcacaaactttccattgtaagcattttctgcatgttctctgataaaacttgtcttattttgtattgccattttttaattatgccgttgatctaggtatgccagtgtgcttatttgacatatatttatttccatcagttgttatgcatgttctttatttcttcttcaattgttcaggcacaggcaaaaatacatagagcagagcggttactatcaaagatagaagcttctatggtccttgctaatccatctgatgataaagaaatgattacagatgaggaaagatctgttttccgtagaatcggtttgcgtcttaaggcatacttgcctgttggtgagtttcttgaacaataaccttggagagcattctatactatttctattgattgattattcccccttccattttaggaattcgtggtgtctttgatggcgtcattgaaaatatgcacttgcattggaagcacagggaagttgtcaaattgataacaaagcagaagactctgccctttgttgaggagacggcacggcttctagagtatgagagtggcggtatactagtcgccattgaaagagttacaaagggctatgcacttatattttaccgtggaaagaattataggaggcctattaacataaggcctaggaatcttttaacaaaagcaaaggcattgaagcgtgctgttgcaatgcagcgtcatgaggttagtttgctacaaaagaaaaaagcaagagcagtaccttctttttttatgataatcattgtacacaactttagcatccttctgatattgtttaaactcatgaattgttatgcaggccctcagtcagcatatagctgaactggaaaacaatataaggcagatgaagttggatttggtacgtaatttctcatattacagaaaagtagttgtgttttaattaaggcaaacatttagcataacgaacccttttttcttctcattatacagcactaaaactaatttctgtaggcttaaaatgtaatatgatgccatgccttttgtaatttttgccatttgcatcagagtaaaaacatattaacatgcatcttagttgatcctctgcccactaaatggcctttaaattccacaatatttacctattgttttagcaaaaaaacaaatgttgttattcattggcatttcattattaaggcaacaactttcccttagactgcattttttttcagcagagatgtttttgacagtgaggcatatatctgttggtgcgctagtgataaattgatcatatatgtcttttagttaatgtcttcattgatgaatgctttcctgattttatgtcaaaacaaaatagggcattgaggttgatgaggaatatgaagaggacggttcagattcagaaaatgagaataatgaagcagtttcctctgcaagatacgacgaggtatccaatcttttgaaactgatgctgtctgttttagaaccaccataaaatccattcttccctttaacgtgtccaggaccaagatgattttgatgaatcaagtgatgaagatgaatatgatgattatgatgaagatgatgacgatgacgatgacgaaggcgttgatagctagtaatatggaactgggctttgcgatgtagagtgatgtttatctctggaggtgatattgcaatcctttggacattcttggtaagagcaaagatttttgttttggagttctaccaatacctcaataggttcatgcatagcatatacagaaccatataggtacaaagaattaatcatgcagtttcggtttgtattttagggagattttttattaagaacactggggaatttgtagttggtttgtattatatcaacacctcatctgttactgtatcaattaatcaaccactagcctgtaaggggcttatcttttctgatgtccttctcaagaacattttgatgttagtaatgggcttagattctgagattttgaaaccacctccatttttttatttgagagatatttataccagcataaatggattaatggattttctcccgtactattcacttaggtctttttgttacacaagtactcctttgtgaatccttactgttattcagcattaaatgcaactttgaaatatcggcacattgcaggagccaagaggatcgccggcagaccttgacaactgtattgctgctgcttctgtttacgcatggtcttttggacgaagggcatataactttcgcatgtctctactctgtatatcccatttgctttgttgtttgcaaattggctgctgggatctgccttagaaaagctgagttgggtgtaaatggtaatcttgtgtcgatgtcttctcatacttctcattttgtaacaattatttaagcaggctcgaggtagaaggtacgtttccacccccaaaatgtactagcacacgagcactgtataattcttctgctgtataaccggatattccaggacacgaagaatgttgaatatacttggtttttctcccttgcacggttgcacgcattgttcatgacatgtttatacttaggttctttgtaagttttaaggtgattgttcttgtaatgctgatctggttcttatatcttcctcagtcctgttggcctttttcaccgtaaaacgtcattgtttatctgtctgtctaagtactactcgtatcaactactgaagtgtacgtcaaacaataaaaataaaagtgagtgtgcaatatgcttcgcacagaagacacgtgaacaagtttcaccaaatttattggttttcgactgtttggttttcatacaatctgtttgttggtgaaagccgaccggtattggatttcatatgacgttgatagaaagttatcactttttactagtttccacttcaaaacaaaaagatattggtgcgttgaccgaaactcatcggtttttactagttttcacatcgaaaatgaaaagataaaccctgcacgtttggcttgtcgattcgtgcagcatgtcgattcacaaaaatgctatcgatcggtggctattggcttgtttgttttattttccttcatttttacttgttgaggaggtggtcagagtttgagaacttttacggtacactacacttgtaatatatacttgtagtataaacaatctaatacactacacttgtaatatatacttatagtataaacaatctaacggtgtggatttatctgatctttcttttacagtataaattatgtagggtatatttgtctttctatatttttgcggaaggttatttttgtattttcatgattccttctttagtcagatcggatcgtgagaaaggggctagtcccatgcgctgccggtgacagccgctgcacgcgtccctggctcgcccccagcagccacggcgatcaagggccgccacgcgcagcaaaacaatgaaacgtcagcaaattaattctgaaagcagtcgaagattcatagggtcttttagagttcgtaacttcgtatgtgctagcaaatgctgatattcgtttcgatcaatcatgtatacaagcatcgtagtcgcacaaccggacactggctggatgatggcgtgccggtgtttgggaatctttcgatccgccgccccgcgtgatatattccgaagaagcgccgctgctcgtcgaacggacgacgagatccaaaacaaataccaactaagcaaacctttccagattaactccccccggtgcaaataaatctcaacttcaaattactaaataacccattctatattttgaacaaatactaaacatacccttctatataaagagatgcggcagctctactgtagacgctgagccatgccgtcggacgccgttggacggcagaggccatgtaagggaggtctagtttgcattgggccgagcccgttaatctgatgtaatttttttttccttttcagttttatcggttgaggaggtggcggagttttcttctccgacccctgttttcgcaagaggatcgccggcagaccttgacaactgtattgctgctgcttctgtttacacgtgtcttttttttttgtggacaacgtataacttcgatgtatgtactctatatatccccattgctttgttgtctccaaatcgctgttttgttgttcgtaccaacagttctacatcgtcctcggtcctgtggccttctttactgttccacaactgtgtcagtgtttatctgcctatcatactagtagtatatcaactttttcaccaatctgtttcatgtaggagacgcgggagcgattcgtgcagcatgtcggttcataaaaacactattgatcggggctgaaggtattggcttgcttgttctgttttccactttttctccagtgaggaggaggggttcggagttttcttccccgaccaccagttttcctggtttgacgaggcagcagagcaccagcgcaggcagggtagtagcggctcgaacaccgtcttctcggctcccgtgtggtagagttcctcgccgccatacattccgcttacagcgcaacagatgcggcggctcggctgtcgacgcctcgacggcaagccggccgtcggcgccggtggacgggaggtggggaggagagagcaaccaaccagcagggctgctaattttctagttgggcctggcccgttgatctggatgttatcggcttgtttcttttgttcctttttcttgttttgtttatttgttagcttgatcatttccgtcgcgcggtctctttcgttattcgaacatctcgggcgcagcccacaaggcggataacattttattattccaaacaaaatagaaatacacaaacaggtcagcttattttcttgggctttttgggtttggccaggtgcccccatgatatatgatatataagtctaattggtaggctgcgtttgtttgtgggtttgggaatgatattttgagtagcataactaaacatgaaaaatgaattaatttatttattaaaaaattatataaaaagtttttcgtggaacgcacagtttagcaattcaagaaagtagcctaagccgagaagtggcttaaaactcagcctagtctccgattttaaatgtatgttgctgttgtttttcactttctttttaatctaagttggttagtttctaagacatttattcactatattctcgttgttaattgaatgatactcccctgtcccgaaacataatgcgcaactaccactaacacaaaaccaagaaaaattactatcactttcttgtttggatcacgtcaataaatataatacatgtatccaataaaattaaaaatcttaagggtgaaagttttagaaaagaattaaaggagagggggagatgctagttaattgcacgtatgaatgcgcgctttatattactatgaaacatcgaaaaggtggttgcggagtatattttaaagaggacggagcgagtattattttcgtgaaagaataggatctcattttcagtttcaatgtgcaatgaatacagagcaacaatgtcacgttaactgtttaattactcctgtacacatgcaagtctaaaacgacttgtatctggagagtattactacaatggagttatgacaaatttgtgacactcaatttggcaatttgtcacattcctttcccattttgctgggcactgaaatttgtggttggaaacattttttttttatcaatacacaagtggtagttcccaacaactgccccattatcttgacccttttttggtgcctaatacatatatatccaacttggtaggtttcagatgaaggttttcatgtgaaatcagcaatgattgttttatgggagtacagctcgtattgctgcttgccactcgagcaggagatgacacgatgcatttaactccacattattaattgggcatttgggcaacttgatttgggagttaaaataccggaggcccataatgagggagcaaaatgatcaaagtaatgccttggacgtcgtcacctattcccatttctgaggcgcagcatggcacttactaattaacattagcaattggattggtacgagttgaattttatagtacttcataagtatatttgcagcctgttgtatttttctactatatttggtgtgaaaaaaaaatgcgataatcagtatggctttttgcatctttaaatgcagtgatggggataaaaagagatcatcatcttcttctgtaagtcttttttttaaaaaaaatatggccaaatatgttaataagagcatattacagtcctattgttacaagaacgagaatgtaaaatctgttaaaaataaaacgtaaagacaccgcaccttatattgccacaagacatgcaaacacacaagtacaactataacactgagtcactgaccaaactagggtacatgcaaaacctgcgtactccctctgtgctgtaaaaacctacacagaatatgatttttttttttacgtaacagatggagtataaatgatcaaccactcgttccttttttttataccagtctcagtaagcacatcagcaatatatgcctaaaaatttatctccaaaattttgttttttgattcttgaggtgtaaaaatcctcttttcaatatatatatatatatatatatatatatatatatatatatatatatatatatatatatatatatatatatatatatatatataagttgactcataataataataaaaagtgaatcaaccccaaactaccaacagaaatagaaaaaaaattgctcacccccttcctcagcgagcacgatccctcccctcctagcgcatgatacctcccccatgcgtcactcaatcccgtgcatgggaggcggattaggaacctgggcgctttcccactagtggagagcaagaatgacgagaagggtatttttaattttggaaagtaatcagataaattgttagagccaaattttttattaaaaaaatattaaattttaggattaaaaaccatattaaacatccattggcgatgctttaattctctcctcaaagaaaactgcaagtgctcttctactttcaagtttttagcattattaaaggctggaatgttacattccattatcttaaaaaaaaaagttcagcattagctctaggggtctcatattttcgcttatgcttatgtataagccaaatttggaattttcaattttaaatttggagttaattttggggttgcttcatcgaagtttatttttcagtttttactttaaactgctaagaacacacacacacatatatatatatatatatatatatatgtgtgtgtgtgtgtgtgtgacactcatatggggcactatggtgcccgggcaccatggtatctaatgcacaaagtcacttaaattttttaaatgtgagtatatacctagttataataattcgatccatacctatacctatcaacaaaacaactcaaatttaactttatttcacaatccatgattacatacctaactaattatatgtatggatgctatatatctagaatcaaaatctaacgaaaacaagttcaaattcagttcaaacttactttgaactagttagtaaagtagttaatgttaataactaagtaatttgagaaaagttgttcatatctccatattgaaattgggtatatactcaatttcaccaatggttcccgggcaccatgtagccccaaatatatatatatatatatatatatatatatatatatatatatatatatatatatatatatatatatatatatatataatttataaattattttcttatttgtaaatatgccatgaataagccaaatgatagggcagcaggacggtaaaccacatgactgattgactgcaagagcacacacccagtaaaccaccgaccaaatggtagaatataatgtgatatactagtactagtattgttctggagagaagctaacaagatagtagttgttgataagcagtcacaaaaggacatggaaagacaatggtccaagcatgtagaagcaactcagcaacgtctctctgctaaaagacatgctttggttgtagtggtggcttaaactactgctcagatcacttggactgctcctcatcatcaaccattcaaccctccaactttggacgtattatgttcagccgcacatatgcagggttaaacccttaaaaaaccggagacatgccaacacatcgaaggtgacggctgcctccactctttgctgagactaatatagtatattaggaccttctatccaggataatagttgacctgttccctccaactcttcacttaatgtttttttttagtttgttcttctttttccaagaaccttttcttttgaaggtcaatgggactcttgaatggagattagttagacacttgcatagcttaaggatattgttttttttggggggtaggatcattattgtgagatgctatatagctttgaccatggtcttaattagctctataatgcatcatatatagtgcacttccccaccactaagcaaccagtttgcagaggatagaaattgtttccattatccaaatcttctttgtttgtagtattaatgtaaagattaatcaaactctgaagcattagaacatatggattgtaatcatatcaactcgcgatgttgctcaggaaaactgtaccaccctattccagaagctagactattctgattgtatagaatcactatgaaaatgtacgaatatccgtctgggggagacctgtcagcgcaagtgcgcctatgtagaaccaataaaaaaaaccctcattcttgactaggggcttgtttagattgatttcatttcaccccctatcattttttcggtaaagttgtcaaatatgtgcatccattttgtttcttaccaaactttgataaatatataagaaatcctaccaaaattttggtaatattgccaaaatgccagtaaggtttattttggctacaatctgaacaacccctagctttttacgagtaaattcactactatagaatttaacaaattgaaaaagtagtatttccttcgacgaaatctctgagataaatagcggagggttagttaacatcaccaaaattaggataacttacgatgaataagactagtatattgggaacgttggctggcagctgtggtgaggacatgttaacatcactgcaatttacaatataaatttgtcattactagctcttcatagtgctaaacttttgatatccagatcgatacttgatcgtcatccttgagtcctgtcaattgagttaagtaaaaaaattatatatactccttacatggatgttcgtcatctcccacattcatgcatcgatgcacaaaactacagacacttggcagataaaattttcattaactcaatagacacatgacgccatgatggtactgacaaaaataacaaacaaataaaacatgggcaaatggaataaactgcagtaggcattatggccagtgataagctcatcatccaagcacacagccaaaacaactcacaaaagaataccaactttgtatatcttaacatttcttacataacctatcgttttaacgttgttgataaactgtctgacgcatgctacattaataatcgatacagacattaactgcaagagaattttaagttaatagtactaattttctagaagaccataagggctttaattctattgggtcggcttcggatagatctatgtgacaagggtctttttgccaaagtggaaagacaacacgctaccgtgggaatataccccaatcccatacataccgttttaagctatgtgcattgcaatttggctgtgggtatgtgcactttaataaaacattggcttgcgttgaatcaaatcgcaaatgatcacaaatgtgtgatttattctgaccatacacgatacatatttttttaggtatatacccataaatggggggggtaaaatgatgctagtaaggcgcgttgatgatttccacaccacaaaagggataaataattaaggtattggaagcaagtggtatatcaatatcacccttccctcctttctctgctactaggtacctagctatataggctgggcctttttatccaggattttgtgctttaattgatgactatggttttaaggagacgtggcacgtagaaataaattaaggggagcggcgtaagagcaagtttaatagtatagcccactactagctccaatttatttatagccaatctaatagtcaattcatacaatagttacttactatattattaatatatggtcccacatgtcatacacacattgcgtcttggagtccgtgctacagctagctacagatctgtagcccactactcttctctcacatcttttatctcattaaaatatgtttatagctgactaatagtctgctattgacctgctctaatagcactctccatgtatagtactccatccattcctaaaaactttcgcggttgatcggcattgttttgactttgaccaccaataatattttttttagatggttatacaatgatgaacttaaaaaactcaagcttatgcttaggatgcaacatacttggtacgccttctttccaaatttttataaattctttggaaaaaaaaccgagtgctcaaatttcgagtaacaaacactccctatgttctaaaatataagtgcttttgggagtttacccaagaacaaggtatatgccttttgttaaataaggcatttgttgggggtaggagtttagtaggggataagactggaagttaattgaatgagggtgattattgattggacaagtaatactttataagtgtttacattttgataaaaaaattaattcttcaagtgcttatattttaaatacaagaagcattgagattattatctaaaaaaaagaagcattgagattattcagggcagtcataaaaggttactgttgttttacctaactcatcgttcgctctatgacccataatcaagtgaaaaatgaatgaaataatcaaaatgctttatatctatgacttttatatatgtgttttcaatgatttgaaaactaatattgaaaaataaagtacgataaagaaaaccttaaaaccagcttcaaattttaagtttcgaaataaaagttttggttatggctgacaagccaataagaaaacaacgagtgaggtaaatgcatcaatagtctttaaaatgcaacatttgacaaaagaaaaaggaaaaaggaaatgcaaagtagaatcatatcctatgtgtaaattttacaactcctggatttgtagaacttttcgcctaaaacacatgattgagggcaaatctttccaagggacagcatgggctgtgtcctgtgtccaactcgttcctgcaccaccgcggcacacacaaggccacgtcgacgtcgggacccatgtgggcgcggcgcgtgtggcgttgccgcgtcctgcttagagcatgtacagtgacacgctacaagccagctataaacatattttaagaagataaataagaagagagaaaagtagcggactacagatatgtagccaattgtagcacggactttaagacacagtgtatgtataataggtgggaccaaatattaatagtgtagtatgtaaatattatataaatgagctattagattggctacagataaattgaagttagtagttagctatagtattaaacttgctcttaattagcagcgacgatggagcatgcaaacgtcgccgtcgccgtcgtcgtcgtcgtccgtctttatcgattgatctccacttgaaaattaatcagggatggctgcaccgccgcaggggagaaggcttcattaattaattccacgtcgaaattaatctcaggttgggtgttaacttcggaagttggaataatcctcctgtgtagtatgtacatggaggatgatggacgccatggtccaatgggcatcaatgcaccgccatgcatggaccggcttccatttgcatagaaattgaccacccaatccagtgcacatccaaggaaaaaaggcatgatttcgtgtcaaatcctagcctgttcaaaattattgaaaaaaaaaggggcctcagatcatttaccccgaatcatacttcggctatgttttagaagcccaaaattataagaaacaacggacgaaaattttagaaaacttgatttttccaatatctacctgctaaagttcatatgccgaattctagaattattgatttaaaaaactactcctatataagattctaagctatttggagaactggagattctgaaattgcgagatactcactccgttccaaaatactccctccatatacttttgatagtcatatttcattttagcacacagactaaggataagtaattctacttatcatccatttaaatatgctactagttattcctcgtaaacaagcgattcattaatatttacatttctcgatgcccatgtagccaatcctgtgtggaagaatggagagtcacgcattaaatccgagaaagtcactaagagaataggttttggattgtaatatgcctataaaaatattttttttcagatttaaaaatatgcctatcaaaagtagatgaagagagtataaggcacaaccacccttaaccaaaagatcaagaaaaacaattattatcatctcttagtttggatcaccctaataaatactacctctatctacttttgatagtcatatttcatcttgacagacaaaggataagtaattctaattatcatccatttaaacatactactagtcattcctcgtaaacaagcgattcattgatatttacatttctcgatgcctatgtagccaatcttgtgtggaagaatgaagagtcatgcattaaatccaagaaagtaattaagatgataggttgttgaagtgaaatatgcctatcaaaaataaaattttcaaatttagaaatatgactatcaaaaatagatggaggaagtataatacatgcatccaatagaattagagatcttgagcgtgaatgatttaaaaaagtaataatttaatggagaaaaggtgctagttaattgtatgcatgtatgcatgctggaacatttttaaaaaagtagttgtgttttatattatggaacgaagggaccgagggagtatctaattatataaagtagggacaaagctagctgaactctaaattacacagatcaattagagcacacctcgtcggggtctcacgatcgatctcagtgcccgaactgctcgcttccaagttccaactccgcgcttcgcttggccaagttgggtcaggctccacgccggattttgccgtgtctgtatccatcacgcgacgcggtttgcagagcccaccaccggtggcggagaaccgacgcggagaaagccggttgcactcgcgctgttacctgcgcattgcggcggcctcccgtgctccgatccgatatacgctcgtctgatgtggatgggagatgcaacgacgtcgttgaagaggtgagtcggacaaaacagtactgttctgtgacagtttttgcctaaaaacttggtggttcggtatagaaagttttgctaataacattgtgcttgtttggccgttatttttgtggttgcgggtatagccgtgagtagtagacgccagggtttcccaaaccgccggggccggggttaccgtaccccggcggtaagcacagtaatcgcggtaaccgtgaaaaaccgtacaaaaccataccgaatttatcaaaaattcaaattatttttaaaatttatttgaatttaaagaggttaccgtggtatttatattaccgtacccccgcggtaaccatgcggttaccggcggtaacgtaaaccctggtagacatggcttactactctaaaaatcatagccgaacaacttttttttctttttgaacggtcagtctgattagacttgtcttatattgatagaagggagtttaagtacacacagctaaaggccaaaagaaaaaaaaagtacaaattcgagtgcaaacaaacttgcacgtcaactctccttacacctcatggcaacattctcctgatgtgctttatgccggtgagtcccaccatcccaactcctattggatgcgattgattatttgatggattgttgcctctttccctctaaagattcccacaatcatttttctccagatttcccaagcaatggcaagaataccgaacaacctcttgtccttgttgaagatacacatatacatacaacaacattcacttgcacacaatatacgtgtggtattatgaaatgcacaacacatattcgaggataatgataaatctgcgaactcactaaattgttattgaaatgcatccgcccacataattttactcttatataagccgtttatttgttttttttttgtttgggcacatggaattaaccagagtgccaacgacaggcacatggacgaccatcttgcgatcgaggacggacagccctgatcgagaagacatgccacatcttgattcgattccactggagtaagtggccgggcacatcaaaagggccgtaacaaatacgtatcgatttctgtacgtactggagtacttccttttggcgaaacaagatcccgatcaatataccctccatctttccgtagcaaaagaaaggtaccgaaatgtatgtgcatcagtaccatttcacacaaaattctcttgctgatgaacaacgtacaccacatcctcccagagtccaaactgtggccgcgatcgcataatatctggtgctttggtgcagctcatttttgtccggtgaggattctctactataatgtataactactattatagtcactggttgtgagtcatactctcttattgttcgatctacacgttagtgtctgtagtgatagttgtagtgacagtgatattatgatagaggatgtgaacccacttgtgtcgtacgcagtcgtctctgcatgcatccatcgatccttaataatcaacggacgcttttgacgccatgcatggcttttgagggattcgatcgcctaaataattggggttcgtatagatctcgatactgccacagattttcctcatttggttctaatcaagaattttttttgtgatgaaaaacagtgagaacaagttgattcgatatgagaatccaactgcagccgaaatatgccaacctaatggcaaaggatatgtgcagcgcaaggttatgggctctgacctataagcgcgtgcacagacgaggtatcggattatatttgtcaatccaacctttgcttttggaagttgataaaaaatgccaaccaaaaacttttgcaatgttctttgtttatactctagctttgatgctccaggtgcaagtgcatgaattcggccatgttcttttctgattctggattctagattttcatttgcacgcttctaaagctactaaacgatacgtttcatataaaatactagagtatgcaaatttttcatgggatactttttaaagcaactttttcaactctatagcagttaatttattcatctgtatatatcctcaaatggttaccataaaaatcaaataatccatcgatttcagttatcacaaacaagggccttagcagcagaatttactagtgtcacaatcaaaatgtcaaacaagccccaagtcctcgcgcatctcttccaccctttctctgtggaagaatgcaaaaggatttggcaagtatatgtaagaataaagcaggggtctctctcactcgcttgaagccaaccttcagaaagcagtagtattttagagggaattcatgtgatacgatgacgaaatttctcacacacgtaagtgacaattcaaaattagttcaagttgttcttgaaagggaaacaattcgttgccgttccaaatattacggccatggtgagctgacctgtcagttttctcgcttgatagcaacgcaacaatatatatgcatgtcaacgacggagtacaaaataatcacgtactcctactaactcttcctctaaagattgtttctcatcttatatttcgaaccttcctccgtttggtcatggagtcacctttcaagtgaccgagtcatgtgaccaagcaatgtgacatttccattcacctagctagagtcaatttcatggctcatataagatctccattttatacccacgaactcttataacactacatttatcccttaatatttgatgctgattagttcaaaacataaaaaaaatataggaaaaatagtttaagataaaattaccatatcaaataagggaatatttcctacaacagcaatggcattttttggacgttgctatttgacaaaattttgagaggagcgtaaaattaaggaaaaattggttatatagcatcgaaagttcacgttttttattttatagcaccgaaagataccggttcactttaatagcacccaaagtttaccctgttcccatttttagcacttccgtcaattctcaatcgttttccgtcgtcttgatccagccacacacacaatataatgtttctacccctcacaagtacaagtagaatgcatgttaatgaggggtagaaacgtcatatcgtgtgcgtagctagg

SEQ ID NO: 16584 - DNA, 4437 bp, Oryza sativa
  unsure (1)..(4437): unsure at all n locations
atttatatgttgtatatattagtgtagctttttttaatttgttacatgtgcattgagttgattttttcatggttttgattatagaaaatgagaaaattgtaatattgtgacctaaactttttggatagagggagtatgaccggtgaaatctccaaaactactgcagggtaggagtactcgtagtacttctaaccagcctgaccacattcaaacgcacagtagtacagtacttggaggacattcaagtcacagtacacaaatgtttccagcacaataaaactacttggaacagtactgtgggcagcagctctttgcaggccgcaggcgagtacagatggaccctcatcgaaacgaaacgaaacccatgccaagaacctgcgtgctctttgatgagccagtcattcctcgaggcatcttttcatcagatcagaattcagagcctcgcgagaaagaaaggctggcccaatcctgcagctgcacagatcccagcagctgcagctgtagctgtagtagtagctgtagtcgatcgacagtgtccgagccaatccatcgccgcaaacaagccaaggggaagaaatatatatagccctggccacgtactacgtactagcctctgccgatctgccatgggcgctagtatagccatgtgaccgtgcgagagtgcaagtgatgggtacagacgttgttagcaccaatctgggaggcttatctccaaacccccaaattctctccattccattgccgtccgtcgtgtggctgccgcacgctggaggggcagcggcaatcgctagatttacgagggtcccacggcgcagtggcacgacgacgcagcaccgtccgggattttcaacggcacccgaacctgggcgtatcaatcgctttgtctcccggaaaagagaacgacatgggatcgtattaccccaagcgtcgccgatgatcgccaaaagtcaaaaaaacgtatcaccgtccaccgaccgaaccgaggtcgctaccacgtactaccagtagtagtagtagtagtacgcggactcgcgaccagccagccgctcgggttgtctcctctttttttttttttcttgccgggatgggagcgtgcaccggtggctgcactcaccgtcaccggccagtagtctaggcgccacacgaagcggcggcctgcgtcgccgaaaggcgggggaaaaccccgaaaatacaggagaattctgcgtttcccgcgggcgcgagagcccgcgaccccgcgcacggtgagacagggaccacgaccccgcgcgaactcccccttcaggtggacgaccaacccagcccagccagccgcgcgccggtttgtggctttgccgaatccaacgcttgcacacaccaccgcggcgccgtatgccgggtcccccacttgcattccacccggtcgtcgcgtcgcgtgatcgcgtcacgtcccggcgcgccaggatacgggtgcttggctccgcctccggcttattatttaagcacgcgacgccgcggccatgtctagtctcctcggctgctactactactgnnnnnnnnnnnnnnnnnnnngcgacccactactgccctgcgtctgcgtgtgccgcgtatacgcacaagccaaagagaatttttaggcgggtagaaacaaaaatcagacccagtttcgcgcaaaaaaaaaaacaaagagaagcccgggggtaagagagagagagagaatttgggagatgtgagacggaagcaacaagcacatgagcgttttgtgattaggaacggacaaaacaaggtcataaggcggcctaatcaggattggaggagaggtctagtctccctttctagtttcccctacatgaccagcgttgccaccaggattgccacgctcgtgcgggccgcggcggcggcgagccggccattgcggctccaccgccggcccggcggcgaggatacgaggatggtggtgatcgtcggcgccacgggcaccgggaagaccaagctgtccatcgacgccgccaaggtgatcggcggcgaggttgtcaacgccgacaagattcagctctatgacggcctcgacgtgaccaccaacaaggtgagcctcgccgaccgccgtggcgtcccgcaccacctcctgggagccatccgccccgaggccggcgagctcccgccgtcgtccttccggtccctggccgccgccacggccgcgtcgatcgcggcgaggcggctcgtgccggtcatcgccggtgggtcgaactccctcatccacgccctcctcgccgaccacttcgacgcctccgctggcgatcccttctcccccgccgccgccttccgccactaccgcccggcgctccggttcccgtgctgcctgctctgggtccacgtcgatgaggcgctcctcgacgagtacctcgaccgccgcgtggacgacatggtggacgctggcatggtcgaggagctccgggagtacttcgccacgacaaccgccgcggagcgcgccgcgcactccgggctgggcaaggccatcggcgtccccgagctcggcgactacttcgccgggcgcaagaccttctccgaggcgatcgacgacatcaaagccaacacccgcgtcctcgccgccgcgcaggtgtccaagatccgccgcatgtccgacgcctggggctggcccatccaccgcctcgacgcctccgacacagtccgcgccaggctcacgcgggcgggctccgccgccgagtccgcctcctgggagcgcgacgtgcgcggcccaggcctcgccaccatccgcagcttcctcgccgatcagtcaccgccaccgcgcagcgagggcaccaacgactacctgtacgccatggagacggaaccagagccgccgccgccgccgacgttgccgccgcggctgctccggttgccgcggatgcagtactgcgacatggtggggtgagctcgccgccgccgccgccgccgcacggcgccgcagtcacttcattgaaggcttttgggggttcgagggtttaggccgccaattttccagtgtcccggcggcgcccttctctgacactgctcggtgggcccagaaaaagtagccagtgacatagaaagaagagacaaaggtaattaacgtagagagagagaagctaagctatgcaactgatgagaagtgttcttcttcattgcagcagaatttgtgtactctttcttggagaggtggtgattcatcacatcgctctcctcctaaccgcggcactgtatgtatgtagtgagtagtactaatcatctaattatccaccgtgttcagaattttgagacagataatgagtacagtctagtatatgatttttcatcagtgtttgttgcagtgcaacgggtgacctgctctatttccggagctgaattttttttggtttggttttgtttgttttgtttgtttaattaatcctcctcctgctgctgctgctagtagtagtagtttgaggtggctaatgccatggtggatgcttgacatgttccatccattttccagctggttgttgttgggatgattggatgggtaatgccacgcttagtgtgtgattactgatcgagggggagaagaattgtgttgggcgtgtgggttggtgcctggtgttcttgctgttgccagctaggaacaaacaaattcgtccccgtctcctactcttttttctttctttctttctttctttctttctttctttctgttttttttcttttacccctcctctccagttttcccgtacggtcaaagagctggaattcagtggcattacgattttcactctcttttggattgttttctttcttgtttggattctacagcagcagtctaccgcatcagattttcagcatcgttttatactgtcgcggacttcaggcattggatactcgcttccagaagtttctggtcatttttttctttttctttttcaaaaaaaattgcacttcacatggtcggttggtacgcgtatgtgtacgttgtatgcagagttgtacattgttttatgcgtatgtataccttgtaggcgacacgtccgacataagccaggctttttatacacagtcatcgatcacctgccctcaaatcgccatgattagcagcaatgcaagtactgtgttttgctcgaagcggttctactgtaatataatgtcgcagtactataccactgctctatggtactgtactccctatttcagtatactccagtccagtacttttgcctgtatcatcgctgcagtatacgaatgccaagtctcctggataatcgcaagtaagtagattcttggggacggctcggcccaaatagaatgcagcatcgcaaccctgcagaagcccagcaactgcagtcaagctgtcatacggctatttcactactcctttcatttcatcctaaaatatactccctccgtttcacaatgtaagttattctagcattttccacattcatattgatg

SEQ ID NO: 16585 - DNA, 11656 bp, Oryza sativa
atttatatgaaaatataagtaattttgtaatcccaagacagtactttattcctcacttatcatcttttatatagtttatttttcacttatcaccttttgtattgatgggtttcccgtctaatcacttttttactactttgttcttccaaccatttgtatcgtgatttgttcttttactattatcttaatttttgtaaaaacaaatagtagaatcccttatattcacggacggaaggagtacttccttactagtcagaagggattgaaccggactactagttgtggttaacaacagaatgatagacctgcgtttgggctccgtcatcattagctttttgcatttttacttctgcttattgaaatataattggccaatttagtttgaaaaagaaaaaagaactgacgagcaaatgcaccgttatttgagccaatagactgacagagtatcagacagtttaagtgtgctgggccgcgtcagccttggccaacaatttcatatcctctgatcgtctcatccaatagtaggaaaggatgttcacaagagtgttcaagctacgctctaactttaccacatgaaggattcagatatcagaactcgtcactgtttcttgacatgatcaaatttcgtactgtgcaatatcacttccaggctttgcctccggcctattttgcaggattgctgtactggatgagacagtcaaggtatgggccagactaacgaaagggcctctcagtctcatccccagcctttcatgtactgcaatgtggaacatcaactgtaattacagaacacttgttgtacatctgagggaatgttttgtgctgttcttcccaatccaattgcaggagttagatatttggaagcttaagatagtcaatggatttctaaaaattacaatgtgtctgaaagattggtcaggctatccccttggagtgtgatcttgatgtcgtgtgctgcatgccacacgttcagagaaacattccccatgttggattttttgaaggttctcacatcaccaaatgaggcattcagaaagtacagtaaagtcacatctcgaggatgacaaaagacgttcgaaggataattgggtagggagttggcacaaatgtacactatctcatcaacgcagttctgcactagtttgaacaaacacactctcttgtgcgattacaacaccagcgacatgtccatgaaaaagaagagaacggacacgtccaaaaggcactcaacaatattgctttcgccaaaattcatatgaattaatccagcagatattttaaacatgatcagtatataggtatgctaataattactagtttcagttagtcagtagccacaagaagcaaatctggactatggagaactggaacggctggaagggcgcactgatcatgcatcaagccactcaagagtgaagaacatcatctagctctagccaaacggcactacctgtcaggaacaaagcctggagatactgatggttcagccaaaaaagataagcattttacctgaaaaataactcataaacctaacatggaatttctgaaatttgatgtccacaggaccacagcagaagtaaaatgactacttgtaccaccattctgcgtctgcaagagtaaaacattgacactacaggctggatggagacccgcatcagacatataatgcaaaccactggaaccaaatcaaccaattatgtgcaacatgtaaaattgtaaatcgtgaacatgaagcactattaagttttaactcttgatttacaaaataaaaaatcaatcataggaaatgatcagacagacaaaattgaagtcccagactcacctgcagcctaaaaacaccagggcatactgtcaatcaaataatccaataacaccagctccgaacacaaccgtgcataacttaaaaacctgattaccgactcaccatggatgtcatcagaatactaaattagtgcataattagattgctaagtgagtatggaaaaaggacgcaatgcaacaatcaagcagtctttcagctcctgcatagtgcacacaggtacacaactggtgttccaaatgtcaagaacgataagcagaagttcaaattattaatgcacttagcaaatcgttctaataagcagtgtcaggatatgactagtgaacacttcgtctcctccaaaagtgcaaaacagagatcagacgaaaaacagaagtatcagcattcgagaagcaagaatgatgtgcaccagcttttgcaaacaacagaatattgcaaaatgaacaaatatattgaacaaaggtatatgtaaaaatgaacaactaattctggaagaggtaattaatgccagctaacacctttcttaattgaaaattggcaatgattttgccgttctgttaaaaaaaattaatgcaagctatacttacaagcaggagattataacaaagcgcacccttgataactagtttgatttcctacctgaatttcactagctgagatttctttttctcttttcaaaccactttgttgcaccccaagtacactttcattttcttcggtatcaatgtccaactcaagacatgatatatgccctgcagagaaaccaaagctgcatctttttccctctatctatgcaatgcagaaagtagagcttaatacaaggaaatatcatcctcactaacactacaaaaccacatagtgatatcacagccaacaacttgcagagttgaagcgatttgcaccgaaagaaatatttcacagactgaaaccatgtacataacatgacagctaaccaaacatcacaccacatatgccacagggcacaaacatcgcatacgattccacctttcttctaattagaaaacctattcacaatcaaccataaaatctatatccatcctctgatctagaagaaccaacataattattggatggacatgttagccgtcagaagaaaaaaaagcaaaacatgggaacatctgaaaagttgctctcatttgcagacttcaccgcgctggcgccaatcacctctgcaagaggaaaacacacatgaagaaaagaaccaaattttttgggcgaaggaacacatcaaacgtatcgagcgatatctcacctcctcgacgatcttgtacgaatccaggttcacgtccgccagcgataatccgggatacagccgctgcaattcgaaccaaaaccgaacaaaaattgagcaccccccgatcgagacccaaaaattaggaatcatgaagcgcacgcggaggctccaaaatccttacatcaagctcgagccgcacggcgcgcgggcgcttcttgggccggcgcggcggcgccgtgccgcggatggcgatgaagtcggcgacgatctcctccctggtgagcgcaacggagaagcccctcttcttggcgaccaccggcaacggcgcaggcgggtgcagcagcgcctgccctcctcccgccgccgccgccgcctttttccccgcggcctccgatctcgacgcgtcgggcgccacggtggcggaccggcgtgtgcggaggttccaaggccgcgacggccgagaggcgccgccagcggaggtctcctgccccttctccggcgacggggtgtgcggctgcttcggaggcaagccgaaggcgggagcggagtccccgtctttggagcagcggaggaggcgatgggtgccccaaccgaaggtggtcgggaaggagaagctgtggaggcgagtgcgggtggcggagccggccgggggagccgccgagggggaggatttcgcctgcgccgtgtggtggtcggaggcggcggcggaggcggaggcggccatgaggaccatgagaagagggaggtgaggtgaggtgggtgcgaggagggaagaggaagaggaagccggaagaaagagagaaggcgagggtgatgttgcgggtcaggttttaaaaaagagagagggagagacgagacgagacgagccgagccgtgggcgtgtgggcgtgtggcgtatgcgttttttttttgggtttttccccgtctccgcgctcggcgcctcgtgtgattctgacggatggatccgtggatgggtaagcggtggcggaggcggtttttgggtgcagcggcggggccgcgattttggtggtgatgcgcgccgcagccgctgcgtgtgcgggagcgcgtcgtgtgatcgccttggggcggcgcgagcagggggcggacggcgcgcggccccgtcggcgtcgtcagaggttcggtggttttcgggttgctcctgctgtcaacgaggtacgattgcgttgcaacagacggttatctgacttattgcgcggattatcttacgtggctagcttctttgtttttattagggacgttcggctggcttgctgtacgtgacgtatatgtttttcttttgaatagcgcttagtgtttcttcttctcttctataaaatacttactgttaatagtttggtatagtgttttctatattgtataaaaaaataataaatcatggtaaaacaggttttcccgcgttttctttttcaaaacaaagtactaccttcatcccaaaataagtgcagttttgcactatttgtgtctcatgtttgaccattcgttttatttgaaatttttctacgattaatatttttattgttattagatgataaaacacgaatattactttatgtgtgactaacttattttaattttctcataaaatttttaaataagacagacggtcaaacgttgaacacggattcctacggctgcacttattttgggacggagagggtagttcacattacaaatacaacttacgagctataatgcctttatttgggtgagatcaccattcccgtaaaatcttaagcaaaatatggtgttctaaacattagttgaggagaactatggcaatttaaagtggagatcaaaatgagttcacggcaagaagctaacaaattaagaaagtacagcgcaccatagttgtcaaggcagacttaggccatgggcaatcaattgggtcacggtctggggccccaaacctgtggtaaacatataatggacaattatagatttttatcgtgtaaaacagatgtgcagcccaacatacataatgggccagccctagccttagtccatgttggtttcgctccctaatggttatgggctatgaatcaaatgttgcattgtggtgttattacaaccattttatgttattagctaaaagaatgtagttcttgttgtaatggagctactactatcgatgtgggtgttgctataatacactcatcgtctcgatgctatgagtcgctatgcgcaacactcgtgatcgtgtcattggcatcacgagacatagggccttttcactttgttgcccaaattaaccatttcaaattttggtaatgccaaattttaccacattttggcattaccaaatttttggtagaactagctttgtttggtttgatgtatttgccaaattttgtatagttctaagagaggaagcttctagaactgcagaaaaattggtaaagtagtaatggttgaagtatgtttaaagtagtaagaaggctaaaagtggcaacaaattaaacaagcccttaagtttttggttctatagtctagattgctttttgaaaaaaaaaatcaagtcaattaaaaaatatgccatgcaaaaaattaacaacaccacacagttttggtgacgacaatatcaacaagcaccttttgtaatttaggtgttgtataagtttttgtaaagaattctttaatttgcttatgttacttttatggaggattgaaagataaggatagaagtcagacgtataaattaaagcttgtaaggatgctagtttaggtaacgccacgctagagatatattggaagcaaataaaagcacacgtcatgtatctaaatgtatcctagagatgtcatccttttttgttctttttcttgtctcgttgaattcaaaggtaagtgttcatcatttccgacctttacaaaagcctaccaagcggacaacacagatgaccgatggggcatatgactatgtatgaagaacgtgaacctttgacaagttttgcctcttttttttttgaaaaatgaagtaatgttttagtgatgccagtttctactgttgtcgagatggtactcattgttacactatatatatactccatttcatagttacaagttctaatggcttgttctgtgaggttagaactcccataaagtcttaagcaaagtgtggcgttctatactagcaaatgtttctttagaacatggtaattcgaggtggagaaataagttcatgagaaccaggctatgttgattaagaaaccgtagtcaatcatggtttgtggccatgaaccaaatgcttcatcacaatgttaagagcaatattcttagccattttatacaagcagtagctaaatcaaagttgttcatgttgtaatagagttacaaccgaaaagatatggatgttgatataacatactcaccattctctggctatgagttgctatgtgtaacacatgattgtgcctatgacatcatatcttaagttttgattgtacaatttaaattgttttttctttaaaatgcaatgcatgaaagatgtggcaccgggcagttttggtggccccaatgttgactcgcactttttgtaattatgtgttacatggtttcgtaaagagtgctttaatatttgcttattttactcttacggacgtctagaagataaggatggaagccagacacgtcaattaaagctcgtagggatttagctcagttaacgccatagataaattggaagcaaataaaagtacacgtcatgtatccaaatatatcctggagatgccattcttttaattccttttcttatcttttagaactcaactcgaaacgtaagtgtttgtcgttccagcctttaaaaaaggctatcacgctgacgatacaggcgaccgacgaggcacgtgacacgcctacgaacatcataaacctgatacggatgcatacgtagacacatttcgtctgatttaatcttatgacaagaaaggtaaatacatgttcatactactcacatgtctcttacatactacaagagcaaatatctccgatcttttttctttaacaaagatgaacataaaaactggtaaacaaaaggagagagagaaaaaaaaaggcaaaataaaccggtgtgggcaaccccttcctcggccaccggatcacaatccgacggtccacacgggccatgtggctcgagaaacggggcaaatcggcgaccagaatccgcgggggcaaccgaaccgaactcccgcacggaggcggcgcggcgcaggagcacggcggagcggagggagtcggagtcgcgtccaaaaccaaaaggaaaccacggcattttcctcgctcccttctcttcttcctttctcttcccccacccttctctactctctcttcttcttcttcattccaatcgaagaagagaagcgaagagaagagggttaatccgcgctatatatagccgcctcatgcaatcgcaaacctaagctgctctgctccgcggcacacaacacgcattctggttaatcccctctctttgtctgcgcgtgtggttttcttgccaatggagtcctcgccggcggcgacggtgaccccggctgccgcagcaatgtcggaggcgccggcggtggcggcgccgaggccgagggaccctgggttgttcggaagcttcgacctccccgccgcctgggggtgccgcaggcccatggctttctgcagggaccttgacgccgccgccttggtcggctccgaacccaacgccgccgccgccgccgctgctgctggagacgccgtggagcccaagcgtaacgcctcccgatcgccgcccaaaggaggcgacgctcctgtggcggcggcggcggcgcaggaagctccgcggaagcagtggaacctgcggtatcggaagggcgggcgggacggcggcgaggacgcgctgcagaacaagaagctctggaacatggaagccgccggcggcggcggcggcggcggcgccagggcgagccgcgggttctcggtggagctgacgcgccaggagatcgacgccgacttcttcgcgatcaccggccggaaggcgccgcgcaagccggcgaagcggcccaggagcgtccagcgacaagtcgacgtgcgtgtgcagccatagatggagcacgatttcttcatccgccacccacgaattctctccttcttcttacttcttctttcgattgctgatcacttccctgctttctcttctccgcagtcgatttgccctgggaactcgctctgggaggtgagccgcgatcgctacaaggtgaacgaggtacgcacaaaagtccaaatctttcatctctttcgccactggttctgggagatttcgagttggtgaattcgattctgattcctgaactgctgcagaaggggggattctgagttgctccaagaaggaggagatggattttccgagaagcaagatcaaccattggcttatcgtagttatagacagagagagattcagactgtcagtcagaattgtttcagtgcatccatgcttatgctgttgatgatgaatcttgtgtagttttttacctgactgttggggttttgcttctcgctttcgtgaagcctctgcaaactcttctttcttttatgcctagttcggaaacagttaacagaaagaatttcaaactcttgatttctggatgtgagacatggatacatgataggttcttcgttaattctgggtggtatgaaatctttggcattggcttcaatccggtaattctgtgttgcatctcgaattgcagttgcagttcctagtagcttaggagtagaacttaaccaggtttatttatcagttctctagtttttgccagaaacacatatcgatttcttccatgtcggtcttccctgtcttttcaggtattgtacatgtctttcttgatttttttttatggattggcttcctgctttttatcagtatttggttacttgaccattcacttcagactgaactatgtttttgaagaaagcagaggattcatgctcagaaactgaagcagaatcacttgaaatgaatgttggattcatgcgaactcaggaccatttgactgttcaaacagtactccagattcatgctgagacttcagaggaaacatttacccaatcaggaaaaaaaacgctgaggtttcagaatgtgtaaacagttccaaggagaggggaaatgacatgagtaagtccaaacctcatgatttgccaatcattattctggtgtactcgaatgttttgctacctttggtattgattgctgaaagtgaccccttaaactatgacattacagatcctgggttttacaacccttttcctttgtcaactcttttctgtagttcacttttatcatttgtgcttgatgtcatagtagcacattgatcttgtttggatgagctcaactgaaaaggagtcaacgtgtcccttggacatttattttttgttgcaacgatggccttgataagctagttgtgggggccaatatatgacatgcgtatgcaatattgtgaatgtgtatatcttatgatggtactcgtgatcctaagtcatgatagtacagaagagattggctaaaatttatgagtgcagacaaaatttaatccttgatcgactctaattagttcactttggactttcggatggttttttaagggagtgaaagaggggcagtttaggcatagtccttcaaacaatttgaatgtaactctccttttttttttctatgctagaaatgtgttttatagctgtctagtgtagtctttctatagatgatattcctacgtcaacagataccctaattgttgcatatgctcttatgaattatctacaatggattcacaattcactctgttcctaaatgttgtttatgagatgctgcttgctaatattctattacatgctcgctacagcggatgaagcttccactagcacaagtgcacaaccgcacccatgatacacagctcttcaactgttcatgtctgggaaacatgtgctcctcctcctcatttcctgaatatttcttctcatattttttccaagagaatatgcgggagagtgcgttatcttggacaaacagatctatttcatttattcagaattaaatcaagcagacacttgctatccctcctttaattgatttcaacggtcctcattcagaaaaagatttagacaatttattgcctgcccatcataattaagctgagatcctgcttccaaacagttctttttcctctcttcatttattctacttttttgctgttttgctgccgatgagatcggaatgaacgattctcctcatgctgctctgcattcatccaaacttccaaagtaacagtattaaagtaattttactaattctttgtttcatattacatgttattttgactttaattaagatagataaagtttatagaaaattttagcaacatctacaacaccagtttagttttatagaaaccaatatttgatacatttcaataatatgatatgtttgttttgtattaaaaattttgttgtaattttttataaacttgatgaaacttaaaaatatttgaatagtaaaaaagtcaaagtgacttagagcaaccatactgttgcaaaaaagtagccttaaggtctttaaggtgaaccataacaattatggtattgaatatagtctaggccacaacaagaaataaccttggtggattagttcttttattatagtgtgctatctttatacattgtgaaaattgaaataacaagagtccagttgtgtgagttctattttatatgactagttggtccatatatattggtgatgtactaacaacgatggtcaattgctatagggtccaccttaatgctatgttgtggcaataaatattgaccttgcccttataatatgaaacggatgtagtagcgctagagaccatttggttaagtttctcatacaccagaaaccaatattcacaattggaaaacccgacacctgggtcggtgcttgcgaactaaatgaatttccaaaaccgcggaccggggaacgtaccgggtgtacgatttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtttgtcacaccctgaagttctcctcctaagcctaaaattgaattaataagagaccctaagaaaataccggtgcaaagcaagagtaaaccctattaaatcaatgcaaataataatcggaattggcatgtggaatttttcttgagttctacatgtcgaaattcactaacaagatttttagtggaattttcagagctctcgaaataattttaaccatttaaaatcgagcatgcaatattttaaatcccagggaaattcttttcctccttttctttttttttccttttcccttcttttcctcttcttgggccgtgggcccagtccaccccgccgcgcgcgccctccttcttgtgggccggcccaagccgcccctccctctctccccgggacgccgacaggtgggccccacctgtcgggcccgt

SEQ ID NO: 16586 - DNA, 4939 bp, Oryza sativa
  unsure (1)..(4939): unsure at all n locations
gccgtcgcctccgccgccggttgctgtcgccggcaacgcgttcgcgcgcgcgcgccgtcgccatcgccgtggccggtgggccggccttgagccaagccgagccgggtcgccgccgcccatccgatcaaccccgagggtgatttgggccgtcggtcccgtggaccggcggtggaccacccgcgtggtcccggtccacggtgaaccgtttccccccttgagtcgctgccgagtgggcccgcttgccggcgcccctttcctccctctcccgagccgctgaccggtgggccccgcatgtcggcgccgcgccttctcccccccgtgctgacatcagccctgggatttattgcgcaataaatgatttaaggtttttcttttatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgtaatgtttaccttgtatgtcgctagattccggttcctccgacgctccggtgtacttcgaaatagtcgccgaggttcctccagcagcagagcaaggcaagtcatgcttgtcacttgaacatgttgatcctatatcgcaaatgctctattgttttccttcaaatattgcattgttttataatgtttctatggggtgtttacctattgtcatagccatgctattgttgtaccatgtctctttgtcagcttggggtttaacatgactagagattggactagggattgcttagccatgtttagctcanctagtgcccaatggggggaatccaattaataaataaactgttggttctaatggtaatgttggattagtgccaccgctttggtgttggttaattaaaataaatcacatggtgggctgtgggtgcatggttttgctggtcgcaccaatggcagttaaggaccggttcgcgggatgccctggaagaacttatcgtacttaccacaagccagcgtgggcaacggttgggcttgtagcgtagctttcctctagccgacgcatccaggcaagggtgggcatgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacgggctctttccggtatgtcgtggtggcatgtcggcgcacggaaacgtttcgtggggctgtgtcttgtgggtacagttgtacacctttgatcagagtaaaactattcgaatagccgtgcccgcggttatgggcggtcaaccagattcaccgtgattagtctcaccctagtgtaatcttttgaatttggatggtttagttggatggttgggcctgttgcaacgtgggatagcgttggacagtggatagtaatattaattaattattaccactgtttaaatctttcaacttctgcttttaaatgctcgctttatgcaaatgaaccactctagctcttctttgataattccctgcatcatacccctattccggtatgatttgctgagtacagtgggtagtactcggtcttgctctacttttcccaaccccagagtacgagtatgtgtcagatggaggtttctccgaagagtaggcttcgtccgtgccgtcgaggatgcctgtggagtggtgttcccgctgcagttctagtcaaggcttagctcctggtgtctttctttttttccgctgcatttatgtaagacttttatgatgtttataagacgtggatctgaatgtcaacattgtcgtttgtgtaccccggccggtcctggactgggattttaatgcacattctgtttggaattctattcgggaatttctgggcgtgacatgtcggggaggacccctgggcttcctggcacagtatggtctgggacctaatctggtgttggtctgggactcctctcgttggcatatggtgaacctatgtcggctttcgaaatgccttgtcatgaaagccttaaggtctctagtcgtggccgttctgcatggactggatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttgtgaaatttgctgttgtggaatgggtttgatgtttggaaaatctgcggctgatgggatcagccaggcccgggtggccgtttgaaagctgttggccgggtgccaatcttgatcaattcaaaagactgaaacattgcacatactccgaccggacgagacgcactgtctcatccgtgtcgtttgagaagcactcccttagttgtttcagaaaagagtttaaataaaatcaatcgcaaaaacaacagcctttctttgaagcctgcattaaacacttatttcccatggcttgctgagtactcctgtactcacccttgctctatataaataatcccccccagttgctgaagaagatgaagcggatcccgctgacgaggagttcttccaggagcaagccggctacgatgagttttagggtttcggcctagttcccaagtcgcgcctgtgatgtgtggtccaagtcttggcttccgtttcccttttgtaatgcagttgtgagctcgggatctgtccgcagtccaacatgactgtactcctactctataataaagagacctctgttgctgtgatattctgtcttcctgtgataccagcactgtttcctgggactggtatcgattaacaggttaatttggagcgtcacgggctagttccgctcgggactagttcggggcgtgacaacaatactgctacgatacggtaacggtaaccacgtggtaactcaccaaattcaaacattttttttcaaaaacaaactcaattttttgataaatcttgttcagtttaatgtgagaaaaaaaaagaaaatgagagaaaagagaacattttgaccagagatgacgcggtggccttgcccgggatatactatccccgttgaccgttcctccttcccgtgcacgtgttagtatttcaccaacgaacatgcaattcgccgatcgcccaaacaaagccaaagctttggaaagttgacgcttccacaattcaccaccatcgcgacgacaactcgcacccccatcccataaaacctctcgtacgcgacgcttttcttcccttcaactcctcgtttcaggcgatcgatcgatcgatcaaccggccgtgcggctgtgctgtgcttgcagattggtagtagtaaaacatctgaaggaattcgcatttgaccggagtacgatctacctgaggttagaacaatcctctcttcatactgagctactactagctggcatggttcaatttaagatactgatagtacaccacgtactcttcgaaaattactcgtgctactgttcaatcgggcaagtacgagtatagggagtatggttggttaactgatcaattcaatgatcaaaacatcactttcctttttttaaaagaaaatgaaaaaaaagactgcttctgattatgaatatgaacataatctatattttcttattaaaaaaaatgaacatagtctatatttggttttgtatttattttttatgaggccgagagtgtacagacccatcgtttctcttaataaacgaaacaacatttcgcttaataaacgaaacaacatatttgcaaaagaatagtaatttgtaaataaaacttttatatacgtattcgtagcgatctaaaagtaaaagctggaaaataaattttgatgaaaaaaaattcaaatttaaggttaataatttaaattttggttgacaatcataggcctgtaatctcattgcagtgtgactagcagtgacatgacaagcgtgcaaagggtgccaaaaagcttgtgtgacttgtgggcagcaacaagcaacaggactagagcatccaggagggtcggagtgcagctagcgcagtgcagtgttgtggctgctgccgctgtcactggccggtggggtcccgcaccgtttgccgcgccggggaaagagtagaccgagtccaggagcacagggccggacggcgtgaaaccacaccatcaaaactgacacgccgggcccacaccgaaaatccgatcgtacgaggacccgtgccgtgctgcatggacggacggtccggtcggtccctgacgcggtgggccccacccccaccccccctctcgccctcacggacatggctaacgccagtttccatccccgtttggtgggctggagattggcctcctcgcccgcgtggaccacacgtatcgcccctccacgtcgatgacttgtgggaccctggtgatctggggccccacccgtcggtgggagtaaaagggtaaagcgggtttcggatggcgtaaacctcgggcgccccgagtccgtggcatggaaatgacgagaatgccactcgggcaccacacgccacttcggcgctgcgagcgacggtaacaaaacgcgagcgcgaccccacctcctgtggcctcaaaaccttctctgccttttctctctctctctctctctgccgctcgtcgactcggccgccgccgccgcctctccgagcagcgccgccgcggctggtgaagacaagcagggccatggcggcgacggcagatccgcgggcgaagccgcccgcggcgacgtcgacgcaccacctcgagccgtgggggcagccgcgaccgcgtcggcaactcccgcgcaccgcttgccgccgacggtgctcccggtggtagcgttaccggcgggtggggacgccgccacgcgcgatcgtcgacgctcgtcgtctc

SEQ ID NO: 16587 - DNA, 9998 bp, Oryza sativa
gccgccgccgtgcaggtcgtcgtcggcaaggatcccttcgacggtgggatcgaggagctccgggttaagctcatgggccacctacgagacgccgccgcccgtctccgcgtgccccagcctagccccccacccccgccgcctccgccgccgccgccgccgacgacgacgacgaagcccgagagcctacccgcggaggcggactcggagcccgagctcaaggcgccgcctccgcctccgcctccgcctccacttctccccatggcgcagccgcaagccgacggtgcagcgaggccgtggaaccttcggcagcggacgcggcggcgcccagccgcctccatgtcgtgggcggcggcggcggcggtgccggtgccgtcgtcgtcgcggcgccggaagcgcgcgccgttctcggtggcgctcacgccggaggagatcgaggaggacatctacgcgctgaccggctcacggccgcggcggcggccgaggaagcggccgcgcgtcgtacagcggcagctcgatgtaaggcgaattccccacactacccctccccctccccctcccaaaccaccattatttaattaatcacccaattagccctcctcttatttattccctcgatacaatacagctttaagcgtatgcttagacttaatattttattaaacctaaattgttgtgtgcaagaatggcactcctgcaatccaaactcaaactcacagtggttgctactgtttcatgtgcagtcgctgttccctgggttgtggctgacggaggtcaccgccgacgcgtaccgagtgccggacgagtagccgccgcttgctccggcacgacggcggcggccgccgccgccgccaagatcctccaaactttgaagaccccacctacctcacctcaccaccacatcgcggctcaagatcgagccgcgcccggatttataactgctaggactactctgtcgcgtcgagccggtaggtgctcgtgcttttgtcatgtctcaacttcagttttttttttcttcttccttcttcttcttcgcttcagcatatgttgttttcttttctcttctttttgttttttttttgtacagcggtgtgcttgttgtaatccatctgctaattcatcctagtacctgtacttcttctcatcgatctgtgtcgctctcgttatcgatcagttcttcttcagctctggctgtgcccgtgctgctgtggctgcttacgtggctgggttttgcgggttctggtccgggtccatgctttttcttgggggctacccaatggataaaaatatccggggagagagagagagaggggattacgtgacgtatttaggctcttttttttcagaaaagaaaaataaaacgagagaattaggctgatgggccgggcattttttggattctttggacccctcactctcctccactggggtcgacacggcacaacacacagtagcagcagtagtagtagtatcatcaaatatcaaaggcgagcaacgctatcattgcagactgtagcatttcaagtggagcgaaattagctttgcgttatgtacattattagttagcataggccgctcgaaaagaaagggattagggaaagcctttagcatcgctctttctgatgcaatcatcgagctattggtgcctacttccagcactgctatctagcgatgctattatttgtctttgttgacatcctaggtcaagagacgcctccatgttttgccttttaacttatcagccacaaaaaaaatagtattaaattttaaaacttaattttaaacttactttaaatctgttatcattatttgttgattttcaacgttattccctcagtttcatacttataatacgctttgacatcttttctaatcaaaccattttagttatgattaagtttataaaaaaattaataacatctataatacaaattagtttcactaaatctaatattaaatatattttgataatatgtttattttgggttcaaaatgttggtggtattgtcttttttacttaggagaaaatcaaaacatcttataatataatacagactggtactataggcaattaagcaattaagtacgtagatataaaatgtttacatataaattaattttagttgctgctataggccgaacgatcagaccggcctttcgctcactgtcacatcgtacaaaaacgcacatgtacatgcatgaatgtatactcgagtccgtacacatatagttatatacatggtcgatcgatcgatcgatcgagtttaaacgcaacattatgccccattaaaagggaatcaggatgtgtactttgtggcacgatgttgtcgggcccacgtgtcagggttaagccggtacgtgaatggcaggaggaagagatacgtgcaggcctggccgggaagggggagatgggcccgcttgtaagtggcagtttgctcggcctgcacgaccaacgcaggcttttgaggctgcatccaggcccaccccggaataataggagcgtccatgcgattcaaactgcagagagcgccctaatgtgggtctgacggctcgaggtcggcttagcaaccgttcatcgcagatcggacggccgatatatgccggtcaacttttttgcatgccttcactttgttttttgattcttggccaaattggcccctattcatttttttccaatgtggttaaattgatgaatgatttggaatatttgagtgggatgaataaattaaatattacaaagttgaaaattagatttaaaacattttcataaggattcatttatataaaaaaaattataaaaaacatcgtttaagagcctaagaagcgtgcgtattcatacatcattccatatttccattccttcaaaaagaatagacagtttgtatactactctcttggcaggcagtcaataaagttgtcaaaaaaaacctgctcgtgtgcttaattgtgaaaaagcaaaatttgaacaccttcctccctcttctactgattttcggcaatgaatttttccgagatcctctctctgatcactctttgtgatgaatttgtaatttgtaaatggattataaagtttgttaatgaatttgttgaatggattatgaggtttgtgatggaagttgtgattggtgaatggattatgggtggtaggggattttggaggatttgctgattttttttcgtgccaaaaatattttgtgtcgcaggtgggttaagcatttcgtctgttaatattgattttggcaaatgttgctttttagatacctgtcagtaaaaaatatagggagtagttatatttatggcgctatattttttaccaaaaaatagtcagtatgtatttatattgtaagtccataaattacatatataattttagtgtatttataatgtaagtcctaaaattacatatgtaagtctctaaattacatatgtaattttagtgtatttacaatgtaagtttctaaattacatatgtaaatagtatgtaatttaagtgtaattagtatgtaatttcaattcaagccaaaatctttgctcgatcagttggtcagggccgctggacaagtcagatcctaggttcgattctttacagtacaattttattttcgtcaaccaaaatagcacgaatcctacagttgatctaatggatcagaaatcgacatatttctaaagaaaaatgtgtcgacagttttttagactttccgaaaatatatttttgcaagtggctaatccttgcttgtgaaaatactctattttcacttacctttggccaccagtgaaaatatgatttagccgctggtgagtagtagctttttttaagccacctgaagcaccacttggagtgccatcttaacacatctcctttttttttccaatgatataaatctatccggtctaacaaattacgtactctctccgtattttaatgtacgacgccgttgacttttcgactaacgtttgaccattcgttttatttaaaattttggtgcaaatatgaaaatatttatgtcatgcttaaagaatattggatgatgagtcacagtaaaaaaatgataattacataatttttttaaataagacgaatagtcaaacgttggaaaaaagtcaacggcgccatatattaaaatatggaggtagtacctggtaaatcctaacaaattgtccaagctatacaacagcaaattacttcggtacatggaattcgctgtttgtaccgtaccgcgtgccgtatgatggcgcaccgaaagcacgttttacacttgggccctgccgatgcggaggcctttttgcggctgcactgtgtcgtacgtcgcgatacgtacgacgtacgtggccaagctgggcccaaagaaagaaacgagacgcggacgccatcgcatcgcctcgctttcaaacgtcgtcgagccaccaagctcgtaaccaaatatcgataattttggtgatttttacgagaaaattgacattttgccactgtcaaaacggggtttcgctggaatgacactcccaaaagtggtttcgttaaaatgtcaccctcaaacaggggcaacatgttacaatgtcatttcatccatttcttctcagtttaatgattttttcttggtgagatgaccaaaatacccttggatcctatctcatctctcttctcctacctcttgctctcttcgttgcagatggtgggcggcgccggcgcagctcatgaccttcgctgaaccgctacgggatgagaaagctggccacgccggggatggcaccgacgccgcccttcggcgccctcaccagctcgacgggtagctcaccgggttcgcgcgtaggtttccggcggtggcgatggtgaccgggaacggggaaggcggcacggcggcgcgactgggaacggggaaggcgtcggcgtggacgaggacgacggttcggctcggcggcgtggcgcaccaagcgctcgacctgaccgcgcgccacggcgtcacttccttctccgatgagctcctcgacgtgggcagcgactcgcggcggagctcctcgtcgaggcaacctgctcgcgcgtgcagccgtagccagctccactccacggcgtccagccgcttgcccgctccaacctcgtcggggagagagatcgacgctggctatggtggagctcgccattgaagagggacttcaaaatccaccactgagttaagccgatttgagtgggatttgttgggggaattgatgaggaggacgagaggaaccgatttttgcatttaatttggggcgagagcaaccgaggagggaggtcaatttggggcatgagttcaccggagagagggaaggatggtggcggacggaggtggaagacgctcctggcaagtgggccccacggctgaggcaagggcatttgggtcaaaccaaataagcaaaacagtggaaaatatttgcaaataatcaaaattggttgaaatggcagtatggcaagatggggtcgtttgaagatggcattataacgaagccacatttggcgatggcattctggcgaaaccccaccctgagaatggctaaatgtcaattttctcgatttttaccccttgcctgcactgcactgttaatcaagcggctacgcggcttggctttggctgtgttcgcgccgttgcgtggcatcagcatcacacgcgctgcggctgcccccgagctgtgagaaggaaacgaaacggagctcaactcaacatggacgccgtgtttagttccaaaatattttttaaaactttcaactttttcattacatgaaaacttttctacacacaaacttccaatttttccatcacatcgtttcaatttcaaccaaacttccaattttgatataaactaaacacacccgaagttctctgatccccaacacgtgagtccaagggagaagattgaaggatgtcgcaccgctagtccacgcggcctctaggaaaaagagcaggtccctcaaacatgccgctttagcataccaatggctgcacgaccttgctctaccaacaaacgaaggatggacaacggatctgattgacgagctcatcactatttggagcgccgttcggaatgtacacttcacggaacatgaagaccagatcacctggaagctcaacaaccacggcgaatacacagccacctcagcctataaggcgcagctgttgggtacaacatcgtcaaattttgacacattgatatggaggccttgggcaccatgcaagtgcaagacctttgcctggctgatactccaaaacagagtgtggacatcagacagactagcaaccagaggctggcccaacggatccacatgccctttatgtcgccagactcaagagacagctctccacttgcttgcggaatgcagatacacaaggagaatctggaatgaaatcgcgcagtggacagactatgaacatctaagaccttctaactggcaaatatttttgacggtacatgagtggtgggaggccaccgtaagcatacgagaagcacctaagaaggcactacgcatgttagccttgcttgtcaactgggagatatggaacgaaaggaaccggaggactttccaacacaaggagttgctggtgctaactttgctagccaagataaagataaaggaggaagcaaaaacatgggggttagcgggtgcaaaaaaatctcgccgcctatagttagggccacggccctaggttttttttgttttctgtactttatccttttttacagttttcgtctcctctattcaatgaaactagcatgatggcccgcgcagattgcgccgctaacatcattgtattttctcttatataataacatatatgttttctcattatattattcaaatatattatgtatgacaacataattttaaattttgcaataactttacgaaattactaatgtgtaatattcatattgcattttatataggtgttagttattaattatttttaatatcaaattttagttatttgtaaattatatatattcctatatagactctagactcgtcttttaatatttctttttttaattctgaattttctgtaaattgtatttctatatagactctatgctcttcttccaatattattttttattatttctaattgtagttctatgtggactctaaactcatctttcaatattctttaatttttaatttttaatttcagttacttctaaattgtattcatatattgactttaaactcttattcccatgtttttcttaatttcgaattttagttatttgtaaattatatttttatacggactctaaactctacttttaattttattatgtttattccgaattttagttagttttaaattcctatatggactctatactctacttctaatattccttatttttaattctgaatttttattatttcctgattgtatttctatatggaccctataatctacttctaatctctactattataaaaatttaaggtgtttttgtctcaaattttagtacgtcgtcaatcggacgtcgtctctgcgcgaagaaaatccgcatagcctgatttatttccttcttccgtatctcgcacggtctttactgctgcggtagacgacgtgagctaagacgggccggaccttcctatgtcgaccgcaccatgcatacatagaatccgtaatccgtttcagtctggttcaagggacaacgatgagattataaacatcaatactgaactacctaactggctgttatcaacgcatgatgtgtataggttttacatggatgcaaaatcatagcaaagctcctattttcatcaggcaaataatggccagctccttgatcaatctcgagcttccttttttaagtaggatatcttgtagactgtgagtaatatttaagattaaaattgcttcaaccttttgcaacgtacaagtacttttttctagcctattataaaaattcaaggtgtttttgtcaaaaaaaattgcgtacatcgtccccaattggaaatagcgtattctttttttcgcacggtttttttagcgcacggttttttcttgtctccccaaaaaaaaattcgtgcgtcgcccccaattggaaatagcgcacggtttttttgtttttttagcgcacaatttttttgtctgactccccaatagcgcacggtttttttgtttttttagcgcacaatttttttgtctgactccccaatagcgcacggtttttttgtttttttagcgcacaatttttttgtctgactcccaatagcgcacggtttttttctttctcagatcgcaccaatagccctttttttttgtccgactccgtctccagatcgcttccaataatttttctcagatcgatcgtatccgtatcacccaaattttccatctctactattataaaaattaaatatgtttttgccggtattatgttacgtcatccgtgtatgagtcgttttttaaattcatttgcttttcgaaatacatatcctgagtcggtttttaatatcgttcacttttggtaatacagaagaaatcatataagaagtatgtttaaaaaaactcgcatgccaacttgagacggtcggactcctaactgcagctcatgattttctaaaaatatatatatccaagcgaactccaacaatgaattttatcttaactaaaccatataaaaataataaaattaaaatagatttcacccgttgcaacgcacgggcattttttctagtattccttatttttaattccgaattttagttatttcctaattgtatttctatatggactctagtctcctcttctaatattccttatttttaattccgaaaatttctatatggactctagtctcctcttctaatatttcttatttttaattccggatttcagctatttctaaattatatttctatatggactctagtctcctcttctaatattacttatttttaattccgaaaatttctatatggactctagtctcctcttctaatattccttatttttaattccgaatttcagctatttctaaattgtatttttatatggactctgcttgtttttctccgattaatgtgagaatttttaggccatgagagcgaacgtggaggctcctttttctattaatttaataatataatagattgacggcctggtcgattcgttcaaaataaaaaaaaaacacgcgagtccgtggattttttagtggagctgcatcaaccatcaatgtcaagctatggtgctgttcggtagagttccaggggtggcagattctgccaagaatccaggggggctgtgagagcttttatgccttcaaaattctgtagtactccctcccatattacttatcgttctaggttaattggcatagattaaagtttgagggaaaatagtatagtatcatctattaaatactgtatggttggatatatgagcgcggttgacagtagaaaagagagagatttgaattgaaagtgattgataagacaattagtactccaatataacaactattttggaataaaatgtgaatctgaggaaggagtatgtacttacttaagtggagtactactatatatgatagtgattagggctagggattcgtctcgtgattgagcccagcttaagttcactcaagatgaagataaagtcggaacacgtaaaaaacaaaagctattagcgcacgattgttttaaacttgaaaactggatttataaagtaacatatataaagagatttcacacaaaaaaaaaccatctagcagtttaaaaataatgctaacgaaaatcggattaaaattgatttcttaattagaaaaaatagtccaactaagcatgtgggacccacatatcaatggcacattttcttcttctctcattctttattctttcctttttctttcatgatgagtcagatatccggttttacagttcacctgtatgaatcagattggagctaaaattaagggagtcagagtggacatattccactaaatgtgtcttgaacatcagtgttctttttgttagaaaacgggccata

SEQ ID NO: 16588 - DNA, 18133 bp, Oryza sativa
  unsure (1)..(18133): unsure at all n locations
aaaagaccctctttcaaaacagagcctgattttttgggaacggcgaccggggtctacttcgacttagagttttaaagagataaaggaagaaagataagagcagcgggctataaatctgtagtcagctgcagcacggactccaaaacattatgtgtgtatgacaggtgagaccagatattaataatgtagtaagtaactattgtataaattggctattatattggctataaatgatttggagctagtagtaggcccgtactattaattaaacttgctcttacgtttctcttgtccatggcggtgccggcagcagagccaatcatctcattcttggctaagctttgacctgatcatcatcagttggtgttggtccgggggccaaaagcgcccaccgacactggcggaatttctcgccggtgcggctgctgctgctgcctgacaccgttggatggatgcgatattgcgaagcaatgcaaagcacaagtggctgccctgtggcgtaggcgtccggtcgtccgggcaggtgtcaactgactcaactgcattcgtacgatccttaattttctttgcttgttttcttttgtttattttttttccatcgcacgggcaggtcgtttcgtgtgtgcacatgctgttgcttgttgccgttaagggtatctagttcagtgaaatagtgctttctttccgtccggttttgagagtacaaggcagttatacataataagtaaattcaaagttataataagtgataggaagtgaagttagagtaatacaaccatgacgactacaatatactgcagacacgctgagataagatggtagcgatactaagtactcgtagtggctaggtgctatgttggttggggagaaacgttcataatcaaagcttcgaaggtgtaggtttcgactgaacttcgttaagaaatatcgtgtgcctctgtgtcatcatttggcatgtcttgaatgattaatgaccaaagcaatcggaaagtttaatcgttattctgctatgttgactaacttttataatatcacattttcatattacattttaagccatccgaccatgtccaatgcaccaccgtgaataatggtctcaacccttcacgttagtgccgagcactcttggtacagtggggaccatggttccacgactctttgctagcgtcaagctcatctcacgaagaaaaaaatgaagggaaagagagatagggtgggagatagatggcaggttagcagctcatatgtgggtccaattatttattttttgcttgattaaatcaccacatcagcataacttaagaaaaaaaccagagagaggagagtggggtcaacggaactgtattggaataattaaaactcaattaattatatgttaatccgcctcattttacataaaatacttaggttgtgtttattgggggaacccctcccctccgcacggaaaacgaagcgacacattttctcatgattaatttaatatttaatattttttaaaaaaatagattagtatgaatttttttaaaataacttttatatataaactttttgcaaaaaaaaaacacaatttagcaatttgggaaacgtgcgcacggaaaacaagatagagggagttgggaagaaggtagaacgaaagcagccttaatcttcatatttatctttatcttcaagagaaaagaacacattccttgataagagtatggtctacctagtttagagtttgagggtgtgtctcagacagaacgaataattgaggggttaaaatgaactttctgtttatcggagaaatttggacaggactttgcatgcagattgcggacaatggacacttgagcacaatctacgcacaggagtacgaagggtgacagagaaactcnnnnnnnnnnnnnnnnnnnnnnnnnnnnnncaagtttaatagtatagtcttactaccggttttaatttatttataactaatctaatagctaattcatacaatagccacttactatactattaatatatggtctcacctatcatacacacattgtgttttggagtcccgtgctgcagttggctatagatctgtagaccgctgctcttctctctcatcgcttatattattaaaatatgtttatagcttgctaatagtctgttattatacatgctctaactatccctagttttcagtcacttcaatgcctaaacatgcgagtcagtagtgtcaattcaacgcagcgcggacaataaagccaaccgtatcgcgtactatcgccttcaagacaagtgcccatccaatttaagctgaccggccacaactccattttttttctgcaaaaaatgaatttctgcaagtacaaaagcaataattctgcttcctgatcacatacaaaattcgcaactcaaaacacgtcttttttcctcgtcgccaaaacggcctagattttttatattatggccccttttcaaaacttattttataaatggatccatagataaacttattttaagaatatacccttttttttatgttgttgttaaagttcaacgtctctaaaccaacgacacaacgacactagcaccaacacccttacatccccagcaaacaaaatatagaggggtcagcgcaaaaaaagattgacaacgagatcctatttgtaaatattttttttaaaaaagagccaacatataaatattttttccttataaatagttcctcgacgccaactactttggcaccaaagatctatttatataaaaaaatacttatattttggccattttcaaaaaaaaatattttacaaatagatccacgttggagaggcagagcaagagcaacgggaaacgggacgatggacaaaccaacgtcgagggagacaaccacggcgatagatccatgaccatcatggcatgaggtagacggtgagcgagccaacatcaagtgagtccgagcgatgagagccgtagcggggaacaggctgacgaagtcaccatcgcacttgtcgtgcggtagttgcccgaggaaacatgttacgctagtggtggcggacctcaccattctcgcccgtcttgtgtccattcccgtctgtcttccatctgcaagggagcatgtatctcgccatgagtgtgtcatccaatgaggatgccgctaccttactgtaggagatgattgagttgggatgacatgtaaggctcacatatcaatgaggtgagagacaagatacgtagcggggtattttgggtgatagaaaaatactactctataaaaaaaaaagaatttctagctatgaatctgaacgcacgtgtgtccagtttcgtagatatgattgattttcaggggtacatgcttgcacgtgggtccaatagtgtccagtgtgtagaaaatggcacatcgcgtagtataaaagtacttgtaatgatgtggttttgaataggtaaatattaatatgagatatatttgagaaaaaatagtcttagtggtttttacttttactactactccagtagcatttctttttgcagaactaccgcgtacctttggatggtccatggatatggcacagaggaacagtttgctcgtatctgcaggtcagactgaaggtgggcctgtaaaggaggagtgttggtgctctgggaccatggcgagtgttggaggtcctctgtttggccaggctgtttgtttgcctcattccactgtggagtacttaatggtacgtggtactctttttgtacgctttgctgcaactgggataaggatccgagagaggctgggatatacatctcccggtaggtatatcccgagatagtacagttgattcaattttgctgttaggatgagtgatctctgagagcctggaactggacgggtggggccgtgggagagcttagcctttccagcaggcatattagtcaaactgaaatatgacgtgttattagttactccctccgtccaaaaaaaaaaaagacaaaccgtgggttctcgtgccaacgtttgactatccgtctaatatgaatttttttataattagtattttcattgtttttatatgataaaacatgattaatactttatgcgtgatttatctttttaatttttttcatatttttttcaaataagacggacggtcaaacgttggacacggaaaccggggtttgtctttttttaggacggagggagtagatgatgatgcaacccgtgaagtcaaaccttagattcttaataaaccattactcccccattttaaaatataagacacaactacccttaacctaaaatcaataaacaattattatcatcttctagtttggatcatcctaataaatataatgcatgcatctaatagaattagatatcttgagggtgaaggatttaaaaataataataatatagtggaactggagaagatgtgttaattaattgaaggcatacatgcacgtcttatattacaaaacacctgaaaaaaatggttataccttatattatagaattgagggagttatacatttaaaatattaaaatttaatatgtaaaaaggatgttaatagatttatcatgaaaaccacttccacaaggttataaatgttttattatttttgcaaatatgtaattaggaaaataataataatcaaacatatgtattatagattgtatcgatgtcgaaaacaacataagaaagaacatgaactaaatttaccaacgatcaacaactaggtggtaattgacatgaatatcatcatatgctcttgcaatcttttatcaggtttattgaataataatttgttaataccgtgtcacagtacaataagccaacttttatcaggtttattgaataagccacgattttttttatagccgagtggaaatttctcgaatcacgtgagatagtgtttcctccttccggagtgcggtttacgctttgatgaactgaatggcaatttaggagctaatctttgctacttactccaagaatgtccaagaatagctctagcagtcaacgatatacccaagaatgtccttccataagacttaaaaatttattgatacggttgcatttgactaactggtcttgaaatcttttgtatttgtccacttgcagatttgatttacaagtatactagtgggctcagcactcaagttcagccgtctcataactaaaaaatgtcagcttcttctttgttgtcttgtacaatttgacgctagagtctcaagatatcgtactaaatctgccattacgaaacactaggcgcatttgaaaagtgtaacacttgtctgggtcatatatgtagattaggagtaccatccatttcaaactgacggacagaaggagaaaacaatactgtgaaactgtccaaatgtcaccttgtcctaatcagcagtactccctccgtccaaaaagactcaattcttgggttttcatatccaacatttgaccgtccgtcttatatgatttttttataattagtatttttattattgttagatgataaaacataaataatactttatgtatgacttatctttttaatttttttataatttttttaaataagacggacggtcaaatgttagacacggaaacccaggaattaaggttttttgaatggagggagtacaaagtatactagactttctacttcagtttacttgagctgcccgtatgcaacaaccttgcttctctttgctttgaccccacaactaaacatcaaccaaaaggtagatacaccagctctgtcagtacaaagcctgaatctgggagtgctagataatagacacggtgattctaattaagtactatacagagattgccttgttttggtaagtagaatgttacaatctggtcgtgcaactactgttaccatccaacaagacagcaacattatttccctttttcttgcttagaatctacttagcctcagccgtatacaatcaaacataccaacaatgacagctaggaaatgaaagtgggcaactactccaagcagaatttttccacaaaaaatgtatagtttctttactcgttcatcttagacttttaggggccgttgtgagatatggatttttttttcatatttctaaaaaaatacttggaagattcatatgaaacggtatcgaggatactccctctgtattagaaaaagctactccctcaatcctataaaaaaccaatgtactagatgtgacacatcctaatacaacaaatctggacatacatatgtccaaatccattatacaaaatatgtcacatccagtactagatttacttttttttttaatggagggagtaacttctaaagataaattatctaggttcgtctctaaaatttacattatcttttttttacaggagtactaatactaatcacttccgattagaccagtccaaactccaaagtgcaaactccaagaagaaccctaaaagtacagctagacggccaaggaagcaaacaaaaaaggagagatcagcaaagaaagccgagaaaacctggcacagccagccagccagctacccatgacatacacataaaaaaaaaagaaacaaaagcagcttgagatgtctcttcctctccgattgccacccaaaagcccctctctttttctcccggaccccctcctccccagtctccaactccaccatttggctcatccagtcatcgcccacttgctctagattcatccccaaatattttcttctcaaggtttattatagcatttcattttttagaagagttcacaaacaggagtagatacaagaacattcaggatgagtgttgatccattccggttctatgtgtaggaagaggaataatggcatgcattagtcatgtcttgagcaagagttggagtgctgctgccacagtagtcttctcctttttgttctctagcatttggccataagccatagttctttctcgagctgttgttgctgcaaaggcattgtcgcaaagtcatgaagaatttgatgtggcaattaatgcctatccggagaaagagttgaagcgactggttttccaggatttgttgcatttattcgctcataagaaacggcaagagagagagagagagatagagagaggggaagcaagaagaggctttgaaagatttttgagtttgaatttcttgttcttgtgggcgtgtgcgtgtggagcggtggaggcatgaaaggcggcagctccgccaccgcggcgagcggcggcggcggcaacagcctggcgatcgtcgagcggcagaagccggcgacgtcgtgcgtggcgtcgctgttccagatgctcgccaagaagaagctcttctcctcgtcctccaagaagaccaagctgcttcccccaggtgagattgcaaggatggtagtagtacactgttcaggcttcttcttcttattattcttcttcctggattgtgcaaatcagatgtgttcaattggcttttgaaccatttctggtttttttctgaatggattgtactgccatttctgtttcagtgcgcacacagaagttctcgcctgggagaccacctgccggcggcgagaagacgccggcggccaagatgaggactctgctggtatggtacttttctccttttcttttagcatctcgttgtaaagctacaattgtttgttgattctttatgagatctagttgaattttccaaagaatatgcccaaaaaagctctcttttttcttcccctttaagccaatattttgtgctatgaagcctcttttttttctcttgttaaaaaaatcagttaaacaattagctttacattcagatttcttagctttcttgacctaggaaagtttttccggtgccttttcagaaatggagtttttaacactttagctttagctttacattaacatttcttgatccctttttacctccttttcacctttgttatttatttttagaatgctaagttgctggctcaccttgtactattttccttcagcttgatgctccatactatccaaatgaagttaccactcgcttgccacctcctggccaagacaacaaaagcagtgaaatgtgcacaccgggtgtggtagccaggctaatggggctcagcgcaatgccagccaccagccatcaaaaggcagtaaaaaccatggatgcctccgagcttggtggtcaccggagtgaatgctcctatggaagcatatacaactcgcatcagaagcaacaaaagccagggcatatcagagatggccggcatgacaatggcaatcagctcgatgcagatgcgcagccggtgtggtcacggaagcatgcagcacacaagttagcctcacctattaagagtccaagatcagtttcaagcaggaacaaggttaggctgattgaagcagcagtcaaggtcctggaacccggtttacaatccaggcaccaccatcaggctcggaggcaagcgcgcctcgagtatagatgcaacagcagtgatgtgcagagtgctgctgaagccatgcacgatttctccgatcaattcgcaagagaaatgtgtgatgttgatgcatcaaggtcaggtgctcaaaatgtaggagccacctctctgcacaattctacttccaatcagtggtccgaagaggatactatgaggaatgtttctgttaggaggccaaaccagaacatatcatgtcaagcacaatctgaaggaaaccataagggtcagaggaacggatttaaggacagtggtcagagaacatcagatgatgtccttgtttcaagtcaaggtgtccaaaaaatacagccgaaaaacatatcccgagagaatgttgattgtagacctcttaaacagaacaatctgaagcagaatgcattgcctgaaacttatagagcagcagatacagggcatatggtccaaaggcagaaacatagagctaaggagcaaaatgtggcaaacacagccaatgactttgtctgttcaaacagaggtatgaacaacagtgcatctttgaggtccaaaggaaaagtaaaggataaaatcggcatgccacatggtagtgcggagaacaggaacttgagcacaaaatgtcaccgaaccagtggcctgcatggtgattgttctaataaacagatatcaaagactgcaacactgaaagctacagagaaagacatgataattgcaaaaggtgcagggttagttagtgagaagccaaagtctaccagtccaaactctgtaaggaatgactcgcggagaaaggtagagtcacgcattgcttctaggggtaacaactcaggcatcatttccatctcttctaattcaccgagaaaggctgtcctcgctttgctgaatggtcatactaaaggatcagatagtgttgttctgggatctccaactggttcttgtcctaagagagactatcgtagggactgccaaaatatttcttcagaaagggaattggtcttgagtgaagctttacaaggcatatcaagtctggaaagtgcagaatcagtgtgctttaatcgaaatgagttgagaaacagagaaattctggacgacagagtaatgtcttcattgtttcgaaagacgagtgctatcaatgtaatggaagaatctccaagtgatgaatttctatggcagtgtaactttctggacagtctgacttttggcttcagagaggttcctagaagtggtaaattgcgtgaaactcataaaaagcatgaggtcagtaattttggtttttcctgttctctatcatggtgcaataccgagttaattctcatcaaaactgcaagggtcattcttctctgatgaatatctttggctgtcatcatctgcaggttactacaaatgctagcgatccatcttattatgcagatgatgagtgcttttctgggagcctgctcaaaactgcaggtaagggacctttgtttaagtgcattgactaattgttggttaggttgtttacaagtagtttgttactacgatctcttgtgacaaaacactataaacacaaaaaaatcgtatagttaagtcacagtttttttagttgcatgctgaccctttcatgcttttccaaccactgccagcatcagaagctggattcagagaccgacgccgctcggagaattgcacaatgcaacaagatggaactaacaaaagaaactccaggtgctctgaaactaattttggccaagacagcagcaacctgatacaccctggagaggttgcagcaactgttgagctgctactaacaaacgttcgccggtctacttctactactcctccacggacatcaaaggcaccattcaaggcgttccttgtcaagacattcgagtctgctctgaccaccgtgaccaccacaagctccacgaagaagaagaagaagaagaagaacgggttcagcttcaacgccggcgtcgtcaaggccacagaaggggagaagagcaggagcccgctgggaagcctcgcgttcgattccgtcatggagtgcttggactcgctgttcacccagttctgcgactcaggatacaggtcgttctcgagggttcccctgatctgccccgaggagaggctggctgctcaggtggacagggagatcgcgaggtgcagcggcatggccgggaaggaggtggatgagctgatcgcgagcgacgtccagcactcgggggtggagatcggcgtggatgtcctgcacgaggcgtttgagattggtgcccagatcgaacgggatctgctccaagagctggtggccgagatcgggatggatatgttgaggcgtttgtgacgtgatgatgatgatttcgtagcaatatggtgaaattatatgttacaagtttggtcatttttgccgtgtgcgttgcgtgcggtgacaaaggcgagggatgagattgccgtgggggttgaccgggagtgaccgagtgaggccgtgagggggcgatcactgaggcgccaggctaggcgccacgcgacgcgacgcttacacgtgaagatgacaaaggcggcctgtacgtaccgtgcggccgtgcctggcggccagatgcgatgatgcatgatgggctgggcagtgggtgcccaccgcgcgctaacgcgatccagtggcggctgatgccaatgcatccaatcggtgatcgcgtgctgattgcccgtgccacggcggtggggggtccaagaccggctgggccgatgcggatcggctcgttgccgtacgcgactttagttttaaccaagtgggaaggtttgcgcacaaggaatctatcccagctgttcatgtttatgcagcgattgaattctaaatgatttgttgttgtttttttttactctggaacaaaggattgacagttgacacccatgaaatttctttagaattgataacaaagatgcatacagccgcatcggttggcatattttctgaatatgccaaatggcatatttacaaacgaaaatcaatttgtgaataaaacttttatatatgtgttcttagcgatctaaaagcaaaggctgaaaaataaacttcgatgaaaaaaccctaaaatcagctctaaatttaacgttgaaaattcaaattttggctgataagcatatgaatatgccaaacgatgaggcccatagagattttagaggagagttagcacaagttaaatctcttacaaaatttcctttgcatccatctctcttatcccattccttttcaagctctagccaaataatcattcatgtacttttcatttgttgcagtctatttttttctattcatgttttaccatccctgcatttcaaaggagcctcagtggtcacttccatatttgggtaccaacaattttgttgccccacatgccaccaatcccctgggaactaacaccctttgtgcccatttggttgggcttctcttgattctctaaagaatttggccccggaagctgaaagctctaccaatttaccaaacatccccgaatattaaactagagattgtgcgcaccttagactgtgacacaatttcataagcgcccaccattagcatctcctatgacttgttaatcgcagcaacacacaagagcacgcatgacgcatggatttctttaagttgatgtatatttacaacaatatatatattcaaaaggaatttcgaatatgagagggaaaatctcgcctggttaatctgatgttgaacaatcagctctatcaatcttgataactctagtgttatatgaaccgcagaagccgcatttgtgatacagccaatggaaccgagaccttccttttctttcacaatcgttacaaagtatatcctggaacaatcaatcatatcaaacggtataccccagccactgaaatttttttaactaggaataggagaataatttacctggcaccggtcccggtattcctcaggaagctcttctgcggccagcaagccatcaagcatgccaaagtatacctgcagagaaacgcgatttaaagaacatacattaactgcactactgaatcagaagaacggaattttttacaagctgttctgtgtatggtaaaaatatggagttggagaaaatataatctatggtgaatgaaaaaaaatgttatttaagtggtgtagcttactgtcatatctcccaaggatttagagcagattgggcaggtgtagtgactacaggtgtacgcctgaaatttacaaacttgtcagaacagcactactcacagtaagagatatcgctcaagaaaccatgcatcagaatgcgactagattattgtacctgaaagcaagctgaatgcatgaaatggccacaaggtagacctttaactgctgcactcgatgtaaataggaagtcgcagcagattgggcaattcatctctagcatcttttctcgacatttatgctctatcaatttcatgcccaggcaacagttgcacttcatgcaatggaaaaaatcaatacccaatccttgcccaagacgacacaaattgcaaaaggggcaatggtacacactcctgaaaaaagattcactattagcgtggtcaccaaaacattgcaaagttggaccccatcaatctcccgagttagcaaaactagcaaccacgtcctttttttttttttacctttcatcgtcaaaaaacttgcatacgctgcaataatactttgccatggatagcccattgcaagaaggggtctggcaatttggaccaactggttgaactttcaggcattgcatgcacatcatttccaccgttgctttcctgacatatcagctccccagacttagcaatatcatttagcattttatattataacaaagctataacaaccaacacataatatgatagaaaacaggagagtttctgcctcctatcctctctcacatgttcttaaaactctgtatacacctatcatgcaaatacagcgattaaaaaactaaagacggaaaagttcatattggacaactttttgggccatcgcatcatttcaaccaaacatttacttgggaggaaaacaacagatgaagagaagaacgaaagggacaatacaaaggccacaagtcatgcctaaaataatcattctgcctcactgttttgcacagatataaatttatcacaaggttctctaactgtagttaaatctttaaccactgcatgcttattgatgtctgttgtttggtgtttaaaaatgaatattgaacacattactactgcgaccaatacagaagtatcattggcagtaaatctcaaaaaaatagacaacatggttgcactgagtttacctttccattgtatggtcactaactttatcatgacaaaacctgcatgtgaacagtttattgcagcatgcagcaacaagtttgcatttccttttgtaatgctcacagccaaaaatctgattctctggatctcggtatgaaggacaacatccaggtaatactgtacatccattgcgatcttctgactgaggttggggcgatttctgctgagcagctatccagcggctgaaaaaatataattagcaaaacaatagtcattcaaaataacttcctatattgtagtggaggaacagtaggaaaagatcctaaaattgttttctgaaaatttcatataagaaacctggtcatgagattttggattagataagccttcctccttgggtcaagagtagaatcacgagaaacctttcgtatctcagcctcaagctcactctggttcattcggaagatgtccttccaaccaggcttaaacatctgttcactctgatcgaacttttcctggaaatgatcttctacaggccaaagcaaagaacaagagttaagataattcaaaatctgatcatgaaaactaaagtgcttaatcttttatcataaatatacatcccagacccactacttttctctcttctaacaccattctaccttcctttatgctaaggccaacttcactaaatctcttctatcacaaatttacatcataatagatttgcactatcgctagctaggacagttgaaaatagtcatcaattggaaagtcctcgttgtcatggtgttatcacttatcacatatcaacaaatacatggattttattttacagcttctttgcttttgaacatttcccgaatttccttttggccaactacatttgtccaattagtgataatttttattcagataacacagaaactaaccaatgtatgaagtttatatgttgctcattagaaggccaatcttatttgttgataaccattgtaagggataacacctttatctaacacaatatataacaagtgggcctcgatagaagtttcttcaatggggaaaaggatatagctttgacacaattttatgaaatggaaaacagtgagtgcctacataacatagcaaactaaaatatggtggaagtggttgaagaggggagatgggatggaaattaattgagcagaccttctggatgggaggcatcgcttgaagggccagaagaagtaggtgatctcttccaccattcatttagccattcatcaaacattgtattcttagttacttgcctccatgtgtccagcatattgttctgttcatctagactaagcgctgatgtaacccagggtaacattgactgcagaacctcagctcctgtacttccaattatacggcctacaatcttatcctgctcctctacagaaaaatgtttatcaaatagtggccacaattcaagttcttctctatggacatgattagacagagtaacccggatagacttgcacattccttgaagctttgtcaaaagttcattattctttttggaccaatcgatcctattatatggatgaatgtggttcgctccaactgcatcagcaccaccaagaggatgcttcaaatcagcatgcaattgtgaaagctcaaaaagaatagtggatatatctttaaataattcttcttcctgcttgtggtcaagagtatatgagtggctgacattgtgcagtgtctctttcgattcaagagcaggaaatacaatttcatcttcagcattgctgtgtgctctataaagaccccacagtaaacgaaaccttccgatgaattggcgaagggaagattcatccccatctatgagctttctagattccacatctaagaactccaaatctttgcgaattgccttatgaaatttgaatattgtgtcaattggccttgaaatgttatctgggccagaaaaggctgcatctgtctcccatgaaaaaagacttgaatacaatgaaggagcagaataattgagagacagcgatcggaaggactctgcagaagcaaacgaattgacagcaagattgctaatttctacccttaacccaggaatgtgacaaggtctgtttttacatgtcaatgctatatcagccgtttgtgagcagttgcttatgttactagattctgtgtcattccatttcttggctggcctagaacaaatatctgattgtaaagaacatggacataactggcagtctttaaacccattttcatccaatgggctgctcagtgcccttggtgtcaagcatatgaattttccagagttagaggtgccctttgagcgacctttgcatgcccaaccagagagaagagtgaccaatgcagcttcagaggaaggtgctgttcagttcaacatattagtaaacagtaaaatgttgagaattttttttttttggaaaaaaaaaactggtgttttaaagaagaaaatagtaaacttggaaaataacctgccaaaaacatattctgaagaaaagcttctgcatcctgatcattcagcttcgatacaaaccacggtaaaacacgctccaataacttcaacggtatgacacagagactcttatataaaagttccctttgtttctctgatgaaaaatgaatcctagcttgaggaagtacctggatatttagatgaattacatgttagactacattggtcacgtgacccaagtagacaacattcctccttaactacagagtttatgtctaaaatactaacctttgtttcctcatttttgaagtgcctctcgattttctccattatctgatcagcttgtgaacatagctcagagtaaaaatccactgctgttgatctggctcctgttatttggatttgttcaattaaacatctaaatttattaaaccgccgttcttcttcagcgtgctcctgctcaaaggacacttgatcgttgactgctggaaatataacctgatcctctgcaatactgcagatcaacatataaaatcggctaggccactatgcttggcaaaatcaatatttgtgccacaattctagaaattccagttcttttgaaaaagaagatgtaagctctactattagccacataaaacaaagaatatgttatagcagggaactggtaccacacatttattgtgcttcccagtatctcgattgctcatgttcttctaagctgtgtaatgtacaactgaagaagtaaatgtgtttaacatgatagaaacaagagctaatcaattcttatgttgcacattgaataagaaagtgtttacatgcaagcttttgaaacaaagtggcgcatgagttgagattcagagccacatacctgtggaagatgcacacatccgcaataaattgaagtttcacattaaagtctgatatatccgagaagtccccagattgttggatccttcttgtttcttctactatatcgctcaattcttttcggatagcattgtgccaacacaaaatctcatctattggatgcataacaagctgactataactagattctgcacgctttctctttccagttttaaagtgctcatgtgagcatccatacttgtctgtttgatcaatagcatccttgcatctaacattgctttttgaacaaggactacaaaaatcatgtgatattgttttcactgcttcccctccaatccacgcaaatacaaccttcacaaatttcgaaactatagttaagtaaagcatggcaacattattgatagaaaacgatgcatcaacacgagacctgttggagaagtttctcgtccggaactattttatgtaagcagttaagaatatcttggtgctcatcagatgaaacagaagtagcaagccatggaaggaactctgccatcatattgacagggatgctgcataagaattgccagactaaatcagcttgctcttcatgtgaaaacttcttaatgagcagtgggaagacctgaaacattcagaaatgattagacaccaacagtgtatagctgtatgccctatgctgagaggaactgataatgatagaggacacataatataccaatatactgattaataatatacgtatgattttaaaaagtgcatgaggaattgtcatcaagtacatggtctaaattaattgctgcagcatttgagaaactatcatcggccaatgttgatctttatagtttagcttatcatttagttctctaggctatcaaaacttaaaaacactttaatcaaagcttatatacaatgcaagctcaatgtccttatactgcttaaagccgagttttgaacagtaaatgcaagtgaagacacataacaagatagctccgtgtcatatatagaacacagaaattggtgagcataaaaaaatgccaccccatacatgctcaagcaatctgcagatggcttaaggattacaaagccttgacaaacacacacacacacacacacacacacacacacacacacacacacacacacacacacacacaga

SEQ ID NO: 16589 - DNA, 5520 bp, Oryza sativa
  unsure (1)..(5520): unsure at all n locations
atatagaactctagtgcacccaattagactattgcatcatgtcagcgcctctcatattgttgctcatgagaaatagaaaggcatgttggtcttatttcgacaaatgacatacaaaggaattaacagagtaaacaggggaaaaggaaacctgctcttcttccttggacatatgttgggttataaacgtttgaattgcacctgtacaggacgcgagttccctccgaagaccatcatcattccgcacatcaagctttaacagagagaacaggtgtgcaaacagatcattttcccccttatgttcaagggaatacgtgcctgctacatttttcactcgaatatcaagtgctggaaagataacctgcaatcaaaaaaacagatcttatgccccccaaacgttcaatatagttatatatcatgaattatgagaaaggtctggaactgtttcacaaatatatcaatctataggtttgggggagaattagctagaagtcaaactagtaagtgttatgttctaaacaatcaacacgacgctggtgcagtcctttatgtatagaagagttttgcagtgcagaaccgaaaagcttactactggcacaacataaatgcaaagagaactaaaataccctaccttacctatgaaataccacagcaactgtcgtgaactccagcaaaattcattttcattcagtgcagaacaatattcaacttttcatgttcggaacggaatagtcttcaataaaaaatggatgggatccttcattggttcctgactctcaaccactaatctgaaggaacttaaatagagtagaatttaccctttgcatgagtaggcagttcatattggctacactagtccggttaacataagctaacgatgtaatccgagatgaaaccctgtgactttgatgcataattgcataatgttcaggactcagaaattttaacatgtacttttgcatattcagtctaagacagtataggccactgatggggacatcaccaaaaggataaaaaaaaaacaatgcagtatactgttcgcaatcacatggctaagtagatgcaaatgcatctcagaagatcaacatgaacataacagtgtgtccacaactaagttgtacaaccaaccaaccatgcctgcaaacttcattcattttgagataatgttggtttcacctcaattcaacacaaatccaacccaaatcctccaaccaatgccacgatttccgaacccagagcctcacactacccaattctgcacgcataacacacaccgcatggtgtcactccccgcaattctaccataaacaacgccggaacagcgatcccgcgcgagagaggagagagtaagagaggggctacggccgcggcggcggcattcaccccgtacgtaccgcgtcctcggcgtcgcagtggtgcctgtagacggagaagaggaagcggcaccgcctctcgagctcccccacgtcgccggaccgctccgtggcgaggcgcacggccgcggcgtgcagcctctccagctccgcgcggatcgccttgtggaagtagacgaatatcagcatcggcgcctcggccgccgaccccgcggcggcggccggtggagaaggcgagcgcggcatcaccgcggcggcgatcgagccctcgtcggccaacggggtcgccatcctcctcctcgtcgtcggcggcggcggaggcggctgctccgcgtgcgcgtctgactcgctcgctcggataaaataatgcgccacttttcgcctccgcttgtctgtgtgcgctcctctctctgcctctgtgggctgcttgtatttgtagccaatgagatgagaggtggaacagcgagtggacaccgtggccttgtgggcccccactctcttaattcttttcttgatgccacgaaagatttaggtggtgcttggtaacgagagggattaaactttagcccctctcattatcttagagtgaatttgtgtttttgttgtttttgtcctcaagttttagattggatcatcctttatctatttttctccaatcttttttattttggattaggtttttttttccatttttgtgttttgaccacccaaagtatcttcacaagcacagcattagcatcaagcacattggcaccatcataccgatgatatcctctgttgacgtgcagttaacatctttgttagagaagagattggatgtggctagataaaaacgttagggtagttcaaagggtaacaaagataaaataaatttatatagtccaaaacgaagatattagataaatatggtccaaactaaaacttactccagtaggtatgaaaagatggcacaaattataattcgcttgtagatttatcatatctagtattagattggtttattttatggcaaaagagtatatttatacacatcaccatgtatatcagtcacacaccaatgactttcgcttccggcccaacttgaaaattaagcatatattgtttgtaggcaaattttactacataacacttaaaatttgtgcaatttactggtaaatatcataaaaacgtgtcacggctgaaagacactttaaaaaaagtaatttgctggggacacttttagctcaattggagagaggaattcttcaaaaagacaagaatgcccctaaggtcaaaagcttcgagctgagactggagctaagattgaatataatgtatgctagtgatgtacttagggtgatggcaaatttagagtttcgtgggttctaaatttttactctaacatcatgtttaaagcatgtggtctttagggacattcttatcatcattaagaatttatcaatacaattgagccgaaagtgtactctaacaaattatcagttttttaaagtcttttttagccatgacacctttttcgatgtctatgagcaaattatgcaattttttaatgtccagtagcaaaatttgtcttgtttgtaaatcgtaattttggaatggaccaaaatacacttgtaactagccctaaattcgtgtacaatgtgcaactaaaagtttgacagctcaaacttaaaactgaacgagaataacttccagtcacgttttgaacttttgaattgaagcaactttcaattgaaatccacctgggttaacatatataactgtgagattacgcctgggctccgtacgaattcatgcatgcacatagaaaccaaatcgtgtggcgcgtggcaccgatcgagcaaatcggtccggtaattaaaaccattgttaatcagacgagacaaattataatctaatatatactaaaatctagtagtagtagtataatctgatcttgcaggtctctgtcacctccaacgacgcgtacgtacgtaccatgcagtcaatgacatttcagggcttgatcagattcagagagataaacataaaacaagtcccagaatggaagaagcatcagatcgcaacaaactggtttctggttgcctgacccttccatgccccgaaaggatgctgtcgaggtatccatctgctttccgctatactactaatttaattatgtatcgcccagattgtgggatggaatgattgagtattcaggcggcgtgaggcgtgcgcgctctccacccatgcctggatatgttaatctgcattctgtagtctgcttacccttgcgtcgcaatcacattatctgaagactgaagttgaacatatactgtatatagcatggagtattctgtttatgcaagttacacatatatacatactgtttttcagatagatgtatgtatgaccatattaatatccgaacaacatcgatccgcattactccctccatatttataaaggaagtcgtttagaataatgtttaagccaaaccttgaaaatataaatcatgaataactctcaagttattaagtttgaaaatataaaaattatatgtatagatttgtcttgaaaaatactttcataaaagtatacatatatcacttttcaataaatatttttatagaaataagaagtcaaagttgtattttgtagaccatatcgctgtcttaaacgatttcctttatgagtatggagggagtatgtaggtgcaatttggagagatgaacatatcaacaatcatcatgcaagctgataaaaacgagactcactttgtgaatactcagctagttagtttttttaaaaaaaataaacatgttcattaggatttaagtcctagacgtagcgttattcttttagtgattggcgtcatacacatcgacagcgaaatatttattatgacttcattaattgattggcgtcgtacacatcgacggacggtgagatatttattatgacttcattaatctcaaaatatattggtgacgtagacacgtgtgttcatcaagtgagtgtatatgcgtttgtattttttttagaaaaaaagaaatgtgactgactttcagttggaacttgggatccagtcaccagataactttaaacaaacacaaaaagaggcagattaattaataatcttcgttaggtattggggtggacgcatgtgcatgctgtattcatgcacgaatgcaagcatgtgcctcagctgccttgaccagaaaaacgaagataagcttaagataaccagccctttttctccatgttcttttaaaatactccctccgtattttaatgtatgacaccgttgactttttaacaaacgtttaacatttcgtcttatttaaaaaatttatgtaattattatttattttattgtgacttgatttattatcaaatgttatttaagcatgacataactatttttgtatttgcataaaaaatttgaataagatgaatagtcaaacgttggttaaaaagtcaacgacgtcatacattaaaatacggggagtagctagctaactcttcatatgcaagactgtgtatgtgctatcgtggcagaagctagtaggatcgatcgcgaatgcacaaatataagtgatttttggtgaaaggaaaggacagggacatatacgtggatatgatttgagtggaacaatcacctcatcacactggatattcggatggtagtgggaggcagaggttcatgctgtccaagtggtgagtcactagctacatagacagatacagatcatacaggtggctgcatgtacgcaagctagaatgaagtgcatgcgtcgttggatcgagctgagtcgatcgatcgatcaaactcaaccagcccatatgcacacagatgcactatgtattgccatggttgcagcgattgcgatgctaattagttcggccgagtcgtcatttgtttcagtacttttcaggggaaaaaaaggaagagtccttgtcatgatagaattgcagcagccttaatttattttgccggcattttgaacaacctgatgagtgatgacctgtcttgagatcgatccaagtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16590 - DNA, 592 bp, Oryza sativa
tctcttttattttttattttttcttcttttttccatttatataatagatatatatatatatatatatatatatatatatatatatatatatatatatatatatatatatatatatatataaataaacataattcatgcgcgcgctacttctttcaattctttttttcctttttttctttttctatttatataatagatatatattttttaaatagttatattttacaaacaaagaatctaccatcatacaacttagaggtgactaaattatctctacaatttttgaaaataaaatttacaccattatatgttacccattaaattaataatgtaatataatttccatttaaaccggggtactcattactttgtactattatttttaaataatgcactttttaaaataaagttcacacattatattgtatacatacgtatgtgtacgcacgctcctttcgcttatcttttccttttttttcttcttttttctatttataaaagggatatatattttttaaataatcataattttacaaatagagaatctaccatcgtacaacttgcatgtgactaaattagctctacaatttta

SEQ ID NO: 16591 - DNA, 400 bp, Oryza sativa
tatagatcagtttaaaatcattataaaagtcaagtgacttggattctattgcttgtgttagtaaagtacaaggaagcttttgttttagatatgtaagtggaaactactatgataaatgaagaaccagaatgtagcctcaccacagcatcctttatcgtggatgtataaataattggggattggagatcatgttcatgtttacaaaattattgtttcattgattggctctggcattttattggtatctccctcttttcttgatattataagttcccactgaaaaaacaatgtgctgtgaacagttcagttttatggccatgacaagaatgtggataatcgtcacccatcaagactgataaagatacactgcgagaaggatataggtaagaaacaagtccaa

SEQ ID NO: 16592 - DNA, 7828 bp, Oryza sativa
acaatattctcccttttgtgcaaagcagagatcaagagcttacatgtcacagcacatgtatcgatgtgatcacgagctcatgtatcgatgtgatcacgagctcccatatgactgcacatgaatagaggtgcttttcttctcggggcaatgctaaatctttatgtgctcgaaagtttgtaaatttttattcacataagattgcatttcatatacctaaaattgaagtggtattttacatgtaattttgttggtatataccttttttctttatttttatcatgggttgaatatttttttcatataattttgtaatgtataaatagtaagtttatttcttgtaatatctgtcaaccttttatataagaaaagggactgaaaagtatcctaaaaatctatcaaatgttactgcaatacaattacaatataattttcataattacactataattgtataattgtattataattacatatgtacctagcatatactgtaacttgtataaataggatgagatcacaggatcgatccctccttgtgcgttgcttttctctttttctcagaaatcacggtgtatcgaacggctagcacgatcccgaacacatccaacggtttaacaagtgcaagatttaaccatcaattttctgtcaacaacagacagttagcaattcccataataagaaataaaaataggagtactgagaaccactggattgatgaaaaatatgattggaatttaataattcgtatcctacgtgcaaccactcaataaataaataaaatcctagatttaaagagctctaaacatgagtccacgttaatactaccttcatctcactataagtattatttagcactcaaacttatctgagaataattacattttgtagactactagtattattattctctccacaatcattcaccattcagaatttctttcaatctttttcctacttatgcttttagtccaccccattaaataaaagatatttagaccattcttatttcatatagtacatttttcccaaaatataaaaacttaagattggactagaaaaagcgcgcggctttgccacgcatggtatactgagcctggccaattgggcctgtaacaaattaatacacatatataaaagagccagagattaatagtagagataactaaagctgcttatattagagcttataagttgactataagattgtctctctatttctttaccttgaagcatgtgtagagctagattttacttgaaagccaacactgttttttttaaatctctattctccacataagtttatagcccactattagtctattatctttgctctaagagcaaattttataagcaagttttatagcaggggtgattacgacctcaaatttattcacatcatcaactaattaattaagatgtagcatattggtttcaatttgcatccaaaccacaccattcttttcttagagtttgtgaagaaattaccacttgcatgaggggtggttacttctcacatactatcttggagctcatactgcacctaaatatttatatgtagtccacttttcttctctctccttctttggtcaatagctagcttattgctttatattgtacttgttctaaggttgcattcgacaaagggacaaataaaggaaacgtccatcatttttcacccacatgtcggcgtgtttttacattaaaaaatctttagaaaagttacccttttataaaaaaaatcatatttctatatttttcatgtttaaaataattattagtcaattaattatgcgataatggctcacctagttttacttatctccttaatatctttctctcctcttaaacataggctaaggtatgtttggaactcagaaaaacaaaatacacgaaagaaaatatttggaatataaaacacataaatacgtgtgtaaaacagatgaataaaaaccatagaaaacttaaaaagatggatctttggaacgtaggaatttttagtggatgatttaattatatcctgctaaccctattttaatctctaactaaagtaggtattattacttctttgatccacaagaaatagcggcctgcctgactgagctttgccagccctacggtgggaatgtgagaaattaacgtgtttgcactgtatgcatagtatctcgtctcatccacgtaaaggcgccggattggggagaaatttctggacgaccggtgcacacgcacgcacgcaggcaagagcattttatcgatccctgcacgcgcggacgcacgtttcgtcgagcctgcaaaaccggtgttgccacgtggcaccattctccttctgatttttggcattgaattcgtattataagatatgacatttttctagtactacgaatctggacagattttcagtagtacgaatttggactgacagacaatctttctagatttataatactaaaaagaatatctgatctaattttagctttttatattttaagttggaggaaatagtaggacggtagtaaaaaactatttcatcctaacccaccggactattatctctccctatgtgaagcatctctccctataaagcagatctactccaacatgaggttccatgtgacatcactggtatcgaggagctttccagggttccaaccatctaacctactccatccattaaaaaaaagccaacctaagagaatacgacctcctagtacaataaatctggacaaaataatgttgaggtgcttttcttctccacaaacttacgtatgactgcattaagcaaatgactagaataataatagacatctgtaaagtgttcactctcgtgcaaagttaactctacacatttttataatatatatgtatttgattcatggtaagagaaaaagagaggaggagaaaatggacataataaaatgatggaagcggactatataggttgtcacgttatatttgtgcgtacgtgaaggaaaaaagagatgagagaggaaatagggggtacatatttgtagcaagttacagcacgagatccgataacctatgtgagagagaaatgtaaggtatgcattaatagtgtaatatgtatcgatagttaactattgtatgatggactatttagttagaccattcccgacccaattactaggatggtatacataacacttagaatgaaagatgatgtggcaagagaataaatgaggaaagagaaggaaaccaggtcttgcatgagacatggtttctacacaacatccaagacatcatgtaagataagtagcattaaatttaaatatggaaaagtggtgtttgcattgaaagagtagtgtctactattagtttcttgatgatgtaaagtttatagaaactatgtgtagaccccgtttggtagggctccaaactccaactcccaactctaaactccaagtccagttagagctggttcctataagagctgaagtggaatagaaagtgtttggctagattggttagctctactccaccacgtcccttgttggcattttgtcaaacacctggtaggcgtcgctgccaccgctcatcccatgggccgccgccggcaccgcacgcgcgccggccgtgcgccgtcaacccgcgccaccgcccgtgcgcagccgccactaccgctgctaagcccgcgcgtcgccgcccgctccgctgctggcagtctgctcgccgggcggcggcggcaccgccaccccgcgccaccacccgcgcgcctaccttcgccgccgccgcccgtggccctcatcgccacgccatccgccggccactgccgacgccgacgacgccgccgctggccgccgggctatccaagaagacggaggaggagagagaacaggaggagatcggataggaaggggtagttcagtggaattttggtgaaaatacactaaaaaaattaaagggtagtgtgtcttttggggtggagtgaagctgtggagcagaaaaacccagctccacccccatagtacaattttgtggaacagctctgccaactccgctctcaaaaatggaggatctggactatttgtcacagctccggctctagtaagttggagttgggagctagagctgtgccaaacgggccatagtatcttgagttgggaatggccttagcaagtgtagatgatatgttaatttttttaggtagtagttggttatattataaaacttgctttaatagctacttcactagtcccatagtaagttattttttagttccttacattgtctcaaaataagttcattttaaagtaatcattgtatcgtagtttgtgaaagtagcgaataattgtgttggaagtaaataaagtgagtaatagttgcattagtatctgataaagtagaggtatttttgtatttgtattggtatgtgtaagatgaatgaaaaataaacttattttgaaaacagaggcagtagtagttagctctactattaaactagaacaacttacccttaggctgcgttcttcctccattttcccaacccacctctttcatttttcacacgcacgctttttaaactactaaatggtgtgttttataaaaaaaattctatatgaaagttgttttaaaaaattatattaatctatttttcaaaaaaaattagttgatacttaattaatcatgtgataatatgagcttcgttttgcgtgccggagaacacagccttagtttgttagggtcatttgaatgacagaaaaagaaaaggttgtctttttgtgagcacattgctcgaattgctaaactatatatgttttttagaaaaaatacgaaagttattttagaaattatattagtttgttttttaagtttgaaataatcaatactcaaatattatgagctagttgctcatctcgtttctcgtatcttcttctccttttctcctcctatcctcttaaacacaattatatagttaatacatgagtgaatttattagctatataatttttctttgtttatgttatgtaagtataattaatgggtaaatgtgcagatctagggcacgtgacgcctgcggctaatgggcatgggcaaggtcatctctggtcgtcacatgtgcaatgggtatgtctgtgcacataaaattatctggtaggtatgggtatacactactacccatgctcattgtactcgatagacggtttccttccttttaaaataaaagtattttcaatatttgaattttatacaatagtataagcattttttttactgattcacatgatgcccattatttccatgatttgaaagccaattattagaagttagaaagagaatctaagccattcaaagtttaaaacctgataactgaaataagtaaaagtaatgacctgagatattatttgctaaacaacataatttttttatctttatattttagagtagatgatatttctcctcactgcattagaaaaaataagaccatgcacaacacagaacgccgcaagtagacatgcaagcgggacgtgtaagcgggttttttcccacttatctctcttctagtttattttttattattttttcttttaagttttgtactaacatacgaaaaataaactagcaagtaggttactatacggatagcgagactacccacttacataactaccgcatatagtctcggctcgaaatgtgggagccgcaacaccacatcagttaatgttggccacacgtacgtaccctctccaggccgggttcgtatcctctgccattgctacataatggcagggagtaacattctctccattctagccctctatccaatatcaacggctgataacatactcacgtaatacttggtatgccacgtaatagtgattgcagttagcaaaacctcacgcttgtaggtttctagccggggaaaaaatattttatagataaattttttatatagatattcataacgatttaaaatataaatgatgaaaaaaagtataataaaaaatttaaaatgtcacctactcatataaggtgtagactaaacgatgaagtgtaaagcatttaaaatttaaattttcgcttactcttataagcttaaggctgagggagtgtttaatcagaggggaaaagagaatattgagataatacgcaaaatgaggtaagttatgactatataattaattgggtattaatcatttcaaacttaaaaaataaacaagataaataacctaaagatgaagtatacgaaagtatacgaaaaacaagataaatcttctctcaatctcctgggacgaacacaacctaaagatgaagtgtaaaatattgcagtatacgacgggttgggtatcttaaagatgggactggcaactaattttaattttttttactatacttatatttttcatcatttatattttaaatctatacgaacatccatatcaaaattttatctataaaatatttttcccaggatagaaaccaaccagcgtgaggttttgctaactacaatcactattatgtggtgtgccaactagtacatcctatattatcagccgttgatattggatagagggctaggatagagagaatgttactccctgccattacgtagcaaaggcagaggatacgaaccccggcagaaaaagcgaacaaggacggactttgcaagatgcaagaaggcgcgattcttctgcaacaatcgctcacggctcacccctatgaaacgagctgcttcgaggcgagggtgtaagggggtgtttattcacgcatgtaaaatgttagcatgtcatatcgggtattatataaggtgttacataggttgttcggataataataataaaattaattacagaatccgccaataaaccgcgagacgaatttattaagcataattaatctatcattagcaaatgtttactgtagcaccatattgtcaaattatgaagtaattaggctcaaaacattcatcttataatctgtataattagtaatttttttagtctttatataatacttcatgtagatgttcaaatattctgtgatatggtgtaaattttttttggggaactacacatagcctaagtcaaggcatgcattggagagatcgggccttcgacttgatggctgtggttccttcaacttgttcgggagtgcaagttttggattgagtatggctcatctgagggtacttccccgttagagcaagcactggtagagaagtactttttactcccgaatcataaccccctatagtcccggtttttcaaccgggactacgaatccgggactaaagatcgctatttttaccgggactaaagatggatctttaccaaccgggactaaagatccctctttttagtcccggttggtaacaccaaccgggagtaaagagagaatagcggcaattccagacggtcctttttctttttttttttaattttctcccaaatcaagtaggaagcatatctattttctcccaaatcaagtgagaagcatatccccaaatgaaagtaacatcccaaatccacatcaaaaataaagtaacatcacaaatcttaaatttacatatacacacaaatcaaatatatcacaaatcctaaaaaattatacacaaatcaaatacatcataggtcaaatacatcacaaatcctaaaaaattacacacaaatcaaatacatcacaggtcatctcagattcatccaataaatcataaaattatacatgtgaatcacaaattaaaaaaaagagaaaataaagccgttgccgccgcccggcgcggccccgctgccccgacccgccgccggcccggccccgccggctgccggatgggaaggggaggtggatgggcaggaaaggggagatgaggaggtagagg

SEQ ID NO: 16593 - DNA, 9249 bp, Oryza sativa
gatcgggatgaggatggaggaagcggaggagggagggaaagaagggagagattcgatctgttgaggagaggataagggatatggattatataccacgcttcgaattttagttccggttggtgttttcaaccgggagtaaagatcggtttgatcttttgtccggttggtgttcccaaccggaactaaagtggtgatctttagttccggttggtgttaccaaccggaactaaagatgctcggccccctgacatcaatctgacaggggatgaaccgggactaaagataatttttagtcccggttggtgttactaaccgggactaaagatcatacaatgcctctggggttttcaaccgggactaaagatcatttttagtcccggttctttttggaactgggattattgtggttttgggtcgacccagcaaagatcatttctccaccagtgaagtttaatagtgtagccaaccaccggctctaaatcatctatagtcaacttaatagccaattcatacaatagttacctataaacatatactacatagttaatatctgataacatctgtcatacacatatgcactttggagtccatactatagctggctacaaatctatagctcgctgtccttctctcttatcttttatcttcttaaaatgtatttatagctggcttatagcctgctattgtacctgctcttaggggattgagggcctcgtgtggttgggcccacttccaagatggggtatggccaccgttggccatgtccttagagcaagtttaatagtatagcccactattagctctaattcatttatagttaatctaatagccaattcatataatagttgcttactatactattaatatatggttccccacctgtcatacacatattgcgttttggagtccgcgctgcagctggctacagatttgtagtccgttgcgcatctctctcatcttttatctcactaaaatatgtttacagctggctaatagcctgctattgtacctgctcttacgccgtggaggcacgtctagcaagttgcttttggcgaggtcatgctcccgtgagaacaagtttaatagtatagcccactactagctccaaattatctatagccgatctaatagccaattcatacaatagttgcttactatactattaacatatggtcccacctgtcatatacacattgcgtcttggagtctgtgctgtagttggctacagatctgtagcccgctgctcttctctctcatcttttatctcattaaaatatgtttatagctggctaatagcccgctattgtacctgctctgacacggggtggccccagcacggccctcctttggggacaaattttttttaagactctttagagtaacattcactttttgagcatttaaagtgaccaaagtgatacattgaactaagactaagggcctgtttggttggcaactaaatttactacacctaaccttaggcaagccaaagttttaatagatagtgtttggttcttgtcacaagtctattttgcctaactcttagccacctggcccacatatcatacactatattttcttgccaaacattgcctaagcttaatttgtcattttatttgccacaaaagtgtggcaagactaagcttagctaccttagtaaaaaatgtgtggcaatattagtccccaaccaaacagaccccaagactaaggctgtgttcttcccccttttctcaacccacctctttcgttttccgcgcacacgcttttcaaactactaaattgtgtgatttataaaaaactttctatatgtaagttgttttaaaaaattatattaatccattgttaaaaaacagttaatcatgtaataatacgagtttcgttttgcatgtcgaagagaagggttcccaacctaagcatatattttcagtttgcaacatgtatctttaccatccatttgcaaattagactaggcttgcagttttgagtcacttgggtggcttacgctcgtgtcggggacgataccaagtggtcattaatttaacttttttccacttttaaaatgtggtaattaaaaatttgctactcgcagttttatgatatgtgagtctaatggcaaatatttaattaccacttgtaagagtggtaaatagttaattattccaataccaagtgcgtgcatcacatcagcgacgacatacataccgtacttgttgtttagagataaattgaattcacaactttttaataggtctaatagttgaaaacaatggatccaccaaattaaatgataaccgatggctaaatgtcttaaatttttcttagaatttctaagatttattagaacaccatgtgacgatctatgagtgtttgtagggatgctatttgaaaaatatgtttatttgatttttaagaaatttctatggccctgtttagttcgtaaaaagaaaacttttgagtgtcacatcggatgtttgaccgaatgttgaaagagtatttcggacacgaatggaaaaaccaatttcataactcgcttggaaacgacgagacgaatcttttgagcctaatcatggactaattagacttaaaagatttgtttcgtgatttctcccctaacgttgtaattagttttttaatctatatttttttgccctatatgtatgtgtccaaatattcgatgtgatattttggggaaaaaaatttggggaattaaaccaggcctatatgaaaggtttttgaaaacaaaacgttttattagcagttttggaagcttgatagaaaacgaggagaattttcagaatttgccatcgaatacgcacggtttttaggatatgccatctaattcgcaatactttcagaatacgccattgggacgcgaattttcttcattctacgccactccgtccgccgacgtcggtcctcgtcgtcgtccgtccgtttgccgccgcccgcgtccccgtccatccgccggtgccgccgcgttcctgtccatccgccagcgccgcgcacccacgttcccgtccgtccgccggcacctctgacgacagctgcgtcagtccccgtccatccgccgccgcggcgacgggctgctcaacgcggccactgcgagcgaacacccgacacgccgcctggacaaaatcgccctagttgaggagctcgtggtggaggtcgtcgtcgagtaggtcgaggaggccgacacagccatcttccccgtggaggcgcgatggtgctcctcggcgagacgcgcgagattcggtgaagaggggtagtgggcgatggcggggcgggcggacggggacgcgggcggcgccggcggacggatgcgagcggcgccgccgtacgggatcgacttcctgactcacatgcccgcgctgccttacctgagccccgacctccgaggcgagaacctgcttgtctgcgccaacttcgcctccgccggtgtcagcatcctcaacgacaccggcatccaattcgtatgcccccgcgcgcatcatcgtcatcatcccagtactggctcatcatcttgagcgatcactaaatcatcctcaacctgattaccatttggttggatggatcgaacgtacaggacatgcatcggatcgatcaatcacgaacctgttggggctcaaacagctggcgatgcgtcttgagttggaagaagaggtaggcgatgagcatgacgatgctgcaggcacacgacaggtcgagggcggcgtcgccggagacgatggcgtgctcgccggaggtgacgcgtacctgagcatgactgcatgagcgacagcgagtggcagaggacgccgagcatgaggagggcggtggcgcgtgggtggcgccggcggacgaacaagaacgcggcggcgccggcggatggacggggcgcaggtggcggcagacggacggacgacgaggaggactgacgtcggcggacggagtggcgtagaatgaagaagattcgcgtcccaatgatgtattctgaaagtagtgcgaattagatggcatgtcctgaaaaccgtgcgtattcgatggcaaattttgaaatttctggaaaacgagggagttgaaacttcaaaactactagaacacatggttagttgtgttacagacttacagcgctgacgacagtaaatttgccgcgtcgcagtggcgcaagtagaaatattttttagcccgagcaaacttcactataactatcatttttaataaaaattacatcattaatttattcaacaatattaaaatttaatgaagtttttgccagcgagctcaggcaggctgcctgggctagccaggcggtggctccgcccctggcagttcatgaggtggatgctggataaagtgatacatgtaaacacaagatacgggatgcttctttcatcctaaaatataagcagttttagaccctgacatagtttccgatatactactttgatcaatacaatatacaatatatatatatatatatatagtaatatgttttaaataaaaagttgtatattatgatagtttgtttaatgataaaatgattgatgttttttatctttttgctattaatagtcaaagttaaaaatgtttgacttgtcactgtgttaaaaatgtttatattttgggacggaggaagtatcatttaggactaggcttcgttcgtttctgcataggaattgagattttaaccggcacggaaaccagagcaaacaattaacacatgattaattaattattaattattaaatatttgaaaattagattcatttgatattttaaagaaacttttatataaattcttttcaaaaaaatacaccgtttaacgttctgagaaccgcgcttatggaaaacgaggaagttgaatagttagagtttagaacgtggcctgaacggtaagatggagaagagaaaaaaacacccctcatacaaaggaaaatctctacgtaagtttcaataaaaatatgaaagtgttagagcagttaacggttatgtattagaaacaacctattatacatacgagacccctcttaatttattgatagactacataaatattagtcacctccattataaatttgatcctgttagtttttttcttacgaaatgagacatgttattaacacatgattaagtgagtattaattactaaagatttgaaaaattgttttatttgattttaaggaacttctatgtagaaaaattctactcaaatatttaatagtttgagaagcgtgcttaaaaaaagaaagttgcatgttgaatttgctgaaaagaacgaggcataattacaacaagtacaatatagactataagctacttcctatgtttcatattataagttattttaatttttttctatttaaactttgttaggtttgattaaatttgtaaataaatttactaacatctaatatgctattgaatatattttgataatatatttgttttgtgttaaaaaagctactatgggtgtgtttagtttacgcaaaaattgaaagtttagttaaaattggaacgatgtgatggaaaagttagacgtttacgtgtgtaggaaagttttgatgtgataaaaaagtagaaagttttttttaaaaaaattggaaatatactcggcctatattttcctataaactaattgacttaaaaaagtcacgacgacgaaaaagagagagcagttagagcacactaaaagaagcagcaagaaaaacgagcttactccctccgtcccaaaatataaccacgtaggataaaatgaggcctattctaaacatatccagataaattattctgagatgagtctcatcccatcccatattattatattctgatagggaggtagtacatactctctctactccaaaatataagagatttttttaatattttatttacaccgtttgaccactcgtcttactagaaaaaaattgttcaaatataaaatttaaaaaacaaacactcgtcttattaaaaaatttgctcaaatataaaacacaaaaaacaaaaaattgtgtttaaagtacgttggataaaaaagtgaataaaaaaataaataataattctaaatatttttaataaaataaataaatgattaaaccatgtaagcaaaatgtaaaaatacgacggagtacatatttaggcaactgcaacactctcgtcaccctcgtctgttcgctcgcgagtagcaagtcgccacacgcgccgcagcagctgcctcgaagacgccgccgccgccactggctacctcctccgtcctccctattgattttcttatcgctcgaagccggtcgtcgtctcctacagttccggcaagatgcctccgcgccgccgaccctcccctgtctccgcagcatagcgccgccggatccggccgccggctcctaaccactcgacttctcgttgcccccgctgcctactccggccaccgcctgcttccagcccgcggctccggcggcgcctccacgcaccgccggtcagccgcctcgctggcctcccgctaaacccggggatccaccctctccccaaaatcccccttccctaaccccaaccccacctgaaacctaatccggcgctcttgccgttgttgcacggccgccagagtcaagaatctcgccggagcacgaatctctgccggatccaaaggttaggaatctgatttttcttgcaaaaaaatttcagttgagttatgaatagcaaatccctataatgtaatagatggatcatctaatagctaccacattttaaacagcgtacttttatcatttttttcccaagtgagaattctgatgtcattctttgtaagtctattgtatcagtcataaaaagactgcccttctgttggctagttgataattgttttataacttacttttagatttcacatagagattagcctctcggagtcgcgtgttcgcgcgactatgagatgccatctttgttgaaagatcttaagattgttttttttccttgtagttatagtggtattttttcctgattgttacaactgaagtagcccgtaagttacatacagtactaccgtaatatgtattcctatttttcttcacaacaaccgttcatgtttattttacttatttgacatctcaaaattgatcttaattagtgcagcccattaaagtatgccaattaattgccatgcaaaccaatagcccattatctatttttcatggagtaatctttttcttgcttgccacatgtctgaggggagacactcgaaggatcgggagggaagtgtctagtgcatttttttttttaccgcatgtatgttaatgatcagatgtccatctttcatcgaaacattcatcttatggtcattgtttttcacattgcgtagcccaatgtcctttcaagaaaggttgtttctttcattactttagattatctcctactgaatttttttcttctttttttgaaactgaaaagaacatgtaccccaaactatgtgttgcatgcaggataaaaagggagggaggaaatgtgacactcagtgtattgtactccaaactgtagtggaagcatcctttttggtttcacgaaccatttaatgtcaaaagattaagggatagaaggcaaatggcagaaactgcaatatacctagctctcagaaaaataggaattgccctaggacgagagagaagtgctactgctttggaacatgaccttgaaggaagatcagctttggaacatggccttgaaggaggatcctttctaattagatctcttaccagagtaatatctgagattattaatagtaatgatatattagttcttaggcaagcagaacttcaaggtagattgaggcgaatagaaagtgaacttcgcatgatcctttgcttcctggctcaaatagaaacaagatatgataacaagcaagtacttcaaagttggattggggaagcacggaaactaggatgccttgttgaacaaataatggacgaatatattgtctatattgtacagagcaaacaatatcgacttaccaagagagtacaggttatactggcctcacatcgcttcactgctcagctgaaagaaattgaggtggagctggagcatctttccaaaatgaaaaaacgatgggttcaagtggacaaggaaacctcattagcttcttcatcatcaatgtttggtcctcatgtcaacaacatagatactaagcgatatgccgaaagaaaggaagaactgattgaatcgctaaagagtaaagatatgacgaaagatggagctctttctgtgattgcagtgtatggtcagcctgggtcagggaaaacccatcttgttaaggatgtttatgctagtgagaagaagtatttcagtacttctgcgtggatttccattgctcaatgtcccaatgctgacactgatgctttgaaaagaatgatgatggaagaactaggaaggcaagttggcacttccactgagagtacctcactgagagtaatgacggaaaatcaggatagcaagttcctgtttgtatttgacgatgtatgggtgccagacatggttcacaaggtacaccgtgcagcttctgataataaaatgggcagccggataatcataatcgctcggatgccagaggttgcttttgtaagaagtgaatcttcagtggagtcacagtcccaaacaccatctagttcgctggaacctgtaagaccctcggcgagagtccccaaggaattcatgaagcttacttgtttacatcctaatgacagttttgatatcttctgtacaaaggcttttggaagaccaagtgactgccctatagaactccgtgaagtaactttgaagattattggcttgtgcaattttcttccccaagcaattgtttctattggagcattgctcagctcaaagcaaaaaacagagtcagtctggagtgaaatggctcaacaaattgaagatattcaaaaaagcaagtcaagcctgaacaatgtgcaaaaagtactatatctcagttacaagaaccttccaatgcatctcaagaactgccttttgtattgtagtacttttccggctggttttctcctgttgcctgagagtcttgtccggttatgggctgcagagggtttcatcgagaaccagggatcattgcaagtggaggaaattggtgagcgctatataaaggagctaatccactggggatttctgcaggttgtagatgtggacgaacaaggtagagtagcaagttgcaggatgcctattgtggtgcatgagctggctgtatctatctctcaaaaggagagaatttggagctat

SEQ ID NO: 16594 - DNA, 8380 bp, Oryza sativa
  unsure (1)..(8380): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaaccttcgcaaacttagcatcagtgttagcaagaaactgaagcgtgcagaagatgagctgaaagtgcttgccaattttgccagtctcgcatcactgaagattacatggggaatggtatctccacgagatgctgccgacgaatcagatgctgcaaaatttaaccttgttcttccctctaatctttcaaagctggatctctactgcttcccgtcgagacaatttgggacgattagttctgacagtttaaagaaactgtattttactggtgggaagttgcatagtctggaaattcagaatggggagtgcaaagtagaggtgctgcgcttgagatgcctcaaggatctgcagttttgttgggaggaattgcgtgaactgtatccaatgctggagtttgtcgaagctcagcactgctcaggagtagctaattggccgctagacaacaataaagtatggacgaaggatgctgaaaccagtaatgctgcttctgcacagtctgaagaaccaactgcgcctgatgtttgtcctgaaattgtggaagagggataaaagcaaaaacatagttaagccggtgtgtttttttagagagaactgccggtgtgtaagttaagccatgcaaggtgacttttaaaaaactagctgggtggtccgcgcaattctgcggctagcacccaaacaaaatcatatatttttttagtatgattttacttaaaatttattaaatatctatgtcgttgtcttaagattttgaaaatccaaatcttatcatccctatatttctaattatatagtttttaaaagtcacaccagttgctaccctttacttctgtcatatgcttctttatttgcttgctcaatctaccactatttctatttattctccctgaaacctttaaaaattgaattttgtagtttttagagtttaatgttttgttgggtttcattttataatttctagaagtcccgtcaaacgctgccattatactcctctatggcccgtccactgtcttttctctttattgtcattgggattttaaaaataaaacataattatcgttcgggttcattttttactttatagaagtcccgccaaaccgtcagcggctttgccattgtactcctttgtggctcacctgctgccttccttctttattgtcaccaagattttaaaatcgaacatgattatcattgggtttttttattttttgaaagttccgaacctttaaaaattggtccttatagtttttagagtttattgtcttgttgggttttattttttataatttttataagtcccgtcaaacgatgccactatactcctccacgacccatccgccgcctactctttattgtcattgggattctaaaagtcgaacataattatcattagaattcattttttattttttattttctagaagtctcgccaaccgtcagcggctctgcaactacactcctatacaccccgtctgctgcttctccttttgattgccattgagattttaaatatcgaatattattatcaatgggatttatttatttttaatttctagaagtcccagcaaccgccttgcccgttagcttcacggtctgcctgtcgttcctccttttaatcgtcattaggattctattttgtgttttattaatagtttttgtatgtcgtatcaaccgccaccactctacttctttatagacctgttacttaatttatctcgtcatgtgttttagatgatctttttttttcaatagtctttattttttatcaccaatttttagttatttattgtattcctaattgaaatcttttttatttttctaatttcataatttattttttttatttttgaatttaagttgtttaaaaattgtattcctacttgaactctcttttagtttttctaattttggatattattttatttttcattctgaattttaattaatcttgtgttgggttcttatatggattcttctttcaatattgcttatttttaattccgaatttcggttaattttaaattgtattcctacttgaactcttcttttttttttgttgctaattttggattttatttttatttttactagcaatagtgcccgtgtgttgcaacgggaaaaacaccgtttgatggtgtgacaccttgaaaacctcaaatctgtaaaaatcaagtataatttgatatattaacaaataggtagaaccgagtctaatttgatcaattagcataggatttaggatttagttttagatttattttttgagcctacttagcagtttatccgacggactttaatttgaaaaatgtgagccacattgtttgatcaaatttgctttcggcccaagccttcccaagccggcccaaacttgggcttgcccatctttggcgagttgagtcaattcgacggcccacaagctgagcagctaagcgcgacctacatatgcggggacggtccgatgcacttccgcggcccattgggcgtagcataatcaatggcggcgacggcccgacgctgggcgaatctaagccgtccgatctaatggacggctccaatcgtccccgcgccgaatgaagcaccgaccggggagaggggcaaaaccctagctcccaaatccctctcatgatcccatttctctccggcgacgagcgagtggaatgacggtggtccggcaagctggtgcgcgcgtgcagcgacgaccgccgagcggctcctgcttcgccggctgggggacgcaaaaccgtgccacgacgtcggcggtccggctaggtgggcgtgcaaacggcgacgagcaccgagcagcctggacctcgtcgacggtaggggtgacgccaagctgacgcttcccgtcttcagcaaaggatggtggaggggtgctccaggacagcgtgcgcgcagggaacccgacacgactgcgaggaggtgaaggtgcggcggtgccgcttcctggaaagctccggtgagctctggggcttcaaatccggtaagtaacccgaacccttaacttaattgatttggatttgactcttatggttcttacccgaaattagagttcttcgaatttagagaattttgtcgggaaatttcaatctattttattccctctttacgagttaggggagtttcaatatcgtttaccctcttttaattttggaaacttcaatctagtttatccctttgctcaatttcgttttttttttgctttggctggcgtttcatcccgcgggtgaggacggagggcaccgctcgtcccctcggaaagattgagattaagataagataagattttcacggacgacggaagtaaattgaatcgaactttcttttatttgttctaatgttttttcgcccttttttcattattacggacaacagaaacattttaaatttttaagtagtagatatagataagatagagatatatagtaccgtgtcaaatataataggattcaattttttttaccgcgtcacatataattctttttttttttggaatcagacatatttgttttttatttctttcgctctttttttaccgcgtccacgcagattcatttttttttgctggtctttttttcacctggtttttttcgcccttttttaggaattggacagattccttttttatttcttttcgccctttttttaccttggaatcgggttcgtttttcttttccttttttttcccttttttgatcggacagatttggtttttctttttttttcacccggtttttttcgtccgtttttttcgcccgttttgttttggatcagacagatttttttcgcccgtttttttacggacgacggaagcacctcttatttttgttttggattagactgatttttttcgcccctttttttttacggacgacggaagaacctcttattttaagtagtagagatagagatagagattctgaatattaattaatctcgtattaggttcttatatcgactcttctcttaatattcctgatttttaattccgaatttcagttatttttaaattgtattcctacatggactctccttttcttttctaattttggattttattttatttttattctaaattttgattaatctcgtatcgggtttttatattgactcttctctcaatattgcttatttttaattctgaatttcagctatttttaaattgtatttttacttgaactctcattttctttttctctggttaatatgggaaattttagtcccccacagcgaacgtggtgcctcattttaaagctgtttaataatataatagattgaaaatataactttttttaagattttgcatttatatatatgtatgggaaagatttgcacaaatatatctctttacggcatgatgggcacgcgggagcgctacgtaattgcggcgtagccacgcgagacagtcggctgggtcgttcacgtaagatgagcgtgcggcaccgctttggtcccgtaggccagaattgcggcaccgcgtcaatgctgcggcctgggtgtgcggcaacgtggtggagggcgggaccatgtcggtcccgtggcatccatgcggtaccgccaggggcggacctaggattttgaaattaggtattcgaaatggaaaggggtaaaaaaaaaagttttacaacacaagcataatatttggtatgtatgatcaacagtatgatattttagtactgcttattgaattagaacttgcgtcaagattttcagcaattttcttgatttattgggatatactttatgaaaaaacatatgtagtacaatctaaaaaataaattgggttcagatattcacattaaacacattgggagaatgtagattgaacgggttacctattgaatcgaatcggaactgttcggcgaggcgatttggtaggggcagtagggggtgcagtggtgcaccgcgcgttgtgcggaagcggccgcggcagcgcgaccaacggtgccggaggcgtggggcgggccatatgacgagagagagagagagagggtttgaccgagcgagggaagggcgtccgcgacctgttgagggtgaggcctcgataggcgtcggcacgccgcgggctactccacatctgcgcgtgcacgacggcagcgcggcgttgcgttgatgagcaagacggagggacatgttgcgacttggaagttggaacaaccaacagcgaccagtggtggtctaggttgactttgccccttcttttgggctattgggcctacataatgagaagataagacaggtgggatgagggagccagtgtgctaggctttcttgttaggcttcttttgatcaatagtatttattttctttatttctctgcacagatacaaaatatatttttttaataatggaatgaaataacatcccgacctttactcaaaagagttacagccaattattacaaactagcactctgtaagagtgcagtccaaatgaaagcaaacacaccaaccaaaattaaaattaaaaggaaaccaataaagataaaataacattatttcagtgtattggtaaatctccatccatgattgacaaacagttgtataaccgtcgtttcaagcatacgacacacaacaattaggaattcttcatcttcatcatacttttgtaactgtgcccacagacgaagccaatatattgccttgaaaataacctgcatataagtaattgtaggtgatttgtcaaaaaccctatcatttctactcaaccacaaagcccaacacaagacagaagctccaacaagtatcagtttactctttttgtttacaactccctaaagccgatcatcaaaaatatgagatatgctagtaggaatatataaaccaaaagaaaactgaactgctctccaaataaactttgcaaaatgacattcaatgaacaaatgttggatatactcatttttcgtacaaaagcaacatcttaaattaccattcaaatttcgtcttgctaaattatccttggttaacacaactcccttaagcaaataccacataaagatcttgatcttaagcggcatcttaagtttccaaattaacttatttctgtcaatgtaaccattgttaattaaagctaagtacattgatctaactgaaaactggccattctgatgatagtttcatctaaaacagatacgaaatatatacctcatattgtattttttatctaaaaatcttgggtattcatctgaatactcttgaattgagctaggcccgtaccgcagcacagttgcgctgcacagagtaggaatccgcgctgtcaatacaatgctctcaaactttgagcaatcaagcacggtgaaaacgtcactcttttcgttcctctttcttgctcacctcacgccatataaggagaagagagtttgcaccagacgaggtgctcatgccataaaaaagagaagagaagagcttgaggaagagagaagaaatgaagaggtaatggtccaagccaagagggatataagtcgaagaaaatagaggtaaattttagtactttaattattatgaagtatagatttagcgatgatttatgtattagatgaaaatattaagtgttggataagtaataattaatgtagtgtgcatatattacatataaatagtttagttatgtgagaagtttagaatttttaggtactatgtatgttaggactcaagaaatattatagtatgaatgtagtagaaatataaaatggttttagtattatgtttcattatacataagacatgcataaattttattaatatataaaaccgtgtgaaaaattgtatatatgattaaaattttctttagttgtgtgtacgatttttgaacgagtaagagaaatgaggaaaatatatagtatgaataacaaactctatcagttatatagccgttgacctgaatcttattggtttcggttaggcccacaattccatatagaccgaaatagccaacgggtcattttaatctaatctatctgtattttatcttgttagttgtatgatcaaactaactaacacattctgaaatccataggacctatactaaagctaagcagaactcacacgcttccgtctgttcttttagattttacgtcaacaactgcacatcatttgtacaatatttttaacatgcatgtttctatcattttgatagtagcactactacttaagggcaagttctattaattaataggtaacaaatacaacatatcacatctaatacacaaacttcaatattggtttattaattctcacatcgtcttatattttcttaaagattgtgtggaggttgcctcttgtatgaggctggcacattctctctcttctaacttctctccttcatatcatcacctaatcctatgtgacatctttaggagcaacatgtagaggcttatagtacttgccctaacctatgtttattcagagcaaggccaataatacagccaactgcttactgtatagatttttatagcctatctctaagcttactcatatagtggttaacttttcagtataaatatatggtccacctgtctgtctcacagatttcggccacctcaataggggtggaaaaaaaagctcggattcatgagctcagcttgggcttggctcgagcttggttggcttggctcggctcgtaagccagacgagccaagtccaagcctcttatttagctcgttgttgaaatgagccgagcccgagctggctcgcgagccgcttattttggctcgcgaacctagaccatcatgtgtttatatcgattattttgcttttcatggagttattatttatcaactttaaatttatcattaagattttgaagaattgaatatataaacttatttaattttacatgtcgatgatttgctcttgcttttttgttaataattacaaaatatatatgaagagatgttttaacaggaaggcttgcaagccagctccagctggctcgagctaggaaacgagccgagctcaagttttagcttgtttccctaactgagccgagccaagccaagcctagcttgttgtgagccactgcaagccgagccgagccagtattcagcctacacctcagtattcagccttcttagggcaagtgt

SEQ ID NO: 16595 - DNA, 958 bp, Oryza sativa
  unsure (1)..(958): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattcgagctcggtacccggggatcactggtgccccctcctgttgccaggacattggaccgccagggacaccatgctacggccttgacagccccttgatgctgggtgaatgtctgcagaggaacccagccaccctctccaggagcactaggccacacattgaccaagttatcattaccaccactggccaaatgtcgtccatctggggcccagcgcagcccacacacttcctggctgtggccactcagtgtggccacatggtgttctgctacccgaacatcatggtggtggatgtggccagaacgtgaaccactggacagggtatagcagttccggcttagggagcccactcgggcagagtgactggtcatatttcgaagccgtttctgctgctgcacatcccatagctgcacctcagcactgctggtgcccacagccaagtagttgccctctttnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16596 - DNA, 1225 bp, Oryza sativa
ttacttttatatgtctaagaagtaacttagtgaaatctaaaagtaatttagatatattataaaagtaatttatattttttcatcaaaatataatcatgtcagatcttgttataaagattaaattgttacgaacacaacggtgtaatcggattgtagatcggatgagtagtttaagagaaaattgtatttgaagtgtaagtggatagtgtttattatagatggagtggtagccagctaccactagcgctaaacaatagcgctaaacaacccgatgcacgctaaaaaacagagggagtatgcaaatagcagctgtgtagcgtagggcctgttttggggaggttatagcaggtgcagcttctcacgaaatcttcagctttcccaaacagtttagattatcacctagattctaagaatttgtaattgtagaatcttcagcttcaccaaatagtttagatagaattcagaaaataaaagttagaagcaaaaaaaaatccagccttttagattctcatagtctggctaccgaccaacaaattctcgtaaccttaaactttctaaacaagacggtaaactagtttcaaagcaaggctttgcttttttctaaagaaaaaaaaaggaaagaaaattgagaaacaattaaacaacacaaagttattacgattatttgatacaaatgatatcccatggtaagtgaaagtacaagcaagaaataacatacgcgacaacttgacgatcgaccgaatgtctgcaaatacaaaccagtaaacagtcgacgatcgaccgaatgtctgcaaataacaaaccagtaaaagtttatataggctcgtagcaatagaatccgtgctagctcctgccttcttgatgatgtgacaagctgttcatagacatgtagagttcgtaaggaacaattcacagtttgcaagtacatatataggtacaaagatacagcaatcgataggtaggcatatgaatacagaatacataagattttatttataccttgtgtaatgcttatgcctgtgaactgtgatatcatggcctcatggggcgtccagctggctgctactagctggcatttcgtttctctctggatagccataactgtggaaagtataggtccctgacggatatgattctctcctggtcatggatactgttcagctgacttatttttaccacatggagaacttgaagacttcccaacgaaccatttggaatctcaagt

SEQ ID NO: 16597 - DNA, 2449 bp, Oryza sativa
aaccaacgagtgaaacatcaagttatatatggtgaaacaaaaaattagcaattgaaatctttaaaaatcctatgaaacatggtgaatacacgttgaaacatgccgctatcacatatgaaactagtgttaatggtttgaaacatatatttttctttcatcgcaatatagtcatgcgatatcttgttgtaaagatttaattacaatgaatacaacggtgtgatcggataattaatttaagagaaaaatcattttgaagctcgttaaaatacatgcatgtatgcatggacgaggtgaagagagaggagagagagtagtggcagtagttttaggaattttgtgaaacacgctcaagacatgcattgaaacatatcattatcgcgtatgtgttaacgaccaaatttggtaagatatgaaccaggttcggcattggaatcaaagtggattcggcaaagagttagattcgaagaacggaatgtgcatcggctggatactgcatcggctgagatggatcagacagaggacagccgatatggccgatacagccgataaggccgattttgctagaggcagttatgaaactgctttaacgtgctacacaaggattgtcatgatggagataagctctcagatagtcaattgtatctattagttaggatattttgaatagtttccttagagatatgtttaggcaagagtcagccgcaaagccttatgtgtatcttagagtttgttagagataagagtcgtgtccggcaaggacatatcatgtatcttgggtataaatatcacccgaacccatgcaatttacaacaacagttcaataaaactttcggcgcatcaccacccttttcactttcgttctatttcgacgagttcttgcttttcgggttaagctgcatcgattacgatcttcaactagaggtaaacttatcatgacggcttgcgttctcaggattagtgcttccatctttatgacactctaatcttgtttatataattcgtcgagttatcatatgcgttttgtaatctctattagttgcgctatataacttgtcatcggctggtttgtactattagaaagtagtcgatagagttatgtttcgttattaatctagattatatcgtgtatctatcatctcttagaggttttcatcatcttgcctagattttatatttatctttatgcttaatgttacatcagttgggttcgatctgttgagtaatatccataattgtgatatctggcttgttttatgattatcgagagagatagcatcgggttttcagccgatcttacctgatttagctactttatgttttatatgtttaattgatatgctagatctgtcatttatattaagatcttgtcgcattaaggtatattaggcttcttgtttaatatattttgcttattttaatatcttagtctaaagtagtatcggagtattaaccgatacatgctagatctgtctgatcgtctatataacccctgctttaatgtatatttcgatttaagtgatttatactgtctcggcatggcgaccgatctatcgtaatcacttagtttaaatatacatcgaaggaagggttatatcaatggcggacgcaggattaaaaataagatggggcgaaaatgttcgctttataaagaccgtatttatgccgtaatcgcataaaaatatatttgaggcaaaaaaaccattttataacaaagaaataatatttgcatcatatataaattcatcatacaccaaaaaatgcagtaggacaaataaataatatgcaagtaactgcgcatgctttccattttcacagtagaacagtgttaactaggagtacctactatttccattaacctaaacagatgattaactgatctagacagcaagaacagatcatttgcaagaggaacaaacaaatttgcttgttacttgactacaataaaatggtccaaggaagaggatgatttgattaaaatggtccaactgctactgctgcccctaccggcttacccctgaggtcgctgactcgttggcgccaggcgtctaggcgctagcctgcagcctgctagctgctgttgtgcctgtgctgcggactaccggccaggccagggagcgggacggccggaccaaacgtaaggcgacgacggtgacgggctgacagcgacggcgttgcgttggcacagagcaggaggaggctggaggcgaggaggagacgaggagaagcgagttgctgggcgccggctgcaagcggcatcgggccagtcgttggtcgtcgctaggcgccgggcggtggctaggcgtcaccgtcgcgtgcaccggtggccggtgtggcagtgcgggacggcggtaacgagcgagagtgcaagacggcgtgcggagtcgcggtcctcgcggagaccaagcgttggcgcaacgatgcggtagcgagaaggcgaagtagtggtatg

SEQ ID NO: 16598 - DNA, 1797 bp, Oryza sativa
gccccatgccgcctaatgggcacgtccgcccctggttatatgtcgttaatatctatagccgatcgagtagatttagtctaatcttatttattcatgactgtcaatcgatcccaatatgacatcggcttgatgataaatgatatgtcatcggcaattagccgatcggctatcgtttatggatttaaccgcggttttcttgtctttctttcttgttgattgtaggatcaaatcaattggcacgctcacaaatctaaaagcaagattttggacctgcacagaagttaagtagatctttcaggccagtgtgtgtttttcgcatcaacagtatgaaacattgagttttaaaggtttgaaacacatgtttttcttttaacataatattgtaaagatttaataaaaaacgaatacaaccgtgtgttaagattgaaatttggtaagccctaagagaattatcacatcgccaatagtcggatttctgctatatttggttaaggaaattaatctattaaaggaagcttatctagaagtgaccaagttcaaggaggatacagcatggcaagttatctattaattaggaatagtttgttagttttctttttatttttaggaaagtttctttcttgtcctacaaggactagtatatccctatgagtataaatatgtacacccggggttattgtaaactatctccacgatcaattacaattcagcgtatcgccaccttttaccttttctactttattttatcgtccggcgggacttggcacctaatgcgggggttttcgatctctaacgaaggggtaagtccaatgttccactggcccaggcaattgtatcgtctacgtcggcgttgttcaaggctgcatcggtacattcgacctcttggattgctctggtttggttgatatatttgtctggctatttatcatatgtcttaatctagtcttagtatcttaatttagctttatcggttgtctctcgctttagggttactgccggtattggctaaattgttttactatattagattagataaggcatctaccaccctaaaaatcagtcaacggcttgattatctagatattgtgtttctttttatacttagtgctgcataagtcaagtttgatctactaagtcatgtttagaaccataatccctagcctgttttttgaccgccaataaaggtttcatctgggtttcagccgataaagtatctggacgttgcatcggcttacaaggattgcatataagttggatttagccgttcaccgctttaatctattctgtggattttatgatatcggacctctagtcgatatatgctttaaccttcagattatattgttgatttcttgcattatcatcagccgattgtctttatattattatttacatcaagcgtcagaatctacatcagaattatagccgatagctcaaaaccctatcgctatcggttggtatcggcatcggttggaattaatctatcggcttatcagcctatcggctcattgatctactatttatatatcttgtcagttgtagggtcaaacttactggtatgtccgtatctcatcaacttttggtcctgcactggagctgagcagatcttccagcccagtgtgtgtttttcgcatcaacatggtatgatcggataagtaatttaggagaaaaatatttagagagagaagaaaggaatgagaagaaacatttagctgcttactcgcatacatccatcagaccgatccatagacggaaaggctaatggacgggtgatcgctcccccacccgcccagcgat

SEQ ID NO: 16599 - DNA, 11130 bp, Oryza sativa
agaaacttggaaagcatgcaaacgaaaacccaaactatggaattgggaaaaaaagagggttaaactctcttatagcatgcttgccttagtaaaagttctattgatattcgttaatattatacccacatttataacataatgatttctttcacctggacgaacaaatagtacaaaatccaaatatgacataacacaatacattataattattctataatcaactcttagtttcaggttaaacagagctaagtgttggaaaaaattcaacccgcggtgcttaattcttccctcacggcatcacacctttaattttctttacatgttatctattatatactaaaagtatatgaagcttccttaaaacgctctcaaaccgccacgtggcgctctaataaattagagaaaattctagaaaatctgaaaaaaaagaaaaacatctatccctcgattttcacttaaatcggtgggtccaatattataaaccgttagattagatttatctcaaaacaactcctctgttccattccatatataggtacgttactgcttgcatgcgatctgttaaagggggtgcatgcacgtacataacctttttttccaaggtacgtgactattctttctctttttttccggtatataattgagataataataataatagtactaataataataatactactaataataataattagtgataataaattttgaataaaagtcactttacaaatatagaatataccagcatacaaatctttacaagtgaacataaataaattagctctacaatatttgaaaataaagtttacaccattatattatattatgtacccattattttagattattttgtaacaaaaatatttgtccatcgatattcacttaaatcggtcctaagtcgctacatgccacccctacaaatgctcctaagctaccatgtggcgctctgataaataaataatagaaattctacaaaagcaaaatatctaacccttaaaatattcacttaaattagtgggtccgatattataaacccttggattaacgtacaacggccccagctctcccataagtccgtacatatgaagtaagtacgtacgcacgtgcgaaaccgctcacccttatcacgtgcatatttctctcctttccttttataatttctaaggataattgaaataacattcattattaaaaacaaacaattataactctgcaaacctagactgcatcatcataaacgtatataatgtttgaagaaagtttactgcattatattctttacacatctatctatatattatatactgaaaatccattaaacaaaataattcaacaccaattaataaaattaatcaactccatatatgacttgatatgtggcaaagtggtagcgtagcggcggtcgtaatcaccttagatgccttagacacgacgctttgtcacgcgtgcaaatggcaaaaagtgcagacgtgcattgtgtagcgggccaaaaaagagaacttcgaacgctttatttataagaaaacaatagatccggtgatttaaataataggtccactggttctagtgtaagtgtaaattagttaatatagattttaaatttttaatttaatgggtatataatataatagtgtagactttattttgaaactatgcattattggagactaatagtccaatgtaataaaaaataaatccagtgatttaaataatgagtccatcagcttaaatgcacgtataaattagttaatatagatcttaaattgtttatttgataggtacacaatataattgtgtaaactttatttttaaataatgcattattggaaaataatagcacaaagtaatgagtacaccggtttaagtggaaattatcttacattataaattttatgggtaacatataatggtctaaattttattctttaaaattgtagagctaatttagttacatgcaagttgtacgatggtagattctctatttgtaaaattatgattatttaaaaaatatatatccaatatataaatagaaaaaagaagaaaaaaagggaaaaaataagcgaaagaagcgtacgtacacatacgtatacgtatgtatacaatataatgtgtgaactttattttaaaatagtgtattatttaaaaataatagtataaagtaatgagtacaccggtttaaatggaaattatattacattattaatttaatggtgtaaattttattttcaaaaattgtagagctaatttaattatctatgagttgtatgatggtagattctctgtttgtaaaattatgattatttaaaaaatatatatccattatataaatggaaaaaagaaaaaaataagcgaaagaagcgtacgtataactgtgtaaactttattttaaaatagtgtattatttaaacataacagtacaaagtaacaaagtaatgagtacaccagtttaaatcaaaattatcttacattattattaatttaatgggtaacagataatggtgtaaattttattttcaaaaattgtagagataatttagttacctctaagttgcatgatggtagattctttgtttgtaaaatataattatttaaaaaatatatatctattatataaatggaaaaagaaaaaaaggaaaaaaagaattgaaagaagaagcgtacgcatgaattatgattatttaaaaaaatatatatatctattatataaatggaaaaaagaagaaaaaatgaaaaaaaaaaagagaaaggaaagaagaagcgtacgttcatggtcgtatatatctagggaggaggagaggtggggcccatagtatttggtttggtttatgttaagatcaatttcatctaacggtgtataatattggacccaccaatttaagtgaaaattaaggggtagatgttttgcttttttcttagaatttctaggattttctctaatttattagagcgccacgtggcgacttgagagcgtttgtaggaagtttaatggacttttagtatataatagatagatagatagatagatagttacatactacactattaatatctggtcgcacatgtcatacacacaatgtgtcttgcagttcgtgctacagttggctgcaaatctgtaacccgctgctctcctctctttttatttatcttcttaaaatatatttggagctgacttatagcctgctgttatacatgctctaagagaaactatagattatccccgatgatggacagaatcacaggaggttcactagcagcttagcttgggagattgaagcccacaaggtggatagaggatttttttggaggcggagatgaacctgaggcggctatgggaggtgtggggggagtgggagatccgcgtgctcgtcctgtccagcctgtccctgcaggtcttcctcctcttcaccggcggcctgcgcaagcgcaaagccgcttggtggctgcgcatgccgctctggctcgcctacctcctcgccgactacatcgccatctacgcgctgggcaacctttccaagaagcagaagctctgcgacggctcattcgatggcgagatgcacctcctcgtcttctgggcccctttcctcatccttcatctcggggggcaggacaccatcaccgccttcgccgtggaggacaacgagctctggctgcgtcacttcctgagcctgctgtcgcaggtcgcgttagccgggtacgtctactggaagtcgcggcccagcatgcggctcatgtccccggcgataatcatgttcgtcgccggcgtcaccaagtacggcgagcggacgctggcgctcagggcggcgagcatggactgccttcgcagctccatggtcacgcagccggatccgggcccgaactacgccaaattcgtggaggagtgccagtcgaggacggagtccggactggtcgccaagatcgtcatcgtgcaggagcggcctccagatgacgaggaccatgtcgaagtcaagcgagaggagtacggcgacctggtgtacagtgcgcacaggttctttcacaccttccgccgcctcttcgtcgacctcatcctcagcttccaggaccgcatcgacagcctcgccttcttccggaggttggagatggagcaggcgtacaaggtggtggagatcgagctggtgctcatgtacgagtgcctccactccaaggcactcgtgattcatggtcttctcggccgcagcctacgcttgttcagcctcgccgcgccggtcgtgtcgctcgtgctcttcacccgcgcgttgggcgacatgcgagaaggctacaaccaggttgacatcaacatctccttcgtcctcctgggaggagccatcttcttggagacatacgcgatcctactgatcttcatctcctcctggacctacaccgacatgcgcggcagagaagcgctccggcccgtggcggcggcggtgttttggctgatcgccctattccagccggagaagaggcctaggtggtcgaacaagatatctcagtacaacctgatcagctattgtgtcaaggacaagtcccgtcggtacaagaaacccatggagtggctggagtggaggtggaacttccgcgtgaagacgatgtgggacagcttgaggtacaagacgagcatcggcgtgtcggagctgctgaagagccacatcttcgaacagctcaagagcaaagcaagcagcatcagcaaggaccccaagagctaccggaaggctggcgagcaccgtggccagtgggcgctccagcgcaagggcctctaccagaagctgggctggagcgtcgactgcgagtttgacgagagcatcctcctctggcacatcgccacagacctctgcttctacgccaatcatccggcggacaaagatgatgacggatgctgcagctgctcctcgtcgtccaagtgtctccgttgcctctgcagctccagctcgggctatcctgatgccgaggctcgagggcgtgactcgaataagctggcgacgatgagcagggagatatcaaactacatgctgttcctgcttgtcatgcgcccgttcatgatgacggccagcatcgggcagatccgcttcggcgacacctgctcggaggccaagaacttcttccggcgagacgacgaggagatcggggacgaggagcggtgtgccaagaggctcacgaaggtggacacgtcgattgcagagccgcgggacgtgaagggggacaggagcaagtcggtgctcttccaggcgtgcaaactcgtgagacagctcaacgagctggagggcatcacggaggagaggaggtggaggctcattgctggcgtgtgggtggagatgctatgctacgcggccggcaagtgcagcggcaatgcccacgcgaggcagctcagccagggaggcgagatgctcaccgtggtgtggctgctcatggcgcatttcggaatgggagaccagtatagggtggagtctggccacgccagggccaagcttattgttcatcataatcatagtaccatgtaggcctgtttggtccattttctctgttcagccatccaccatggccagcagccgcaggatatgctttgagattcgaacgtacacgtaactgccccgctcgtatcactttctgctggcgccccagaatacatgccgtgggtcccaccgaactctgtataggttttttttttttttgagaagactgtatagggtcttggttttttgtttcttccccaatccccaacccccggatccaccgcctccggctagcaggttgaggtggggcgcatcgatctgtccgcgtgttggcggacgccagcgagccgaggagaaacaatctactttgtcccgccaggagcaccatttgttggcgtaagcacgacattgcattatattttcgcccgtgttgcctggaacatgtgtaattctcagaaaagaaaataccaagttcgaggaaatatttaaacacggctaattgcaacttaattcatgtggagcaaccaagacaaaagcgccaagtatatatcagtgtccactaggctgtgttccttggtcaaggtttccaatgatgcgttcaatgagtcgtgtttatatgtataaatctaatgatgcattcaatctagtttatatctgcaatgtcatgatttatttatggaataaattaaatcattatgtacttataatttcaacaggaaaaatgtaggattctaatagaaatgcaagtgcaaaacagatgattgcaaaacaaatgaaaaacccagaaatgaccatctgattaaaccaccggaaaaccaagaatcagatgagataaactcaaaggaaagtttccaagaagctgaagcgcttactaaattttcttcaaaatctctgtggttttatttagaaaatagggtaggaaaaataatatcccacctttcaaagggtaatattgtatcctaactatccattcttcacacttcatttaatcctagccattcatctatttttctttcctaatccaattgccaaacacaccttataggattgtctattttacaggaattttaaaaggtacgataggattcaatcatttgttttaaggggtttcatagaaatttttttctataggattagaattcttcaaatttcttatgtttttccttcatatcaaatgaccctacttgttgaagggtttcgtctgtgttgtaagttgtaattaaattccatcgggatttcgtaggtccgtgcaaacagagtaaaaggggataaaagcttttcagcagcttcgccgctgcagccgctttcctccggccgcattcgcttctctcttttccgccagccgccaccagaaaagcttcgtccacgagatcatgacgatcactgtcttcgtgggcggacgggaggggcatcggctcggtaaccggcgtgacggacgtggtcaaataacagatcatatgcatatgtggttaattacattgatgcatgcaattgggataattaaattaatgtaaaacacctaaacattcacgcatgcatgttatgggtttaattaccgagaatgctgcaaatctctatatacgatttcagggtccgatcccgagcctcagatagggccacgtggcatcaagcgttgcgctccattcgaattctcgatggagaatgtgccacgtattcccaccaatcccaggaccgttagatggtacatcaacggtgaaaaatcgtctggatgagttatttacaaaacgtaagatctaatcatctggaagattggaagagtccggagtattggacatgaatccagaaaaaaaaaatcgcaagaaaaatataaattcctatctcctactcaccgtgcctccgccctgcctctatccacatcgccagcacctgcatcggctgatgagcagggggtgatggcggctcgatctacacagcctgctttgcctagacatgcgtcgccttaggggggaggcgagaagcggcggtcgcggcggtgcaggagctcctgcggcacgtcggcgacggcgacgacgatggcgttctcaatcacgtcgtagattctgcgtggagtcagcggcccctcagaaaagctcgcgccaccgttccagctggttggccagagtcgcctcggccacggccacgcccacccgctcccctttgcccccaactccgatttcttgcgcttgcgccgccggaggccgctcccgttgggcaccggacccgccacgcgcgcgctcctcctgatggccgccgtattctcctctccgctcgcatggtggtggcctcgtgggaatcgaatggataatggagtaatacagggattagtttgcctcttcttcctacggtagtagtagacgaatagcagcatactccctccgtcaaaaaaaaaaaaaaaaaaaaccctggtttccatgcctaacgtttgaccgtctgtcttatttaaaaaaaattaaaaaaaaaattaaaaagacaagtcacacataaaatattaatcatgttttatcatctaacaataataaaaatatgaattataaaaaaatttcatataagatgaacagttaaagttggacacgtaaatccagggtttgccatttttttatacggagggagtatggtctgcatttttttaagcctatcccttctcaaacgctgccttcagcatctggctggcaggtggcaggtagatacgctttaatcgatcggtgccgtgcggtgcgcgacttgtggggtaacctatcagtttgacgcaggtaaaaataaaaaataaaaaataaaataacgaatgcagacttttatgtagcgttaggagttcccataaaaaaattttataccttgtcataccgaacatttagatacatgtatgaagtattgaacataaaaaaactaattatgcagtttgcgtgtaaattgcgatatgcattttttaagcctaattagtccatcatttgacgatgtagtgctacagtaaacatttgctaataacagattaattagacttaataaatttatctcacagtttataggcggaatctataatttgttttattattagtctacatttaatattttaaatatgtgtctgtatatccgatacgacgtaccaaccctttacaaccgagatataaacacccctttaattaccgcggcgtgataggttcacgaacacaagaagcgcaaaaatcttgccatcttacgtgcatcatagatagatcgaaaacaagcaataaagcacaatgtggtgaacgagtcatgttggatggattatttttatttctcttttttactaattcctccgtttcacaatataagactttttattattgtccacatatatatagatgttaataatctatacacatacatgtgtctagattcattaacatatagatacatatgttttacattgtgaaacggagggagtaatttaactgctcgttgtaaggctacattaaaacgagacaaatacataaaataaaagtcaaatatgagatatccctatatgactagatatgcgttcgatagtgtcaaaaggccagaaaaaaaatcccacgttttctatgcacatgctatccgaactgataaacaatatgttatttttataaaattctgttaaaaatttactctaaaaaaatattaatccatttttagttcaaataactactatctccatcccatattagttatcgctttgagtttttattcgtaatgtttaatcattcgtcttatttaaaaaaaatttggaattactatttattttatttgtgacttgttttattataaaaatgctttaaatataacttatccttttttatatttttactaatgtgaagtgggccctcagggtgtctacgtagttaattttctcatcaatggtttctaaggtaaaaaaaaatcagagaaatattaattaagaaaataaaaggactgaaatagaaagctgaaatacaaaatctaccataggtacaataaggctactgttaattactgtggcttgtacaaccttattctatatgttctatatctagaacaaggactaaaatagagagctgaaacatatgttctatatgtagcttattctacatggaatttttttttatttggccactcgtaaaagttacttccgttggaacatactagctacaaagagagcacaccaaccaacatgtttattttttccgaagagccggttcatgcgttcttgaagaattattaattatatcaacgacttgcacataaatgtttacataattgctctactaaaacattcaacatactagaattaatattttctacttgtcccattatgtagaaaagttctcttttgagatattattttgagacggctcttgcctactcgaagaatcgttaattatatcgaagagcactgcatgtgaaacatttacataattggcccattaaaacgttcatcaagctggagctttttttttagtttccatttatatgtttgtcgggaaataaacattttcagaattgtttccaaatagaagtatcacaaataccagctattatcgttgcttggttcatttaggatataagaaattaaaattctttcaaataactctacaacatttataaatcctaaatgaaaaatataaatattcataggttattgttaagttgttgcgccaaaggcgcgtctattttctagtcggacatctatggatgggtacgcctaataggcgatcgatagccatggggatggggtagcaatcagattcgctccccgcctcccccctccctccacctggtttcctttttttttcaccgcattatttttctattttagtaaatttatacaactaaagtttatacttctaaagtttacacatctaaagtttagagaccaaaagtttataagtcaaaagtttatatatccgattcaaatttgaatttgaattcaaatatttttttatatatagtatttctgtacatttaaagtttatacacctaaagtttatagacctaaagtttataagtcaaaagtttatatacccgtttcatatttgaatttgaattcgaattcaaatatccgattcaaatttgaatttgaattgaaatatttttcatatgtagtatttctatacatctaaagtttatagatctaaagtttatagacttaaagtttatagactcgattcaaatttaaatttgaattcaaatattttctatatatagtatttatatacatctaaagtttatacacctaaagtttatagacccaaagtttataagtcaaaagctgattcaaatttaaatttgaatttaaattttttatatatagtatttctatacataaatttttctaacttttgtttttcaaaaaaatttgtgtggtctactatagtagaaagaggagaaggagaggaggaagggggagaagagggaggagcgatcgctgggcgggtgggggagcgatcacccgtccattagcctttccgtctatggatcggactgatggatgtatgcgagtaagcagctaaatgtttcttctcattcctttcatctctctctaaaatatttttctgctaaattacttatccgatcataccatgttgatgcgaaaaacacacactgggctggaagatctgctcagctccagtgcatgaccaaaagatgatgagatacggacataccgggtagttggcccttcgactgacaagat

SEQ ID NO: 16600 - DNA, 4574 bp, Oryza sativa
  unsure (1)..(4574): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaccagttgtctggaaggattcggcaaggggctgcctagataatgtctccaaggagaggagcaaaggatacaccgctgtcgtcgtccattaaagtctcaaagagagccgagactgggttttcactcggcagccccactggaggtgaaggggcggcacgataacgccctcaaaaggtagagacgttagggtttagaaattcatttcaattgatttaatttacctttttatttggaaatatttaaatattcacctcgaatactccagtgaccgctttgtgcaccataccgaccgcctcgacatctcgaacgatccagctcagctcaatctcccgaggtaacgcatggcgcctcgttctccccgaaattacgcctactcgtattagagcaaggtcaatagtgcagcccactactagctccaaatcgtctatagccaatgtaatagccaattcatataatagttgcttactgtactattaatatctggtcccacatgtcatacacacattacgtcttggagtccgtgctgcagctggctacaaatctgtagcccgctcctcttctctctcttcctttatctctttaaaatatgtttatagctggcttatagcctgctattgtacctgctcttactactcctacgattcttttgaccaaatattttccaccgtccgttggaattgcagtcactgacaccctgaccccacacgcacccttacccctcctgtatatataccccctctcgatttcaccatacgttcccctccccctccctttcactttccccatctcctaacaccacggcgaagatgcaccgtctccgccgccggccgaccggagagcacggcaccttctccgccgcgcttgcccgccggtggctgccgcggaagacctgttcctttctccggcggacggcgggcgggccttccgcgccgtcgacccgtccatagctccgcctccgtgatggcttgtcgtgtcgccggcggcggcggcggcggcgggggtggggtttcctccgccgcttcgtctcggtggcgaggccgacggcccattggggcccaatggggaaggcccatcccccgtggcggcttcccggccacgccaacgccttcttcttctgatgaactctccctggcaactggggcccgcaccgactcgcccaacggtctcccccaattttcgcctctcccgcctctcctctcttccaactccgacgagcggggccaacgccgatcgccgcgccggagcagggctagggttccggccaccgccaccgccagaacggtgcgtcgcgtcccgtccccatccttcttctgcttgctttccccccgttgtgttgcgctgtgtttttgattccgttgttcttgttgattttcttgcaggaatggggggttcgttcggatggttggagtttctcttatcgacctcgcacccgtgcgaggatgatgcggcggaggagcttcccgtcgagccgccggtggcggcgatggatgccgcccatgacggccgcgatgaggtgcggggagaagtcccctccgagccgtcggaagtactcgctggagaggaggaggcggcgatggatgccgcccatgacggccgaggcgaggtccggggagaggtcaccttcgagcgggcgatcggtgcctcctcccgtgcgggttacgaaggcatcaagctgggggaggagccctccctcaaaccggcgatggtgggcgcgcccgagattaagatgatcgagatagcagaggcctcctctgttgcccagtgggacttgttggcggggacggaggattgcagccctgagattaacccgaagattgtcgacctccagcagcagcagcaggaggcctctctccttcctgatgaggtcatctctgaggcagacgcgtcaatcttggcgcagtattcatcggtgacaaagaaagacgatgatgctgagttcttgatttgtcggccaaactttggttttgttacacgaccacagcaacacactcccaagaaacggcaccccaagaacaagcgggctatggggattaacttggtaagatgtttaaagccaacactatttgtatctgtctgccttctttttggacatggaatttatactgatttcattattgatgtttcaggctaagtcttcttgttcttactgttttcacttatatcttgtattccagataatttttcttgatggagattgttgtatttagtagatatatgttattctgtcttgatggagattgtcaactttcatagacatgttattctgttttgatggagattgtcaacattaatagacatgttattatgtctagatggttattattaactttaatatacatgttatttagtgtaggcattttttttaatatttatttttgttttctctgttttcttaggttactctacaatctacatgtctaacagccattgataatttatattgtcattgtgttttaattaaattgatattttgtggtattgtgttttgtagtggttaatctttaattgttaattcatttctttcttcatctctgatctagtatgaattatcaatggtgtaagcaagatttgtgctgtaagcctaattgattttttccttaacaccagacttaactaagatattagctttatatttttcaatgcgattcgtgtttttgctctatatcttaactaatatagatggtggctctgaaataaaactaacacaagacaatcttgtaacaaatatagttcgtgcatgctttgccatattattgtagggattaaattccatcagagcttttactggttgattaatactgtcaatagtattgtatataaacagtgaagattaaggcaagtaggcaactgattttgttgatttaaattcactgagctttgcttttctgatgtttatatgtgctgccttgtgcccatgtctttttgctagtcctggacactgcttgctttggcacaatgcattcatacggcccaatggtgcagtcatacctttcccttgttgttaggcttagttcttaatccctcaacgtttgttgtacaggtttcgagccaaataaatgtttgcttgttgaatatgccttgaataattttgtactattattaaataatgagtcatcttttggttaatctgcgtttgtttgtattagatgtgtttgtacatattattgatattcagttattgcgtccaaaaacatgatattcagttaatctgaatttatttggttcatctgttttactatgggattgattaccattcatcgtgaaactaatgtttgatcttttgtttttcagttggatcgagagggaaatatctgcagtgatgataagcttccaagtcagggttgcttggttggtgaatacaataatcttttgctgcagttgtatcagctgctgttcgatttaaaagagctaatggagctttgtggccaagctgataagatccagagtgaggtgttccttaaaaaggcaatgaaaaaagcttgcagagattctgatgatgctgttgcagacatagtgtttcaggccctaaaggtagatggtttcattctgaggctattaaggtatctgaagagccaattcaatttttgccggacccaggcatggaagataaggaatgagatattgagaattggtggtacacccatcaatgatccactttccaaagattctccttgaactttttgcttgtgggcccttgaaccacctccaatatgggacgttgttctagaatcattgagacatatgctcctgattaccacatattttgcactttggcttgtggtggtcgtaattgttttgtgctaaatgtaatcctctaacaggctgaatgtgaaacggtcagctgtggtactgtatatagacatgtatccaatctgaaatgctttgtatggttgtatacctggatggacatatgcatcctatggatagctggtgcccactgtggcaatatgctcgttgtatatgaattagcacagagagtggtgaatatgaaacttcctgttcttgttgatatttcacttatgttttaaattctcggcatcactgcttgtgaaattgttgaaattgtcctggttattcttggattataaatatctgatgactttttt

SEQ ID NO: 16601 - DNA, 1185 bp, Oryza sativa
ccgtgtctcgtttgctttatttgtttcggacgtccctgtcgcttcgactccgattctgttaccttcaagcgtgaaggccctatataatgaatgcacttgttcgcttctctctctccctctctgtcaaaccaagatcgacgctctggttgctttgttaagtctgcacagggaagagaaaattgtacgagttaactgatttgggcaatggaaacctaggctctgacgagatgcagcagggcgtaaaggttgatacgactcgggtcatagagaacactgctagcaccgtcgacagcgagacgcccgtagagcaaaagaggagaaagaaggtggaaacggagtatgtcctcggtgggaaggatctagagtttatcttgtcatacgaggacgatgaacttgagacatttgatgaggatatgctcaaggaccaggcaatggtccggcaacagattgagaattttggctatggtttcctccatagctggagggaagttatctgcactgatagtgaagaagaagatgaccccgtgtccgatgatgatgatgatgatgaacaagatgacttcttcaccaatgatgatgatgatgaccagcaaaatgtcgaccaaatggataagaacatgtatgctgaggcctgaggggctaaaaagctaaaaacgatcacaatttgtacttttcttacaatatatattgcatgtcttaacttagttattcaattgattcatacctaaaaaaaataaattgatttattgtcgtatatataactagatctgatttatttctagatatattttgttcttcatattattaaaacttggtgattctttactttttctcctaatttataacaatattggatatttatctgttggataaattctcctgccatcttcccctgaaaaaaaatatatgttggataaattagtttatagcatctactaatcctaatttgctatagatagcatcgaaaggtttggctcactttaatagtaccaaaagttggaggcgcctataaatcgggcgcccgatttttttatcaaaagtttcgaaaccctagctccccgatagcgacggcggcgccgggcatgcctcctcgtcggttgcggctccacccacttcaggaggagaggagagagaagagagggggtgaaaataatattaggagagtagaggaggtgaaaaaaaatt

SEQ ID NO: 16602 - DNA, 23496 bp, Oryza sativa
  unsure (1)..(23496): unsure at all n locations
ggctaatatatactacctgcataatcaggtcctgctaatctcaaaagcaagaaccgtgactactccagactccagcctagcgagaagagagaaagagagagacagactcagaacagtgacaatttcagatttgcaagaagagacagcaggagtaagccaaccgattaatcgatggaaacattcagctgctcggaaaaattgcagcttgatgcagacgttgatactttggttgtcgaaatcacagccaccgtcgtacacaacgggctagccacgaaggtgatcgagaaagaagaggagaacttgaaaaagaaaagaaaatgtgtgaagaagatgcatggtggggttgtcattgatggtgatgacttggagttacctatcatatgaggaagatgaacttagcttccttttcgagaaaagcaatgagctcatgctaaaggatcaagaaatgttccagcggcagatcgagaattttggctatgcctttatccatggtgtgaaggaagtcatcctcaccgatgatcgatgaggacgaggaaggatgcgatatcttaagtgacgacgacgaagatatctccatcgccagacaccctaactaggacgatttaaacaccatggatgtgacaactgacaaatactcattgatgaatacaagttagttctgcatgagaatgcagctagtgatctgtttctaatatactactccgtttagttccactgatttggtattttgcatcggttcttcgtttaatgtgcttcctgctcccacctcatcgcctcaggatgcagctagtttaggctgtgcttagttcctcggtcaaaaattttttaagtacacaaacacacatttgaaatattaaacgtagactaataacaaaacaaattatagattccgtatgtaaactgcgagatgaatttattaagtctaattaatttatcattagcgaatgtttactatagcatcatattgtcaaatcatgacgtaattaggctcaaaagattaatctcgcaatttatatgcaaactgtgcaattggttttttttatccacatttaatgctctatccatgtatcaaacatttgatgtgacggagtttttggaagttttgaaataaactaaacactgccttagtatattttcttaatttgtaccactaaacctattagtattatttaatttggagataattaattaagacggacaaaaacaattcggggaacaattgttggtatataaaaatagtaaagcaaaaggtgttattaagccctactgattggtggggccgtaaaaaatgtgggggggggtccaaaaataacaattttttatacagatgcttatatcatccacacgtaaaaataaaaaaaaaattccctggaacagaagagccttatctggaaaaatagtgctatacggatattctgctcttttctgtttatggttgctgatgaaattgtttcaataaataggtattataaggatatcatgataatttaatttttttttgagaattacacagtataacgcagacactcacaacgcgcgcacttagatcacccctatgaacacacgcacgcaaaccctacccctatgagcatcttcgaagactgggccgggaaatcctggagagattaacgaagtcaccgcaggcgcctcgctgtcgacgggtacgtcgcctaccactgaaagcacaacgcctctttgaaagactgggccggcaaatcctggagagattaacaaagtcaccacagacgcctcgctgtcgacgggtacgtcgcctaccactgaaagcacaacgccgatatatatatcctagaaaattcactcccatggtgagtcgaaaccaggacctcaggtgctactaagactcttgtaaccactaggctatttttttaggttaactggacacatgccattacaaattgcctatttagaaaaacaccattactatccatcgaatcagtcggatgccactctgctcttctacaattgaaaccgtaccactccgtcatgggttgacagaaaccgtgacggaatgacttgggtccaattttagaatagtagagtagcatctaaccgattagtaatagtaatgatttgattttgcttttctccaatcctacaaaactgggaagcattgttctgcttagataatctacactgatgtgacaatttaacgccgtttgtgtaagttattaaaactggtcttttttttttcagttgggaaaagatggaaaggactgtagtcctgtgaaattcaaaaacaggatgactttgttaccgagttaaacaatcatttgataactgtttaccagacagcactcaagattagagaaatgattgaattgtgtgagttttacgcaaatatgtcaaactccaagaggaatgccattcctgcaaagatgctgaagaatgctcactgtcaggaagattttggtgtccttgatttaattgaccaggcgcagaaaaatgacaagtttttttttgctaacattgctgtgaaattgaagtgtttgctgggacgtctttgtactgcaggttacaaactccggctgataataatcaaaaacaatggcaggcctatcaatgatccaatgtcattagattctgctagctaggtagctccttatgattggaagtagtcctgggaatgctcttcagctttgatttggaatagaaaacaatgatagatgctcagtctccttccttaaagacctgtgagatcttcatattttctatttccctcttgtgtgtacaatcttctctttgtgttggtacttctgtttttaggtgcaacagatgtttgatgaccagtgcaatttgtattcgattttgtgtaaagctgcttttaggtgtagtgccattgtctattgttgcttgcctggtaccttgtgaattcttggtacagtatgatgatgagaaaataccagtataatcatttctggccttgaagatatatttgtttctgagtacttgtagtagtagaactctatgttgtgctgggatgtttggtgttcctaacttcgttgtgtagagctcgtgttaaattggtgtattctcctggtcatgtgttcagatcagtttgtggattcatattcaatcggtgaattgatataggcttcagactatatattcaaatcggattatgcttcggacttcgttttttctgttccactgttcctccgaattatgtcgtactggtgagaaagatcgattaaattagttagtagtggattaatttaattccgattctgttcaacccagtctcaagttctttatactactactacttattgctttctggtcgctgccccctgaaagcaagatcgacgcgagcgtacgtcacaaacgacttgcgagaagataaactgcaggagcttagctgctcgatcgatcaatgggagcatcgttctcctacggacaaacgcaacgggtcaccgagaataataatgccgctgcctccaccgtcgtcgccgtcgtcgatgcgccgggtaggggcggatccgatgtgagttccccctcccaatcaattctagatccgccccagacaccaggtctggagcggggcaggggcggatccaacgtgagttctccctcccaatcaattctagatccgccccaggcaccagatctggagcggaacaagaggaagaaggtgaagaagatggtggagcgtgttatcgatggtggggatctagacttggtcttatcgtacgagaacgacgaagaatgtttgttaaatgagagcatgctcgaggatcaggaaacattccgtcaccaaatcgagaatttgggctatgcgttcatccatgtcatgagggaagtcatcctaaccgatgatgaggatcaagaggaaggcgaaattgtcacctatgctgaggaggaagatgatattgttaccgatgatgatgatgaggatgattagtaattaagcaacgaggaaggggctaacaacatgattgaaaagggttcagaaggctaaaaaataacaagtgatcgagtaaagcatctatgcattttagttacacacttacactacccgtttcatattataagtcgttttgatttttttttctcgttaaatttatttaagtttgatcaagtttataatttttttaacaatatctataatgttaaattagtttcattagatgtaacattgaatataatttgctaatatatttattttgtgttaaaaatattactatttttttacaaacttatttaaactttagtttaaatagggaaaaaattcaaaatgatttataatataaaaaaatggattagtatattttcagttagttcttcaattgatttgctatatggtggtgtcgagtgtgatagtgaaatcatgggtgcaagattacttcattcatttatcagcgttcaaatcccgatattcatccccaggtaaaccccatatataagattactgtaggcattcttgattggtccataggttaaagttatgtactccctctgtttcaaaatatttgacaccgttgactttttagcacgtgtttgactgttcgtcttattaaaaaaaatcatgaaatatgtaaaactatatgtgtacatgaaagtatatttaacaatgaatcaaatgatatgaaaagaataaataattacttaatttttttaaataagacgaatggtcaaacacgtactaaaaagtcaacggtgtcaaaacattttgaaacggagggagtatatatacttctattcattatcttaaaaaaatatatacttgtgaaaaaggaaagattcagttattacggtatgcaaaattccccaccttgtcatttggcgtgctttctgctcccgccttcgacgtcacatatcacgatgcgcttgcgagactgaacaaattaagctggagtactatattatcatgttgtttgctgcacgagatcagatagatgcaccgcttcatcgatctgtttcgatgaatcgcgcgccgatcgagacgttgcccgatctccctcgtgtgcaaatttcagctcaagcactgcaaatccagtttgcgaattgcctgaaaaatttgcaaattgagctcaaacactccgtgtatagttcttcaaattgatttgcgctggcacgtaagatgtttatattccccagcccgcttccgtcgttcatttgacgtattccttgctcccgcctccgacgccaccgtacatcgcacggttgttgatgtaccggatgcatgaatggcttggtcgctctccctctctccatttcaacccaactgcgtgaactaaacttaatttgagcgcgtcagatatcaagctcctacttgatatcgagccggttagcggcaaggcgttggcgtggtggccgcgcgttgaaggtgtacagttagtggtggccactgttttcagaatgcaacggcaacacgagaaggcagattacaggcacaagtccaaccttgttgggccagcaacggcgatgcctacatacactgctttcccattggggcgtttttacgtgaactttctcaaccatgccacctggatacaagaacttctccgaggaattacttgcatgtttcctcgtcgatcggctggatgactacttcgctagaaagaacaagatacatgacaagcgcgtgaaaccaatcctggagttggtaaaaaaaaccaatcctggagttggtaaaaaaaaccaatcctggagttggtaaaaaaaaccaatcctggaggagcagagaggatttgcaaggagtacaaggaggaaggctatgccgagtactggatcaccgacgacgaggacgaagcagccactcgagctccggcgccgggacggaggaggggtcgacgaggggtcatgaataagaagcataccggaggaactaagaatctttaagtgaataatagaacaaagtttagagatatctgtgcactcgatgcaggtttgagagcttcttatgtagtactcccttgcattttaatgtatgatgtcattgatttttttatcaacatttgaccattcatcttatttaaaaattttatgtaattatcatttattttattgtgatttgatttattatcaaatgttctttaagcatgacataaatatttttatatttgcacaaaattttgaataaaacgaatggtcaaacgttggtaaaaaaatcaatggtgtcatatatcaaaatacggagggagtaacaaacatctggtgatcatctagttaaaaggtagcccgcatctcccaagtgttgttttcgttgtgctatgttggatggttagctagtataactaagtgcagtagttaagtgcttttacggttcttgagagttccgatactttatagtgtaaaatttggtatctaccgagagatactaaatttgcgctcaaaattttggcacttcttaatatctcttaggaactataaatatttcgcagtagttaattcaatttgcgctcaaaattttggcacttcttaatatctcctagtaactataaaatctttcgagtagttaaatctctaatcattgagaaaatttaatttgtgcccttaaaaatttgctcaatcccttatgtgtccatcaaattttgcctcatatcttacacgccatcgagttttcatcttgatcttctctgtactcattttgctggttgaccagcaatttttttttcaaaatgtaacatgatctaagttgaaaaaagtcattgtaaaaagcaaaggggatagaattatttaaccacaaatttgaaaaaaaacacaaaattgttaaataaatttcagatcaaccttgatgaacttcgttgaacattttcaacaaaatttaaacctaaataataaatttaaacttcgctgaaacaatttggtaccgtgaggtacggtatctcgagatactttttgatgtactggggcatatctcttccctacactaactaatgccaacacatcatgattaatcatcatatctttctaacgcttcctcctcctgacaggttcttcttcacggcgactccattgcggaaccttctccggctaggggagcagcaactcgagcaggaactttattgtctttgtcgtcgtcgtcgtcgtcgatgtcgacctcgtactcggcatagcctttggtgaagtactgcctgaggatcccctcccgttcaccccggatttcgttctgcatctttatccagaaagccttgtcctcttctcggctgtcgtcgatcgccttgagttcatcgatgtagtcttgaggacaattcgcgaggtcgtcgccgaggatctcaatgatactcggcatgttgtcgtagtcgggcatctcctcttccttgtacgtgatgcagttgttgatctgcgcttgggtaaaccgcaccatcttcgtcttcgccttcttcttcttcttcttcttctccatcaccggcgccttgccttcatcggaggtaaccggcgccggcgccggaatttgtccgtcactttttttccccgagggagcttcatcggaaggatccatcgttgtcgatggaatttggctttgatcacatgttcccttggatgtgctcgccattgtatttcacatgttcccttggatataggctcttaatttttatggaagcaccgggtcgatcagaaataggtaggattcgggatcacctcgtagttcaggttcagcaggagtccatgagatgcgcgactcatgttcgactctgactcttcttctttcatggtggatttgccgtacgtagttcgtgcgtacggatccggccctatggcagccagcacgcgcggccgtcgtggttgacgccagcggcgccgggacgctcgagctcgctcctaacggagatgactaacccatctctctcgtttttcgtgcgcacgcttttcaaatttctaaacggcgtgatttatacaaaaagtttatatatgaaagttgttttagaaaaacatattaatccaatttttttaaaaaagttaatgcttaattaatcatacaataatataagcttcgttctgcgtgtcgggaggagtcccgaaggtaatttgacatgctgccatgcatatgcaccaactacaaatttagctagtagatccgggtcctcctgtgcacgcgcgcttgtctaccgcgtcgtgcggtggtgtggcggcggtgcgacgcgcgcagccggaagcgcggcgatgcacgcggcgcgaatgtcgtcggtgccgtggtcggtgccgagcgcgcccgcctgcgccgagggccacttcacccatatcctacgccgataattgctcggctatttatagtgtagtcttaaaactactcaaagtgataaaatatttttaaaaacaacctattaagtagcattttattcttgtcattttaatgggtggcgttttgtcgaaaccacgtgaaaaaagagtgccatattgtcctttttctccaatgtttggtatgccgggcagccgggcacactcacagtcacagacggcatcgaatccggaacctattcggttcggagtcggatacaaaacaaacgggtccgacgattcgcggaagcgattccgaaaccgagttattgttggagttgcgcttgcgctgcctatatatattccggcatctacccgaacccgataactctatcgcaatcgggtcttgggcctcaatcgagaggagactcaggggaacaattcatcaggggcgcagctggccttgccttcgtgggcttaggattagatgccgcaccttttttcattcagatgttgtgatctgatgcgatgttgtatcattattatcatacaaatgacttagctctttcggttcggtttcaatggtgacggaatttcaggcgtcggggtgatggatttctccaagatagaatttagtgaggcgaagcggattttggcggcggcgctactaacctccgacgacgaagatagcaagcctccgacgacgatggagaagaggaagacgaagatggtgcgctttacccaacagcagatcaagaactgcatggcgttcagtgcggacatatccgacgacgacgacgaggaatccctgcccaagctctcggaggtgctcagcaaggatatcctcgatcgggtgccgcccgaggttcttgacagcttgatagagttcgagaacacccggggagagcgcaaggctagatgggagaagctacgggacgatcttcatgaggaacgggatgctatcctcaaacaatactacacgaaaggctacgccgagtacgaggtctatgatgacgaagatgatgatgaagatgaagataataaagttcctgctcgagttgctccccctggccgccgcagaaggttccgcaatggggtagccgtgaagaagaatcggtcaggaggaaacattagaaagatataaactgaatgatcatgttcagtgttggtccatatccatcttagttgtagtgtagggggaattatagtttctccttcatttatcagtataataataacagctgtgctactctgtggtttgactatagttctcttttagattcctgctatggtttgattctagtcgtgctatgtttttatcttggtcagcattgatctatcatcatggttcagggaacctgaaagtgacctagactgaagtcacagatcagtagttttgttgactgctctccctgagataatttcagtagtagttctgttgactgcttttttttggacacctgaaaaatgttaggttataatttggaaccccttgcaaaaagctcgcctgaaatatgttaggcctaatttaaagaagctaagctgatctctgttgacatgttttctcctacattattcagagttgcatgataaggattccaatggactaaactttttgacattgtcatatgagaatggcaccctgttaccatctgtttctccaaatgccaatgcaactaggatcaacaccggaaatgaatgagtcaggcaggcagtgtgcttgagacaatcagacataatattttcagtttagcttcgcatacattgagttggttcccccataattaatataccaggtcttagttggtccccatagagtagttatcacttactggtatggtgcccgtgcgttgcgatgggacaataaaaatatatgcacacggggtaaaattatgttaaatagtttgagagtacgtatattgtacacgatccctatcacatatctcccctataaatacattgccattgtcataaatcatcaccaattcacgacaaacaggatcgcgattgccctttttctttcctgttcacttccttttgaaagcaaaacacaaggaaccatgatcagctccaagaagcaagctcagtttcctaataagtggcactgaatgggtgccatcaactccattgctgactacttatgttcacttgtaacaatcttctggacaccataaaaaatcatgacatagtcaacaatcttctgttcaccaattcacgacaaacaggactttatcttatcatacgaggacgatgaacttgagacatttgacgaggatatgctcatgtaccaggcaatgatccggcaacagattgagaattttggctatggtttcctccatagctggagggaagttatccacactgatagtgaagatcgaagaagatgaccccgtgtccgatgatgatgaggaggaggaagatgacttcttcaccaatgatgatgatgaccagcaaaatgacgaccaaatggctaagagtatatatcattggttacttctatactataagtaaacaggtgggtgctttcatttgaatacgaataattagacatagctacattatctgcttctatcgttcgtgtcctccaaagaactgatcagaatagtagtagcacacgctgagttgcaggtaatttcaggaaggaaaaaaaaaaaccttgggtcagaccaccgttgtcactgtggggtaaactccagaagacagagaaagctaaagatatgtcctaggtatgttttctctaggaaactagtactttaaacatgaggtagacgtaggagataataacatcaaaaccaatagcacttattatattatttagttgtatctggtagaagaataacaaactattgctagagttgacaacttttttcttccttaggaacggatttaaccgatttgcatcctattaaatctttaggcttatagaaatgatatagccaagctatatcatgacaaacggtgataatctacggcttgaggcgcctgataaaacgtgtattttatattgaaaaggatgttttcgttcagatattgtgttagtattttaacagtgttgctgctaatgctgatctgttatgctaaccaagaaatattaaaccaaaaactgataattgagattgagttccataatccaacacaggaagatactacgacaactagtaggtaaatcttaaaaaaaaaaaaaaagaacgactcgactgctaatcagcgaagtgtatcagcacattgtttagtagctaattcagcttgttaacttttcctccattgatggaaacacccggtcgaaaccttctttgaccaggatgaggagcagggaaatcttcagcgcctgcaggagaggattcttggtcgccagcaggtaaggtttcttctccatcagcttcaccagaaggtaaggttttttctccatctttacctgcagatcgattcttcatcttcacctgcagcttcgtagcctttctgataagcgtctttctccacatagcctttctcatagtactgtttcagaacattgtctctcgctctcatatgccttgattcaatccggtttatatcacggatgatcttagcaaagtattcatccatatgatccccaaccttaaccatcctcctcacgaaactccacggtttggtaccggatgtggctatcaatctcggcttgagacatcaactccttcttcgtcgccgtcgtcttcttctttttcccttccgacgaactgcctgccatggtcgtcggctttttcccttccttctctgctgctgatgccgccgttgctttcttcttgccttgatcggaagagcttgacatgatcgctggctcgcaaatccagatgacaggaagcgcaccctgcgatcgattgtcgtgtgatttggttatgaaaaaacctgacctcgatacatctgctgcatatttattggttggtagctccagttcacaatcggagtcggaacctgcccctgccgatattcccaaccggaatcggcagagcttcagctgcccaaatctagtttagtttagggtctggattaggcatgactaatttttaggaccaagtttgggtatcggttggagacttgttttaaacttaaaattccaaaattagatttttaggaacatgtttggatatctcttggagatctctaggggacatcatttattattgtaaattaattttctagaccctaaaagtactcaaaattgtgtctcatccagcctagattcgaagaataaatgtctcatctaatcctaagttggtatatactcctattttggaacggagggaatatatatttaatttttgggtgtaatttatgttatcctcctggtcctagttttgaaataatgttttgatcaccttaatctttcaatgttctatactgtattattgctcaattgattggagcatttgtaatagtacaatctcaggcagcacggaaacatcctaatatgcgtgcctttgaacaaggtctaagcacgtcatgagcaagaaaaaaaattgtgagctagcaccttatattactcagaagcatgccatagaatcaagctgcaaaaatattacacaactagaagatgagaagatgtcagtgagggctttttactgattatcatcgtccacagatgtgattgcaatctccatcttctctttcctcaagctgtctgcaagcttcaatggccgaagttcaatggtggctgctctcacgaaaccatcctctgcattgtccaagctgcgttcaatcaccatgcttgaggtactcatagctaaaacaagggacagacatttgcacaaactcatagctaaatagatttgaggccaccgagtgcttctgtgctaaagaaatacgagtaactttatatggtatgtttgctaatatcaagtgtttgttaataggaaaaagtaagctacattctgctctagcacaactaggatccattttattggaaaacatcagaccaggctagataaagctacgaactgagcaacatagtactcatgcatgctaatgtgacagaagcagtatgcatggaatgaggtgatcatgactaatgacactgattgacaagtatgcacttaaattgaaaagggagtaccttgcaatccaagcagaggtcgtttatcaggccctttacttgtgaaattaccccagcaatttgaagtctgacaactcccgaacagaaaaggcctgaaattttggaccaatcaagttcagagcacacataaggttgcaactcacaattgttaatccttgctctgcagaaagttaaccacaaaagatggtttgacacgatctgctcgatgaggtacaagaacattcatcacagccttcttgtttaattcaccaccaactgcaacatttgtaagcacaaacataccctgaagagaggaaacagaaaggccaatgactaactatgatttttgcattctttttttcagataataaatagtatcacagttaagaagcatgcatccgtatgaaaacaaaaaaaaaaatacactgttttattggaaatatttccctttttgccctccatagtttaaaaacacatatgaaaaaaaaaagtatagataaggtaagtcagtatactgtagtttaaggaatactgacctgtatgcacactcctaaggcatatgtgcattactcagctgtcttgaaatagcatttaaaatcatgccatcttcaccaataacataattaatggtgtccacatatccttcaacaaaattttgctgctgctgctgcacctcttcaccctactatttcaccattcgctcaaacgctcatgtgaatctatctgaaagtgccaagacaacatccttgacctcatgtattttgcgacaagggcagtgacggtaacaagctcaccgccactgctgagctgcttgacatgagaatctgtgctgcattgttccccacagcagcacagcatctgtgcccacacctggcagatcatctctagcgtgccagtgccatcagcaggcgagtcttgccggtcgatgaggaatgcaccaagcgagcatcctcccctcaacatcttgtccccaagtctattagtatttgtacaagttaatttaaacttcggtttagagctattcgtcctcaatgcatctgcgttaagttgtagcaagtggagcacatcctcagctgtgctgtacctcaggtgacgagtgatagcatagcacagcacaagataatcattgcggctggcatcgggaggcagcatgtggggacgtgatgcaagcaggaaaagcatgtgattggacagcgcctgagccgtttccataaggtcagcagctgaacctgaaccatcgactacctctggttgctcctctccagcagctgaacttgagccattggcaacctctccttgctccccttcagcagctgaaactgaaccaccgacggcctttgcttgatcctcttcagcagttgaacttgaaccactggcagcctctgcttgcccttcttcagcagctgaacctgaaccaccggtggccgctgcttgctcctcttcagcagctgaacctgaaccactggtggcctctgcttgcttcttctcctgatccttgtaccagcacaggtagatctcagtggcgatgtgccagatgaggatcctctgctccatcttggactcagcaacccaggctgggtccctgtacaatcctctgctttcaaattcctcctgaccccattgcttcgccttcatggtctccagcagcagctgcttggtacacgccgagatggggatgggcaggcccgagtaagccaacctgttccaccagtcctcgactcccatccacctcgcaatcttgctgcatcggctggccctgctgtgcacgcacaactgaatcaggttgagctgccccatggagcgtgaccagctgcgcctcctcctccaatatgccgcacggaccagccggcggagacaggcgggtatgtgagcaagaaaattacacacattacttccttccgatcccttctttaccaggagtgcacatgtccagctcgagaacatggccctcaaaagtgacatagtctccaggatgacggctccaacaaagaggacatatgtaacaatgacatctgctctgctgtaaccattcagcttatgctgatgatgatttccccagactagtagtatattaaacagaaagaatgcaacggtggtggccagagacgaaagcactcggatgcaaaggccataccaagtgtgtgtaatctcagacttggtgtagaagacgtcgtggaggagggagagttgcatctcagccaccttgtacaactcgtcctccccttgcaatcgtgatccttcattcatggggccacacaaaaacagacgaggtaatggccccttaaacctatccttggcaaaatccaacaataggtgagcatttaatagcaaggtttctgctggatccaagcgacgtatgaatgactcaggcaccatttgagaaaatcttcttctcgctatatcactctcgtactttccagttgggctactaccggcacatctgagcgcccagacacgctccccatacttggcaacacctaccattaacatgaggatggtggctgacaggagaagcaaggtccggctgtcgccaacaatgactatggaggacccatagatgacataggcagctgcggccacctgcacaacaagcgtctgcaggtggcgcagccacagccggttgtcctcgatggcgtaggcagtgattttgtcctgcccaccaaggtgcagcagcaggaacggtgcccagagtgccaacagctcatgctctggtgacctgctggtaacagagaggtggccaagcacgtagatcgctgtcccgtcggccagcatgtatgcggaccatataaaggcccttagcacgccagagtcaatgtaccggcggaattctgccaagatgaggagtgtgacttggaccatgaggctgagaagcaccagtgcttggagagcccattttttccatgcagcgctaaaaaaaattgctcctgccatcgatttctccaccttaacatctgaaatgtatacaccaatcgattgacataagtcaaaactacataatatttctttttagtttatcaacactatcaaacctaattttgatggcaatctcaagttctaaactcagcatccaagcccaagcagaataatgacagctgagggggtgtgcttccattctgttggactttcccttgttccgtatcacatgttccgggttgttgtttctttaattgtggttgtgtacatctttattatgcagagaggttgtgagtaaacttttgtgtggttgtacttgtattagctagctgtaataatgagagtaataaagctcccttttccacaaaaaaaaaaaactactatcattataattgttgtaaaagcagactcataccctatttcagcctaagcattcacattgccatgagaacttctattagaatcattgtaattaaggctattgtgtacatccaaagaagccactgagaatgcatcagactctttaggggttgtgtgcttaaagaatttgtgattgacttcccaaacacttttctcttatacgtcagttgtttcattgctattatttcagttttcatttgcttcattcttaccatcacctgaggccctgagctggctcatggcatatatggcaagccaaatacatactgtattcaggatatataaacataataagtgatattagagccaaggcaatgtcaatctgatttacaaaagaattagcaatgcatcaggtgccacaaattcaggaacagccttaaacaatgtggccaagcagaaaaacttgatagcaatgaagtcgtattaagtgagagctacaaaaatctcccagtttttttggctactgatgtgataaatgaatcttgtgttgcatgtacttatgtgaagttgtatgttgatctagttgggaagcgcatgcggaaatctccgtcttttaacagcatgattattatctatgcaccacaattaaaatttatcggacatgcatttttctaacaagggtaatttggatgaaatacctcctgcagtaaacacatattacacagaagctagctatgtgaatagagaaacttacacacgataactgaatgggtggagaagtgatcgatgataatcttcagtttgacagacaagttatatatggtcagggattagccagtttgatatgtttgaggggatgaatgcaattcatgcatagttaagtgccacacacaaatatatcaacatgcatgcaaaatctgatgcaatgcctcccagagggttaaggaatcaagaaaagatgtcattcatctgatacctgcccagcagcaagtaaaggataaaagtaaactattctcctttttttccccaaaaagaaagtggagtataagagtcaaatcactaacgctgtatcactttataacgatgcctcattttccttttcatctacaataatatatggttaacatcacatcacaacccctctaaaagaggacctagaactgaactcgtataatctcattattttcccatctaattctccctaacctccattgctccacttacacatgggcccacaagtttttttctcaccaaacaacaaagaaaatagttgcatagattccaggaaacttggtcctgacatctcccgcggtcctgcggcatatgctaggttcaaaactccaggaaaaaaaaaacagacctccagtacatgttttgaagttgccatgggtagccataagcattaagatcccatagactgtgatgttaattgaatcatcaatctacagatatttaagacctcgctggaacccatgattctcaaggcatatgaatagaaaaggattagagtgctccaactcctacggagcgttgaaaacatagaagaactgcacaacaaatagctgtttgaatagagcacatgaaaaacacaagaatcatataagagaggccatcaacttacttctttggtcagatgaatcgggctatcgagctttgtttcgttggtagaatgaataccgatgggatgatctagtcttttttgtttggttggtagtatgaatatcggattgtaccaccccttcccacagttgttgagcttatgattaattatccatccatttgacagtgacacaagcaaattgcggtcatatcagaaacgaaattatgcaccgaggttggtgatcttatgacttattatccatccatttgacagtgacacaagcttcacattccagtcaatgaacatattagaaacatgttaaataagaaatcatccatttaacacaaggttcacagtcacagacaccctttttttttttttaccaaccatcgattcgtctacaagactacagcaacaaatgcaaccaatccttctcccatctatccattataccatccatccacgaaccaagtcagggccgcaaagggataatcgattaccttgggcggtcgtggggagaattttcagaatataacacccaatacgcactgcttataggatttgtcacctaattcatactactttcagaatacaccactagagtacgaattttcttcgttccgtaacactccgtccatccaaagacgcccgtcgtcagttcatccatctctcgccgtttgcccgcacgaatctggccgccggcgagctcgtcctcccccacgccggcgagctcgtcctccccacactagcgagctcctcctcccgcacgcatctggcgagctagctcgtgtcgtccccgagctcagccgccgccgcaccgggctgccgccaccgcgccccgagccggcgccggtccaacctccgccgccggagctcgaagccctctgccctccaccgctgctcccctctcctccggccctccaccgcgtgcgccgatggcggcgacggacgagcgacggcggggccgacgcgggtgacgacggacgagcaacggcggggctgacgcgggcagcgacggaccggcgacgccggagctgacacgggcacgagcggcggtggactgacaacggtggcgccgggaggacggaggactgacgctaggggacggagtgtcacggaacgaagaaaattcgcactctagtggtgtattctgaaagtagtgtgaattgggtgacaaatcctggaagcagtgtgtattgggtgttatattctgaaaattctcggtcgtgggagagcgaaggagggttcgccggcggccggagatgcgtcctccgatgccggcgcgcggaggtgcggcgtcgggcaggcggtgagtgaggacgatggccgggcgcgcctattggatctatcatctacgccgccgttttttccgaccttctccggcgagccgacgagataatgacagctctgctccattggtcaacgagtcaacggatttcggttgtgacttgtgagtactactatggtccatccataaaaaaaaatttggtatattttgactttccaatttaagctttgactaataattaaccgcaagtataatggcatactagtataaattaactataagcacacatagatgagataagaaaagaataaaaaagaaagtgggctgcagatttctatccagctacaatttcaaaatgttgtgtgtataagaggtgagaccatatattaataatatagtatatatttatatgcaactattgtatgaatgcgctattaaattagctatagatgattctcttagttaacgctatcgaaatttaaaataatgttaggatcgttcgttttatttaaaaaatttatgtaattaaaatatattttattggtagttgtttaatcataaaaatagtttaagcatgatttatatttcatatatttaaaaaataattgaataaaatgaataggcaaacgtgtatttaaaagtcaacagcgttaattattaaaataaaaaacggagggagtatttaggttttatcattattattggattcatgttagaaattacgttcttgtgactgattttgtaaatgtaggcaaaattaaaatacatcaaagcttttttacggtcaaatctttttacatcagaatacaaactatattaatgataagctttgttttctaaaagtcaaaatatgccctatatctttgaacagaaggagtacctccctttacaatatttgcacaagtactgcctatttatgaaatttgaccactcatcttctttataaaatattttataatcaactaaaagcgcagcattagagaagtgtgtttatatcgtaagtattataggttgcaataccctacccgcaccacaaccaacaccccaaagccatcgtccacgacatcgtcgtcctcgccgccgccaccatcatcgacatgcaccacctcgtcgtcctcctcttcctctctgcactcgtttttgtcgtcgatgtcgaccacctccccatcgtcttcgtcgtcatcatatacctcaacctcttctctgtcgtcgttgtgcacatggttaaggcggccaacatcatcggggtcaaggagaagggattgtccctcctcgtcttcttcggcgatgacactattcctttgttcacctgcgtcatcatgtcactggaatcctgtactctgacaggtggccacatgtatagctttgtcgggagttttacttttacctgttggactcaataatagtaggtacaatagtaggctataagccagctataaacacatttcgaggagataaaagaggagggagaaagccagcaggctacagatttatagtcttatagctagctgcagcacggactccaaggtgcatgtgtgtatgacaggtgagaccagatattaattatgaagtactgcctccgtttcaggttataagactttctagcattgcccacattcatatatatgttaatgaatctagacacacattcatatatatgtctagattcattaacatatatatgaatgtgtgcaatgctagaaagtcttataatatgaaacggaggaactatatgtttataggtaactgttatatgagttggctattaagttgactatagatgatttggagcccgcagttggctatactattaaacttgctctaaccaatggcaatcggaacgtacaggatcatataactagcatacgcaaaaaaaaaaaagaaacccctggtatttactaaattattttttgtgtaagaaaattaaattttgacaatgccataaattaaatctttgggtaatgccactagatctctgaccaaatttgacttgacaaaatttggcttgacatggcacgttgtggctttagaatctttgggtcaagcatgcatgtcgtgagcaataagattttttttcgtcgacgtgcataaaataatttaccaaaaaagcgcgcgcgcatcttgctatagtacatacatacatacatatatatatatatatatacatacatatatatatatatatatatatatatatatatatatatatatacatatatatatacatacatatatatatacatacatatatatatacatacatatatatatatatatatatgtatatatatatatatacacatacatacttcttcgtgttatattataagtctttttaattattttcctaatcaaacttctttacatttaactaagtttataaaaaatatagtagtatttttaacacaaaacaaacatatcatcgaaatatattcaatgctgattgctagaataataaaatatattcttaaaatgttacttatttttcattaaacttagtcaaacttaacaaagtttaatctctttgttaatcagaaaaagtcaaagcgacttataacatactcccttcatccacaaaaattacacatattacttttgacaccaagaccaaggagaaattaaattaccttggatgctacanaatcaagaagtaaataaaagcatgcaaccaatgagtatttagatgacttcttgagttctaataaaacatttaatttatctcttcatttaagtcttaaatgcataaaaactataaataggaacaacttatttggaaaaactcaaatgtgaaataggtgaaacttttgtggatggagggagtaaaataggagtatgtatattaggctaaggctgaaaaatataggtactactatcaactttcagaaactaaattttggttacttataaggccacacgacgagagcaagattgtgatcaggaatacccagaagcatgtcaagagtagtatctttattgagaagcaaaagcaagcggcaaaaccattacacactgcttgctgggcaccgtcccatggccgaacgtgaaaaacatagcccaagagagtagtacaatttacagcagcagtagcatatctccctcaattatacactcaccactcatcgtcacagcacaagcactaggtttttggtcatgctaaggaatgaaatttctccagagctagcacctaaaacctttttccgtttcggaggaaatcagctcaggttttctgacgtggcatggttacaacaaggtttcttgcttgtttctgcaagagaaaccagtcatggtcctcatggagttcaccaaatttacaatgacaggcttggaggcgacgagaagatgtcggtgaaggcttttttttactggatgatcattgttcacagttcatggcgcggattgctgatgcgaagagatcaatcttccatcttctctttgctcaagcagtgtttgattctgcaagcttcaatggcccgaggtgcaatggcggctgctcacatgaaaccatcgtcggcattgtccaagcagtgttcaagcaccatgcgtactgtaagctgcacaagggacaccttgggatgttagtttaagcccaaaccaaggtttgtaaggttcaagaacatatgccgacaaatgctaaccaactaccagacatgtttgtcatcttgcattatttttgttttttggttttaatcaacatctttatatataaacccatttgaggccatcgagtgcttgtgtgcttagaattttgcaggagtagattttaactatttgttttcctatagagtatttcaatatgtgtaaatttgctaatgtcaaatgcttgttcatagcaaaggtaaaatgacattttctttgcccaatcaagaatatacaatttagtgggcaacatcaggctaggctagataaagctacgacccgagcaacaaaagtactcatgcatgttaatgtgacaggagcagcaaggatgggtggaccataaatatctaacagcagcaatgaagtaatcatgacgctgatacccaatcgtgtgttttttcgagctcaataaataaaagaacaaagaggtaccttgcaatccaagcagggatc

SEQ ID NO: 16603 - DNA, 3155 bp, Oryza sativa
cacctatcatacacactgcgtcttggagtccgtgctacagctggctacaaatctgtagcccgctacccttctctctcctcatttatcttcttaaaatatgtttgcagctggtttatagcctgctattgtacctgccctaagaaaaaacacagagatcaaaaacaactaaatcattatgtaattaattcacatcggttaagatactacactagtaatgtatcccatggattgcattaaatttttaatattgcatgtagttgtaccaccaatagtaattaatcttggttagttgtatgcagcgcattcaatgatgctaatttactctttatataaataaataaagatatatttgttaaatgatgatcattttggaaagatctcaaaaatcttagctgatgatcaaactggaataggaggagtataagttacagacaatatatatatatttatatggaaaagagataacaaaaattgagaagtgttggttctcatgtactacctccgttccatattgatcatcatatataagggtgtgttcggatggaggtatttgggtggataggacatggcggcccattttttgtggttgtttagttggtgggcgggagtgggataggacggcacggaggggaattttcctcccagatgccagatggagggatccgccgatttgcccagatgcagccacccaagtacccaggcgagcggggcgagtgagtatcgtaggtcgtgtcacccctctcaccatgcgagctcggcggtcagcgtggaaagaaggaagctgcggcgagcccaaaggcaagaggcggcagcgagcccgagagccaaaggcggcggcagctagaaaagagtgcgtcgttgccgctcccgatgacgacgatgaccaggacgatgacaactggatctggaggagatggggtgtgccgacgaccggttgggtaggagacaatgatgatgacgacgaggatgaccaaatctagaggagacaggacagcaaccggcgagagagaaggcagggcggcggcggtgaaagaggaggcaaggggcggccacgaagaggacatttttttttatttttttttccgtttttctcctttcctccttttatttcattctaatttttagtttctatttagatttttttagtagattggtattattttgggttcattgaatttcaagggggtatacttacccctactaatgaaagggtgattgcaaccactcatccatcctactcccccaactaaaaaaaatggatcaccaaatccacattcatccttacaaccaattggatcgccatattcactccaccaaacaaaaaaaccggattgccatatccaataaagtatggaccgccatattccatccaaccttgaccgggaaccaaacacacagtaagctttcttaccaaggcagaaaaaaaacttaaactgccatgtattttatttaatacatgagtatgtggtggggaagaattaagaaacatgcatacttttaactccccatttgcacaagaaacaagggtttaactacttctaaatgtctatatgcatacatgcgcgcatactaaatttgcatgcatagatacaataatgttgcacgtcaaatgagtagaccatggtcatatgatgatcaatttagaatatccaatttttggttatataatgatcaatgaaatggaggaactagctgtacacattctttacgaaaatgcatagtgagggaaagagagagcagagaaaaaatagagttaatcttataggtagcatatcatatatgttagctctacaataaatttataacttatagtgagctctactattaaatttgctctaaataaataaatccatctagattcataatgatagaatatgctaaattcagtactatggctgtatttagtgcacaccaaaatttgaagtttagttgaaatttgaacgatgtgatggaaaagttgaaagtttgtatgtgtaggaaagttttgatgtaatggaaaagttagaaatttgaaggaaaaacttttgaactaaacacggtgtatgtttatttatcttaggacggagcaagttctgtcgactaacctttaattattttttttttaaaaaaagaaaccactggccaacttgctttgccagctaatcgttgtctcattgccactggccaacttgctttgccagctaatcgttgtctcattgccgggctccagtagtgcggctggccgcacgactatagtatgtcgtagatctgggttggtgtgcgttcttctcctaaatagggacgtggtcctcgcagtcctgcagaaatactatagcaacatcccgtaaaatgtacgatctatgcgtttaaaaaaattagaattatatccgtgaaacgtacgatctatgcgtgtaaaaaacaagtttaggattatatgttatttaaattagtatacaaatctagaaacccattatatattttttatttaagaatggaaggagtaatccatggtgcaacgcaaatagcattcccgattctcaacttcttagaactcataaaagacaagcgtttgagtctactcaagattaagattaagagcagacacacaaaacaaagaaaggtaatagcacatagttaattcagttttaataatttgaaacataaaagatggatttatttaatattctaaagcaactcctgcatagaaagtttttgaaaaaaaaaactatttagcagtttgaaatgtgtgctaatgaaaactgaagcaaattttgtatcttaattaggccgagtttagttacaaatttttcttcaaacttccaacttttccatcacatcaaaactttcctacacacacaaacttccaacttttccgttatatcgttctaatttcaacaaaactttcaattttgacgtgaactaaacacacccttagaaaaaaatggaacctagatctctaaagaatggaacctagatctctagggtacgagtaccactagtctacattaaatgctctctctgtttgttatttgacgccatactatcttttccatctctactagttcacattaaggctccgttcttttttatttgacaccttaggccgagtttggttctaaactttttcttcgaacttctaacttttccatcacatcaaaactttcctacacacacaa

SEQ ID NO: 16604 - DNA, 2441 bp, Oryza sativa
actccaggcctcatcttctactcccaccgtcccataaaaccaacctatcaagattagatatacctagaccaccaaatgccaaatccccacctaggttaaaagatacggaaactgcatgagaacatatgtaagcttgtgcaattacataagctagaccttgaaggatgtcactatcttgtcacgttgcctacaaagaagagtaaaatgaaggagcttcagtacctaaatgttctcaattgctactcactcacagcaatgcctcatgctatgggccaacttacacatcttcacacattgcttggttactttgtccccaacattggtagtagtgcaatgtcagagcttcaatcactgctagacctcaatagactatggctgtatttagatccaaagtttggatctaaacttccgtccttttccatcacatcaacgtgtcatacacacacaacttttcagtcacatcatctctaattttagtcatttttcaaactttgcgctgaactaaacacagcctatcactagtgaaccttgaaaaggtttcagacactgaagatgcaagaatggcaaaacttcaagagaaagaaaagctcgagacattgatgttgaggtggaatatggatgctggaaatgccagtagaatagatcatgaagtacttgaaaccctccaacctaaccagtgcctgaaaactttggagattgttgcgtatgaaggacatgcatttccatcttggataacaagcactgagccatatctcacatctctggttgagataaggttggttaatctgagatcatgtgaaaatgctttacctccacttgggctactgccatgtctgaagatgtggagataagccgagtttttttttttttgcgaggaagtggagataagccgagttgagaatatcagttgtattgacgataatttctatggtcagaacggtacatttccttcattggagaagctgattctctcattcatgactagccttgaagtctgggaacagtcatctaggatgaatctgtttcctcgtcttgcagaacttgtcatcattcagtgcccaaaattgagagcactgcatatggagtttccatcgattgaaaaattgattttgtggatgaataataagatgttgtacagctcgaaggaaggtctgagaggtgtagagaagagcctcgaaaatctttcaatttctttctgtgaagagttgcatgcttcttcaggctgtgagggtctacaggctcttgatcgcctcaagaagttggagatatgtggttgtcatgaattgtcatgcctcccacagggtttgcagcatctttcctctctcgccagcttgaaaattgataactgcaacaaattggagattttgccagaatggttggagaacctaccttttctacagataatgtgtttgtctggctgtccaattctgcactccattcctgaaggcctaacatgtagcgacattattgttgaatattgccccaattttaaagaaccatcaggtatgtcatcagtgctctgttcatggaaagccatgtttctgattttcattgagctattcttaaagcaattgaactagctttgatagattaaataacaattagtgtatccttgctatttctttttgatgttcaagtgaatgaactcatgttcagttattaatacatatcctcttgagttgaattggcacgatatgaagttgtagtttcaacacgtgtgacttattattgtgtgaaaaacagctgcacgagggcaaacgaatagtcgtcatgaaagatagttttacattagttcagcgatttaagggaaggccatattttccaccgctgatcttaaaacattggtcaagacaaaaacagtggtgaactggtgatcagaagcagagatttcatgatcaacctgttgatctgtttctgcaactggagattatttttaaaattgaactagatttctcattgtggatgtggttagaagagaggaatagtaaatgggaactcatgaatttaatgcttgtgaagtgtaacttgtgaaattctcaagctactgtatcttcagaaatgcatgagaataagaatgatttaggtagcaatttagaaactatcaatttgctcctctgaaattcccagctatattgtgaggcatcagcaacattattaacctgaacacaataggttggtcacctgtgtaacaaaatgcctctgacattatttggttaagccaggattatcttacaaaggggcggtaccatgcataagaaaaaaaaactagttaatactctgatatttgcatatttataacacacaatatccacatataaataacattcaaggtgcttcaagctatcacagattaagagcaggtggtgacaaattcattagttagacaacacctggcagttctcacatctcagaactcacaagagacctagaggctagaaatg

SEQ ID NO: 16605 - DNA, 711 bp, Oryza sativa
tttaaaatgtgccattttcctaaaacagtgctattaactgtaatatattatcatgacattaccattccactatcattatattttgttccaatgaaatctgaactgaaagtagccctagatctcccaataaaattttaaaacaatcaagaaatgcttaagaggtggaaaagaagccagcaaagaatcataccataatccttcatgaacttcttgtgtcgatcatacgcattaagcccccgaatgtgcgattggtattgcctgcatccacaaccaatccatatccatcagatgaaaaataaagcgagcgaactaacaaaaagcagtgcatctatctaatattccattgcccttgagtggcaaatcagcctaacttaactcctatctcgaagcaaagattgcaaccaacaaagttagggttcatcgacatcatcacttcccctattcgcactgacccccaacacataacggagcacagaaataccccttcaaaatcacactttgacagcaacagcgtcaagaaatgtgaagctagaaaaaacaaaggtttctaatcgattcgtgccacacacaaatccgaaagaaagggggaaactttggtgcaggaacagaatgagatgggacggggattgggcagaaaagcaaatacatcttcctctcctccttgacaaagatggaggatttgagccttcccagcgacgacgccatcgagct

SEQ ID NO: 16606 - DNA, 6047 bp, Oryza sativa
aatgtaaaggttgaaaggtaaaaggtgagctaagctaaagtaaatacgcattgctcggtctgttatgaaacactgtcatatatttccctctgttgttattgttcttccaatgattttctgcatcctgcagagattactttgtcgagtctcgactatggagatggtgaattggtgacagatgattcttgttaaacttgcttcttacattaaggatgtgtttagttctcgataaaattggaagtttaattgaaattggaacgatgtgatggaaaagttagaagtttatgtgtgtagaaaagtttcgatgtgatgaaagagttggaagtttgaataaaaagttgggaactaaaccagacctaactttgttgcccgcataagttcagccttttcagaaatatgttctttgttggttgttcaattgcaacctgcacgcaaaaataatttgtccgtcttttttccgaggacactgggccttaatgtgaactcagttaacaaaaatgtgatgaattggagttagtgtgacccaagaagccattatgaatgatattaccgctgtacttgcagacttgcacctgaattttggatttgagataggcagagctcctgccattttcctttaaaaaagataaaaggatttgagttgatcgagctgtcagcttcaggcatagttcaaggggaagtaacttttataagttgcttgttcagttctcactaggatttattttttttgttttgaaaataaaaaccgttcttactggtttaccgaaaaccaataaaactagtaaaaaaacgacgactttctatcaacacattatgaaaaccaactaacggtttccatgaaaacggatcggttttctaaagccatcttttcagataatgggaatagttttcgatccctatttaatagcagtagtttcttttgccttatgaccaaggtttactgatacctagttaatagttaattgaccgtactaaccttttatccgtctgtgattcccttcgctataaatcagggcagtaagatattttggccttttttttcaactgtcattttcttcagaccagtaatcaggatcaaatgatcattgtttactagaaacagtccagcatgtcacacacatggttgcctggatttcttgcaagatctttccatgaaaaaaaatgttgatattgcaaggctaatatagaaaaaggcacatagtagaataggctttcagcgtcagtgcatctccatgtgggaccctttctctgccgacatcttgcttttggcaaaatggatagataggaggctcatggttgtcatcaaacctgaagctgtaccttgaaatcaagaatttggattacttacgccgtgtttagttccaaaataattttttaaacttttatcttttccatcacatcaaaactttcgtatacacacaaacttctaacttttttatcacatcggtccaattttagtttgaactaaacatagccttacatgaatacaagtttttttttttactgaattcttactaactctgacgaggcatgtgtgagttcatctagatttggtataacttccatctaaataaatcaaacgactgatatcgttgtttgtagaaattttgtaaagaaaatttacatgtagcttaaaaaaacccatgtgtatttgaagtattcccttctctgcagtcactatcaagtgcaatctgtcatgtaggattatttattcacaaataaaatgggttgtgctataatttttctaggttagtttgtttttgcttgggtcaggatgacagtgactgcagatacagacaatgggagcatgaagattaagagtttaaaaccacatgtgagactcatcatccaatcatgcatatagctgtcaatactgagaaaaatactgtagaaaaatacataaaaattcgcatacgtcaacacctctcaatttgtttctcaaaaaaggagtacaaattgcagccgcctttggagaaaaattctaacaaacaaaacactttaaaaagaaaactctgcaataaggtctagtttgattttctaattttctgatgacatctgagggctacaaaacgatgaatgaactacttcaaacttaaaaagctgttttaaaaatactctaatcacttttaaatctttttcataaaaaaaacatcccgtttacaagtttcgaaagcgtgcccacaataatttataatctataagaggaaaatatttggccctaaatctgcccaaattatttaaccacctgtaacaacttcacatacacactagctcacactaatgctaatttgttaatcattaccagccaaagtttttaaaacgttaattattccttgtaaagagatactccctccgtttcaggttatacgacgttctgactttggtcaaattcaaactactctaagtttgattaattttgtagaaaaaaatagtaatatttacaacactagcagagtttcattaaatatataattgaataaatttttataatatatttatcttaggttaaaaatactattacatttagagtaatttgattttgtccaaagtcaaaacgtcgtaaaccgtaaaatggagggagtacaaaataatgaaatatttactccacgtggcgttatcccattggcttagggcttccaacccaagccaatttctttctcaatctctccctctataaaaataccaaccaaagaggaaaaaatcgctcgaaaaatacaaaaaaaaaagaggagaaataaatcaaacacctctcgcccaccctcccccaccagatgccggccacggcgagcggcggtgcgcggccggaggaggcggcggcctcggcctcgccgccgtcgccgaccgcgtcctactgcatgggcacgaggccggaggagctgacggcgaggctggccgccgccgccggggggcgacccgtcggtggcggcggcgggggtcgccgtcgaagccgccgaggaggggaggaggagggggagcacaagcgggtgcgcacgctgcgggagatcaagaaccagatcatcgggaaccggaccaagaagctccagtacctccgcctcggcgccgtgcccgccgtcgtggcggcgctcgcggggcccggggcctcccccgccgcgctcgtgcaggccgccgccgccgttgggagcttcgcgtgcggcgtcgacgacggcgtgcgggccgtgctcgccgccggggccgtggcccacctgacgcggctcctcgcccaccccgacgagaaggtagccggtctcttgcttcgcttgcttgctcacttctatggatttccgatttgtatcgggcgtgaaatcttttgttctcgcctagcagaaatttgttttccttttttgtggattaattattcgtctgggagaagatctgttgcgtagaggagacttgctcggaactaagcagacagcaagcaactggttcttgcttgatttcttgggaatcatatggtgtagaatttgggttatgtttgcaatttgggaacaggaaaagttggatggcaactgaattgatactatgaagaattagtgattagattggttaacgatttttctttactgctgatattgtaatttagggtgagaaaaatttactggtgcgatgtgaagagtatttgcttactagtccaatttgccatgaatgcatttttttttactgtgtcatcaatgtgtttggtaaataaggtttagaggtgagtaagaatatgaaaataaatgtggtaattcgatagttgctttgtgaattggttggaaagaaatttgtactagggggatcatgattggtggtttgggttttgcttggaatgaggggaattatttgatctgaactataggctaatctgtcggtttagctaagatgagaggtactggtggttgtcatttctttttccttttcttttttaatgtccttttctctctattttattttaatttttttgattaaagtactgaaggtattgttcaatttatgcttgaaatgtgcagagtttggtagtgggtcaatggttaggtgtagtggtggggatgaatgtgctggaaagttgtctgtttcgtgttagtttcatgatgaatttgtctgaactgataactgaattggctttacagatgtaagcatgaaataagatgtttaaatagcttcctctgggtcatggtaaaactgtagctcatactatatgcttgaactaagagtttggcagtagtgtgatgttttgtgcaatggtttcttggtagggaaattttgtgctgaaatccttattggtttgctgtgtaactggaagttcttgattgccaggtaggatgtgggtgccctttttatttgagatttgaaattgacagttgaaggaaactttaaggaagaaatcttaacactaaacaaagtcatgaggcaattcaaacttgtgattcttccataacaccgaatatcctgaatcactaaagccttctttgtatgagctagaaaagatagttgtatcatcctaacacaatccacatggacttaactcgtaacttgcataggttgtagctcaaaatttggttacccaggtatatctcctagcaactttactggtatagaagtacatggtatagaagtacatattgcataaggatatggtgacaagtcaatgtacaacttcggggaggtatacttacattgttgtcagctactcccagatcagctccagtattttgaagatacagccatgcatacctcaaaccatatgctcattgtgcctttatgccccaattactagttatagctctacctcttccatccctccctattcaattcttactgaccaaacaaggtagccactattaccaccacatcccacatcccactgcctccttccccatgttgcttgtcgcctcccttcagtctctccctttgttgcatcttcaaggtggaggaagtgatgatgaggcatagggcagctgtttgtgttacagaagtgacaattagaaagggggcaaaacatggtagatgggttgaaacaagaaaaagagatgaaacaagtcaagctactttggtagctctctattgtcccatctctaacatccttccctaaccactcttgtcgagttgtcaggcattaattctttcaagatttgctatagcactgttctaaaaggcgttaggcatatacatgcagcagggtggtgtctagttcctacactgactagtcaggctaaacaaatattaggtgctaaccagtatggtgatgcctggggccttttagaacagtgatagtgggatgccaatttatctgaaaaaatgatttgccagttgttattttgctccttatcttgtctagtattgatatttgaaaaaagattgcacattcatattaaggacataaataaccaggaaaggccacaatatacagttattcaaagcagggatactcgctgctttggattaaccagctagcttctgggcttcgctttaacattctgttttggaaacatttataataactaaatgctatcttaagcatctagtttgtacagttgaacttgtaacaatacatgaatgcataagagttcatatccaagcaccctcttcattgaaacatggtgttttggtgctatctgatattctgattattttcatgttatattgaattgtttataaccattaatgcatactatgaataataataataataatatgatctgacccgaggttatattctgattacaggttgttgatgctagtgcacgtgctctcagaatgatttatcaatcgaaactagctccaaagtttgatgtcaacaataatgagaaaaacatggaatttcttcttacccttttgaacagcgagaatgaaaatgtcacagagcttgctgccaatattatatctcactcttgtgatagcactacagaacaattagcactatgtgctgctggagttccgcaaagactttgttaaccattttggaggctccatgaatctacgggatgcttgcttagattctttgactgcaatcataagaaataactgggaagttgcttcaagatttgcactgctggaccatggaaaagctt

SEQ ID NO: 16607 - DNA, 760 bp, Oryza sativa
cagaaccccagagtccgcacatcctcaaatacaaagcactttcctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaaaaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcaccttctatttcctcaagggtgaggaaa

SEQ ID NO: 16608 - DNA, 16870 bp, Oryza sativa
  unsure (1)..(16870): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttctcttcatgcacaatttgacggctggcttggatagtggcctcaatgtccttacgttctcgccgttcagctatgcttaacttggctttctccaggttgaattggtgttgctcaaggtaaacggctggagtaaggatatcggctaactcatctaggattaaagcctgaatctcgggtagctgagccctgattgagccacagtcaaccactaagttgtctagcgatgatgcttctagccgatctaaaatgcttccttgagttttcttcacatcatcagataaaggagccaaggctttgcttgtggtatcttcttctccttcatcaagatagtctctgatgtcaaaagagaaaagatcggctaatacctgcagtgacaatttagaagcagattagaggttaaacgattatagccgatttgaatgcttcttatgataaaagaaacttactgggatagcaggagcagctggttgttcttcttcctcgatgtgatgacttcccgcagctaaaggggtatgatcacttgatgattgttgaacaggaggagaaggaggaggtgaaggctgaaaggaaacaagtgtcagatagaatcggctaaaaattaactaatgaaagttaaaactatcttactggtggagctggtttagatgttgttgcagccgatttcttcttcaccgcagtcttctttttctacaattataagacttggtaatgatcggctataagacaaaataatcacgaaagggattaaagagagacacttacccttgagaagtgaacaagagcagaagtgtcacgcccggaatttctatccaaaattccaaacgcttacatgtgtgtgaaccctcgtccaggaatcagccgaggcacacaataacaaattgataatacagtacaaatattactctaattaataagcgaataaaatgtcattacagaggtagatagttcctctcaatcaataaagttctaagcagcggaaattaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaatttaacaaaacagttaagtaataattaaacaatattaatccaacgctatacaacataccctgttgtataggcccaaccattctgaacaaccaccccggctgcacagttctatctccaaaccaggaatgtaccattccaaaccaggagctaatcaaattattaccagttatagcatctcttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcaataagccatcatgaaataatagtgagtcattagttatcccataagtgtactaaagtttctaagcagggctaagcaattatatctaatatctagttgaaccaatataaataaaactcaactagtcaaattaatataacccaaggtatcaaggaatatggtaatcaagtacgaaagggccataacaaagaataggtcaattccacccaatgacattcaaaaatagatgcaatagttgaatagaaacaatagctttaaataggatcaacatgctcaaagggttgtttgggatctgtgtgacttgccttgctggccttggaattcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggttaaaattgaattatgacgcaataatgaattatttttgaaaaggaaaaggggatttattgcgtcagcggctagggtttgggtggaccggcgcatgggcggcggttcacatgaacggacggccgagattgatccgatccaaatcggatggccgagatcgatcggtccacgaccggctcacgggagaggatcccgatgacgtcaacgatgacatcaccgacgacggcggcggctcggcgaagaagacggctcaggcggcggacactcgccggcgaacggcggcaccacggcaccaacggagggcaccagcacgtagaggacaacgcggcgaacacaccggtgaccaaaacggcggcggaaaaggaacggacgacgacggcgacgagaaggaagcggcggctaccttcgggttgtcgacggcgacgaagctccggcgggttccgacggctgcgaaggggcggacgaggacggcggcgacttggcgatgacgacggcggtcttcccgagcggcggcgacagctgaagcgacggcggagcacggctgaagcggcggcggcgacggcgaagctagggcacacggcgctagagctcttccggcgacgagaggtgaaggcgagggtggcggcgagaagagaagagcacggggatcctttaaaaggggctcggaggcggcggcgaaggcccacggcgacggcaacggcgaaggaaactcgcggcttggagagagggaaaaccgatccgaatcgaactcgtctccgacgctttccaaagcgatttaaccaaagattccaaaggagaaaaggtagaggagatcccggagatcatttcccctctaacaaatcgaccggagaaggaaaggaacggccggatttggaaaggaaacggcggcggcgcgaaactagggtttcgggcggcggcggccgaaggttgacgacgactgacaggtgggccccacctgtcagcgaccgaacgcgcgcgcgcggctgcggactgggccggctgggccgaggagagagagaacggttttgggccgactttcggcccaaagccaaaagaagactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttcttctcaagactttttaaaattatttctaaaaattccatttaaacaacaatttatatattttgaattttcagggtgtgacaagaaggagttggaggggtttgcttaggcgaagccgatggtgttcttttagtatcacttaccttggctgcggcctgatcaacctcgtcttcaattacctcttcatccagagcttgttcgatggatggatctagggtaggcagatcatcagttggcttggttttctttgtcttcttcttcttaattggggatacgatgcttacagccgagatctggttttcctctttttgccggcatcggctgattctctgacgagcccttgaagaagagctaaggtcttgggggcatcatagccgataaccggaggagatagcccacctccgttaggaattaaacctggggcatattggatgtctttgccactgttgctttgatgaggaggggaagattctgttatctgcaaatcaaaaggacgattagttgagattaattggccaaacagctatttaactaaaattgagcaaagttgaagacttacttgacggacaacatctagaaagaggtctgtcatgtacattgaagctggttggtggaataaatgcagtttccattcaccctgccacctgtcaaagcttttgcttctgaatgttgccagttctatgttgttaatactgcccagagggggtccttgaaggctaagtagccgatccatcatcagggttgatgaaatccctcctcggcattggatcttgtcagcgaagaataagccgattgggagttggcccattccgagttgtctagctgagctcattggatgatagaattcataagaagcttggatgtttcttccttgatgaatgccaacaggaaggatgcatgggctgattgcagccgagaagatttccctggatgattggtatacttcatggttgatgtctttgaatctgaagtccactgggtgttcaagttgtgcagagtcttcataaaggaaccagactctagcatctttttgaaagctttcatagaagctacaaaaccaatccttgagcagttcagccgatagttttgctccggcatcagttggtgtagaagcgtattctccgtatgatgtgcatctccgatgagtacgctcttctccatcatcccctacaatcggctctagtcttgggaactcagcttctgatacggatggccgattgacaaccttcatgactatcaggtttaaccaggtttgtagcagccaccagggtccacctgctccaactactgagccgactgttatcttagccgatgcattgctcaacatctggtatagatagccgaggagaattttgcccaaggggaattgtctctttatttctagagcttcagccagaaattgccagttagttgtggggccgcaacttgatccacagaaaagaaatttttctagccacattaatagaaaggccacatgttctcgaggggtgaccgagccctggcccatgtatgctgctacatagcctgaccaacctcctatgcttttggttttgaagtcatattggttctttgtgttcaaactcatagggttggccgatgaggtgacatccagacctatgatcatactgatatctatgaaggttggagtcatcggcccttgattgaatagaaaggcgttagtagtgtttgaccagaagcaagaagcggctgccattaggggttcatctttggctgagtttgctatagtaaggtcaagtgtttggccgattccaatttcatcctagtgaaccttcttgctagctgatacacgtttgaaccatgtggtccagctcttttctggtggaactttctctagagatggccaagacttgaaagtattcttccagtgatctagatctgggttggttaatctaaaggggattctattggtttcaccaacaataaactcggtggggtcaggattgccgattgggccgagaaaatagtggttttcatgcgtcagactgggaattgcgacttggtgagaaagatgctacaaattcgaagcaaccaaaagaaggaaagcgatatgagataagagaagatcgatctgctgctaaagaaggggatttagccgatgagaacttacctcagcgtattcggccgatggtgcaccagatgggctggcagaagatgacattggtgcgggcggagatctcgtcggggaggaaatcgcctaggaatcgcctttgcgccagaggaatcgccgaagaagagagagagaaaacggaagtcacggcgtgagatttctcgggggtaagggttagtatttaaagtgctggaataatggtcaaaagcggcagagtgcgaaactcgctcggagtcggcatacggcaaatccggaacattatcgaatatcccggacttggggggcatgtgttaacaagcaaatttggtaacatctgtgttaggaaggaggatttaatcaaagcggagtcggaggcggagatcgagttcggaagcagagcaggaatcggctggaatcaagatcggctacggttaggatcggttgtatctgagtcgggctaaataagccgatatagccgattctgacaatacaacttgtacgcgacatcgggttcaagttaatgtatttcaagatgattgccacgcacggagagagtcttgggaaggcaattgtatctattaattaggatatcttatgtaaattccttatagataaatgtgggcaaaagtctgccgcaaagacttatagtatcttagagtttgttagagataatgatcatgtccggtatgggcatatcatgtaattctcgggtataaatagaccctgagccctatgtaattttaacacacacgttcaatacaatctcggcgcatcgccacccttttttgctttagttttgtttcgactagttgttgctttcgggttgagctgcatcgatttcgatcttcagcaagaggtaaaattcattatgatagattgcgttcttaggattagtacttccatctttatgatactctaatcttgtgtatgtaattcgtcgagttatcatatatcttacataatctctagcaatatcatcatgtaacctactgtcgtctaacatctgttgatagagggcagccgattaggttaaatctcgtcgttgatctagattatataagatatctaccattctatgaaacttctagcgacttgattgtctagatatcgttcttcttttcatacttaatgctgcttcagttgagtttgatctattaagtcgtgcttagaacatcgatctctagcctgccttctagttgccgattagaatagcatcggagtttcagccgatcgtatgtgatttaactatatttattctatatgtttcattgatatgttaaatctgcactttatatcaagatattgccgtatctaaatatattaagcctttgtttgatatattatacctactttaatatcctgatatagagttgtatcggagtattagccgatacatgctagatctatctgatcggctatgctataaacatatatagtcttgttattaacatatattttgatctaagtgatttatactttctcggcatgatgaccgatctatcccaatcacttgatttaagtatacgtcgatataaggagtatatattgttaatatctacagccaatcgagtagatttagttcttccttatttattcatgactgccgatcggtacacagatgacatcggcccaaagataaatgatatgtcatcggcatttagccgatcggctatcatttatagatttaaccacggtttctttgcttctatttcttgttgattacaggatcaaatcaactggcacgctaatacatccgaaggcgagctttcgacctgcactggagttaagcagatctcccaggccacgtgttttctgtcaacagatggtacacatatttattaattctaatttagtacttacttatttaagagaataaaaaccaaagagtttattagcagtaaaaactgttacaacgtaaggtcatgataacatatcaaatagatcacaaacattttttactgacggaatacctgagtggattgcaagctaggaacactgcatggattaattgtattccctccgtcccaaaataaatcaacttatagagtttaaactttgtcccaaaataaatcaacttctacctttttcatccaccctagtgctttggtttcgtcttcgacttctttggatgttggtgcttcttcatcgaagtcttctgttcttgctttatttaatgccatgtccgatgataaactcgaacagttcgaggaggaggatttggttttgttatctaacaaattttctcgagctatgaaaaatgttaggaacaggaaaagaggagaaccgaattgttgttttgagtgtggagcacttgatcatcttcgctcacattgtcctaagcttgggagaggcaagaaggaagatgatgggagagtcaaagaggatgacgtgaataagaagaagaacacaaaggagaagaagaaacattgcatgcagtggttaatccaagaaatcataaaagcttttgatgaatcggaagatgaagatgagagcaaaggtaagcaaattgttgatatagcttttattgctcgtaatgcaaattctgatgttgatgaatctgatgatgataatgaagaaaagcttagttatgatcaattagaatatgctgcctacaaatttgctaagaaacttcaaacatgttctattgtgcttgatgagaaggatcatactattgagattcttaatgctgaaattgctagattaaaatctttgattcctaatgatgataattgtcaatcttgtgaagttttattttctgaaattaatgctttgcaagatgtcaattctgttaattgcaagaaattggaatctgagattgaaaaatctaaaaaattggagtcttcttttgctcttggatttgctttacatgctcatgttgttgatgaattgattttgacaaagaatattttgaaaaaatacaaagttgctttttgtacaagttctttgttcaatgtttcatgtgcaaaaagggctaaataaaatgagggtgttttgatttctcaagattgttcaaagtgtgttttgaatgagttgaagttgaaagatgctttagagcgtgttaaacacatggaagagattgttaaacaagataaggtgttttcttgctcaacttgtagaaaacaaaaaggtcttttggatgcttgcaaaaattgtgctattcttactcaggaggtttcttatttgaaaagttctttgcaaagattttctgatggtaaaaagaacctcaacatgattcttgatcaatgcaaggttagcatacataatcgtggtttaggttttgattcttatgcttatcatactagacatcctcctactattttgggtgttgctaggagagatgaaattttgattgaaactgagcctaagaacactatgtttaaatctgctggcatcatgtcttctttgaatgcatcttcttcgaaatcaaatgttgtgaatgcaaaaacttctattgatgcaaaaccatcaatttcaaaaccatctacttcacaaactagtcgtgagaagtacacttgttcttttttggaaaagacggacatttggttggtttttgttttagacttgcccataaacagaaaaaagaaagagaaatagcttttgcaaaacgacgttggcaaaaatcgggttttaattcgaggatcacggttagaccgacactgaccagtcggtcagaccggctagcggtcagaccgcagttgaaccggcggtcagaccggttgccaggcccagtcagaccgcaggtacagaggcggtcagacctgtttcagggcaattttgcgcgtaattcaaatcggacttttgtgaagcgaaaaggtaatttttcaggtaagtctgattctgattttgtcagtgcttttgtatcacaccctaaaaatcccaaatatataaattgttgtttaattggaattattagaaaagattttaaaagcctagaagaaagggtctaattataaataataaattccaatataaaagtggaccagataaaattttattaaatactttgcttaattctataattcctagattttttttctaggacttatttgagctaaggaagtatttttaataaatggaattgcatttaatgaataatttaaattgaaaaaggtttttaaaatcctcttttggctttgggccgaaagtcggcccaaaaccttctctctctctccccggcccaagccggcccagtccgcccgcagccgccgcgtgcgagcgccctcggacgctgacaggtggggcctgcctgtcaggtcgtcgtctacctccggccgcccgccgcccgagccctagcgctgcgccgccgccatctccttccaaatccggccgcccctttccgtttccgatgaaattaatagaggggaaatgatccccgggatcccctctatcttttctcttatggaatcgtcggctattttcgtttggaaatccgtggattcgatctcgaatctgattcgtctctctccccgaaccctagaccttccttcgccgtcgtcgtcgccatgggcctccgacgccgcctcctagccgctataaattgacccccaagcccgccgctacccgccgccaccctcgccttcgcctctcgtcgcccgtagagccctagccccgtgcagcctagcatcgccgtcgccgccgtcgctctagccgtgcgccgccgttgcttcggtcgtcgccatcgctcggggaggtcaccatcgtggtcgccaagtcgtcgcagtcctcgtccgcccctccgccgtcgctgtcgaccgccggaacaccgtcgccgtcgtcaagccgaagagcgccgccgcttcttcctcgtcgccgacgtcatccggtcaccgtccgtcaccggttaggtcatcggtgagttcgccgcgtcgcccgcatcatttcggtgctctccgttcgcgccgccgcgccgtcgttcgccggcgggcatgtgtgcccgagtcgtcgccggtgatgacgtcaccgctgacgtcatcgtcgtcgttccccgtggcccggtcatggatcgatggatcttggccgtccgttttggatggatcaatctcggtcgtccaatcttgtgaaccgccgccgcgcacccggtccaccgtaaaccgacccgctgacgcaataaatccctttttcctttcaaaaataattcattattgcgtcataatttaattaaaatccatataagtgttttaatccgatttaatctttaaaaattcataactaattcatcttagctcagatttagttggttcaagtctctaaatttttctaaaattgagatctacatgttaaaaatatccacatgtactgttcatgcttgtttatgtgatgttttggtgattttgctcttttttctttagattccgacgtttccggagagtctgagtttgcaggagaagattttgaagagttccaaggccagcaaggcaagtcacacagatcccaaacaacccttttagcatgttgatcccgtttaaagctattgtttctattcaactattgcatttattttcgaatgtcattgggtggaattaacctattgtttgttatagcccttttgttcttgattactttattacttgataccttgggttattataacttgactagttgagctttatatattggttcagctagatattagatatgattgcttagccatgcttagaaacattagcacactattgggataacttattactcactattatttaatgatggcttaatgatagctcatgatggctaatcatgattggttaattaattaatttgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttaccttttgtatagcatggttcattgcggggcaccaaactgagaagtggcggagataagcccacgggggtcgctggggagtccatgccttgttttataagggggtgattatgatccaggaacagtgcgctgtggcggattgtgttgtgagaggggtactgtcacagatcctttccgaggtaccgtggtggtattgaggcgcatggtgacatgtcatggggctgtgtcatgtgggtacagtggtacatctctagccagagtaaaactattcaaatagccgtgcccgcggttattggcgggtctaacaatgtctttcgtgattagtctcacaattctcatcataataaaagatgctataaccagtaataatttgattagctcctggtttggaatagttaattcctggtttggagatagaactgtgcagccgggatggttgttcagaatggttgggcctatgcaacagggtatgttgtatagcgttggattaatattgtttaattattacttaactgttttattaaattctgaaatgtttattaaatgctgtttatgcaaatgaaaccctactatgctatcctttgttatcctgtgcacttgcatatttgatgcgtgacttgctgagtatgtcatatactctccttgcaatcattcatcagaggaggagttctacagtgatgctgatggtgtggaggattaggtgtagccctggtcaagctgcctgtggagtggagtcgtctgcgccgtttatttttttttctgctgcttagatctttattgatcgagaggaactatctacctctgtaatgacattttattcgcttattaattagagtaataattatactctattatcaatttgttattgtgtgcctcggctgattcctggacgagggttcacacacatgtaagcgtttggaattttggatagaaattccgggcgtgacattttgtacctactggttctactggtcgtgtgactcagtgttggattccaaaatttcttatttctaaccccaacatggaggcctcgacatcttctcgttcgtatatattttggcagcatactccccatgagcgttcaattttaagatgacgattgcttttcaaggtaacatcaatttacatttggattgacatatattttgttctactttcttaattattagcttttcatatgctagtgtttgaggtagtagtttttgttaatactagtggatacatatcaattcatgagaactttggtgatatcattggcaattggatgtctttttcaaaatctttgatttcttcttgatttttgtttggggagaattggaggttaatttgagggggagtttgtactttttcatgcattcatgtttatttttatgcattgtttctaaatctgaaaataaataaaaataagaaaaagaagagctttgttttatacctttaatatattcttgtgcatgctagcaaaataattgaggtatatttgttgctattttagcttgtatgcattttagtctttatatggggcttagatattgcttttaagtgagatgatgcatgacactaattcttttacttgaattaagaaaatatgcaatattgatgctagcatatggtttgatttataaatgcttatgtatatgctttgtaattgctcattgtgaaaagagaataaaaatgtgaaaaaaatgactaccgaatccttggaaacagtctttacgacaaggacgtattcgatgtgagcaaaaaaagggtgccgaatccctggaaacagtcttgacgacagggacgtacccggaataaaagaaacaaatatgagcaaaaaggctcaagaaaaagtaaaaaaattatcttgattgttttgtgctaaagctaatttgagaaagagtgataaatgcaataggtatatatgtatagtgtttatttttcaacctatgtgcttgtgaatatattgcattataaatcatttgaaatcatgaattcttattgttgatttgagcttaatcgtaatatttttgattcatgtttatactatgaagcatgcttgttaactagttgatgaatttatctaacttatattgcaaaacatgatcttgaattgcttttggtacatttcaaagctctcgaaaaaaattgagaaaatataaaaaataaaaaatggttattccaagtgcaatcatgacatcattgcatttgtactttattgttattttttctcttttacattcttgatgaaatcattgtcaaagggggagaaatatacaaaatgcatacttcttgaaagggggagaattgaactttgtttcgattttaaaaaatagtcgattttgtgctttgattgcaaattgatgggagaaattctttcttttaaaaagggggagagattttctttttcattttgtgatttttgtttttatttttcaaaaacacaaatttgcattttggagatattgccaatgtgttcatcaaggggaagattgtgaaatcattgtcatgattaatatttgtgatgaacaattggctgtgcaaaatgatttaatcaacgaattggtttgaaaagacgtgtggatgttggtgtgagtgcgtgtgactaatgtgggtcaggttgtaatatctgtgtccagaaacggttgttttgtctgattgtgtgcaggtgacttgaggtcagccttggtcaatggtgaggaccgggactatgctcaggaaggagcagaggtctagtgcggtcgggataccatgtgagaaggtgactagagttatgattcttggaggtcaacttcggtcaacggtagggatcgggactaaactcagggaggagttgaggtccaaacggtcatggataccaggtgacgaagttgaatacgagatggcacacggtggatggataccgtgtgggagagatcttcgcaacgggcttcacgaggtgtgcgtgcaagcgtcggtgttcacgaggaggaacgagagaagatagagatgttcatgtacggtggagtacatggttgctacagtactcgatgtactgtagcgtgtagtttgcatgtacgtgatgtacatgtgtgcaggtagcatgcatgtgtgcatggtgtatgcatgccgtgacttggactgggaggagcagcagcggctcggttggatggcaggccgagaccgagctggcgaaggatcggtacgaaggagtccgaccccgagcaggaaatggcaggcgcacgggttggttgctgctgtgtgttttggaaattttggattgagtcccattagaaataggagttctacacctactttaattatgggttttttttataaatagagagagagagcgtgaggtttccggtatcgcttttcagagcgtggagttgatagtttagttagggtttcgagattagtcgagatttttgtaaggagtgctgttgttgcactttgtaaacacagagagaagaaataaagttgtcatctactttgagagttattcgatttgtgtttcatcggattcggcggtctaaccggtgacataccgacggttcaaccggcgacaagacggcggttagactggcggcatacgagcaatccgaccggcggcgacaggactacgtcgagatttccatcgatttgagggtaacttttatttccgctaaaagtttttgggtttttcgttttccctaccattcaccccccttctggtaggtttggttgcttgtgttcgatcctacaagcatgacacaaaaagatgatgggcttctaatggcccatgccgttgatcattaaatcagcagatgtcattaaagatcaatggtaatgatggaataattttctaaataaatcgtcagatctttctagttaacgtgagagctttctcaaagttcagggtccaagaagaaagttgatgatgatctccccccttattgacgaatcaagtcatggagaaagaaatcgatgaagctgttgctaccatgagtgaagaagaacaagccgataaaaaacatgcagcaaccgatcaagatgaagctatcaacattgatgaagacagtgaatctgatgaccaacatccattgcctccacgcaagcgtagagtaactcgcaagaaaccacaccaattgcctcagcaagattttctgatctcatcaatttcaactttccaaccagaactgcttagccgataacaatttttatacttgtgagcaatcctctgataagcaatcctgaattcttcgatgagcgaatcaataatcatgccactttttgttatcttgaaaccgtaggaaaacgtgtccattagcttgaacccctctccctccccaagctatggactgggcatctcctcgaagaagtccaaggaacactgagcatattggaggcccttcgatcaggacccctctaaaggggaaaagactagccaaagcgcaacctctagagaggactgagaagaagggcacaaagctgtgcattgtagagtcggatgaagatgaatatccttcacctggtgcaaagcctgcccaagagccgagcgccgatgcagcccaagattcgaaaagaactcaaacggcacccagactgaacagggcaatcccaaagtttagggcctcatctaggtaatcaaaacaaaacttggcttcctgacctatcaaattgttcaaatgctggtgaatgatgtcaatgatgactactcgtgattaatccttattgaagatgtcatttacataggattctatccatgtgacaactttttgcaggaaaccacaaggcattgatccttctagcaagcctaaacctttctgggaaaactagttggaaaccactagggaatcgactgctgatgaagagccctcgactggttgccagtcaggttcgaccggcga

SEQ ID NO: 16609 - DNA, 11864 bp, Oryza sativa
tcaagtgcaggtccttctgcagatagtgcggagaaagtaaaagggcctccccaaaagaagccgacaacaataacaggtaaaagacctcacgaaccgtatcttggtcaaattattctgcttgcccattgactaattccaagcgcaaatcctataatcattgaagatgaagagaagatcctaaggataaagtctgttgaatattctctaccatcggtgaagctctcctggcgtgatgctaacgggatcacacatggtgtcatcctcaacaagcagaaggaggaagatcgccattgttggtgaagagcctaaatgactccaccaggatgttgaatgtaagctttaatcttctttgtcttctgaaatagtccttgtatgaaaactcatagaaattcttatcctaatgaagagaatatggcgtcaatctcaagccatatccaaaaccctagaaaagcgggtggcgcacttggacactctggaagatgttcaaaaacaactaaaggatgccaaggatgcaactaaagctcgagaggcctagttgttgacagaaataaacaacttgagagatgccaacttggagcttcatggaacactcggaggtaagtgtaatgccctagaaaagaataatatcgtagaagatattttggaagtccatatgtatttggtgtttgaaaaatagaagaaaaaccttaggtatactctagttgggctagcttctggctagcccaaggcccagttgccctccgcattcccaaaaccctacgtaggggacctcctagggttttggggaaaggtgaagaaagaagaggtgtttttatgttgccgctgctcatcgtgacctaggtatgaaaccaacgatcttttccccctattttggttttcttttagggtctagatcaagtgttgtaagcgagtaagttaggatgaatcaatttattcctcaaccaggtttttgctaatctgcgcctacgcattactatctcggctaccttttcggccaacataataggatttcctacgaaaagtctatacaaaagttgtagataacgtgtagatctatcttctgatcaaatggcatgattttatctagagaggtatcaatttttgaagttggctgtctaaataatcatgcattttttgtagtcgagattcagagggattttagagggtcttaatgatggaatcagagaatcttgtatttacaaaaattgtagcatgttgtgatctacctcctatataaaaattgttagcatctatcttgtagtttaggcttcagtggctaggtttcttgtgaactgggggatccgcttgggagctatggttttagtgatgaatttttctgttttgttcttccatttgatgtaatggtgatgcaaacgattttatttgaattttaggtttgatatgtggaaatgggatgattagatttgaatttcgtttttgattcatggaaatgggcagttgaatgcatgtggtattcttttttgttgccaaaatccatctacactggcaatcgccttaactcgctacttgcaaaaattggatttccgcaaatgatcagttaaacctagctgcttgcaaaaacaattttcgctggcggctggattaggttgcccgccagtgaaaatggtttttccctagaggctggtggccggcattgaaaatagtgtagtttcaccggccattggttgatggcggcggtgctggccatcatagaaaacccaaactagccgtcaggaaaaatcaattctgcagtagttggatctggtagatgtggccctcggcgatgacggtggtggtgtcacgggccatagtcaaagaactcgtgcggggtgtggagtaacacatacatccattttcgtagtgagtaaaataaatctattcgaatagtcgtgctcacacttgtactactctttttatagataatggaattgaatttcggcttttgctttaagaaagctataatcacataatacaaaaatccgctcaacagagagcacttgtactactctttactagccttagaagttttaatcttgcttaaaataggttttgggaagaacatgtgaccagactcggtatgcaggaaggttcgaattggttaaaaggtgaattggacacgagggtaaactaaaccggataattaatgttgctttcagttaaaactgtcaagttataggtttatcaaatgatttaaaaaactagctttgtacaaataaccaagttatccttagatccctatgtgcactcatgcatcttgtagtggtggcttgttgagtactccatccgtcataaaatataaaatataagaatctagaattggatgaaacattttctagtactacaaatatgaacaggctacttgtctagattcatagtattagaaaatgttacatctagttctaagtttttatattttgagatgaatggagtactatgatactcactctttcctatttaactcttttagaggaaggtgttagagacaaccgtgaacgtgtcacatggaatatatgtaccatcttctgatttagtaactgcaacaagctaatataccggtcatcattatgttgtcatgttgcagctagcgcaagtattccctcttataggatcgaacacaagtaaccaagcctaccagaggggggtgaatgataggaaaaaccaaaaaaccaaaacttttagcggaaataaaagttaccctcaacgtagtcctgtcgccgccggtcggaccgctcgcacgccgccggtcggaccgtctccctgccgcctgaacccgaaaaaacacaaatcgaagaactctcaaagtagataacaactttattgcttctatttatgtttacaaagtgtaacaacagcactccttacaaaaatctcgactaaactcgaaaccctaactaaactatcaactcaattgctctcaaagcgataccaggaggcctcacgctccctctctatttataaaaaaaaaacccatactcaaagtaggtgtataactcctattcataataggactcaattccacgttaccaaaatcatacgagccagaatcctatccccatccatatcggactctgcatttgatctccagcccacgtaggcccctgtctccagctcggtctccagccaactgccaccgagccgctctctgctgcctgggccgactcggcttgccagccaaccgaagcctccagcccaaccaactagctgcacctgcgcatgtcctgcatgctacacaagcatacaccacgatacagtatacacacatatatgcatgctacagtatcatatgtactgtagcaccatatactcctcactaatttccttcaaccaatttccttcgcgaacaccgacgcttgcacgcacacctcgtgaagaccgttacgaagatctctcccccacgatgtccatccactgtatgccatctcgtatccaacttcctcactcggtatccttgaccgtctggacctcaactcctccctgagcctagtcccgatccccaccgttaaccgaagttgacctccaagaatcctgactctagtcacctgctcacatggtatcccgaccgcactagacctctgctccaccctgagcatagacccggttctcaccattgaccaaggctgacctcaagtcacctgcacacaatcagataaaacaaccgtttctgggcacagatatcacaacctgacccacattagtcacacgcactcacaccaacattcacacaaactctcaaaccaattctttgattaaatcatttgcatagccaattgttcatcataaatattaatcataacaatgatttcacacctttgctttcaatactcgtagttattattcacctttttaactttaaccattcgtcttttccacataaaaattatatgtatactgacatattatggatcaatcatttaaaaggtattaatgattagagttaaaacactaatggtcagcaatgacaagtactcccttcatagcacatcccagtactattaatgagacataaccctcctaattcatagtaaaagaatgtgcatccaattaaaattgcttatattttgggattatggacagatttctaaagaacagtactactccctccatcattcataaatttatattttggggctagccggcatggcaccaaggcgggggggcagggggggtggtagtcacgcggccgcgcatgcacgtatacaaagtttacgtaaacccaaaatatacacgtatacaaacttacgtacatacgtataaaaacccaaaatatacacgtatataaagtttatatacgcgtatataaagtttgaatacacgtatacaaagtttgtatatacaaagtttatatatgcgtatacaaagtttatatacgtatatataaaatttgtatgtatacagagttttataattacatattaaaaaagcgaaactaaaaagatacggaaagacgaaacataaaaaaaaaaggaaaacgtaaaccgcaaaaataaatacggaaagaaaaaacaaaaaagataccgagagcgccgggaagaaaaaaagaaagcgccaaaaaaaaaccgcgccatccgccgccctcctctccccacgcgacatctgtccagtcgcgcacacgggccggccagtcgcgaattagccttctcgccaaggctgacgctcttcatcctcctgctcatggaagttccatggcacgctcctagggagcgacatccagtgatggtaggggctgtacagatcgattgtcgacttcaccgttcgctagtcgcttcgcaaaaaacaagccatatccggctgtagagcccggcctactcacagacaacgccagcactcgccgccacgcccctcagcaccgggatccatgcatggcaccctcagcatccccgaccatgcatgtacgcgcaactgctgcatagattcaagatgaaggatgaggcacatctattctcctgagtcctgatgccggtgctcgtttccgggattgtcctcctagcctgagccgcctccatccctgtggccgctgccgtaggcctgccatcgaggcgagcgtttgggaaaacattgtaacttaattatcaatttgacaccggcgatgccgacgggtagagccggataccgatccgccaccaagtctcgcaacttaattatcaccgcctcacggcttggatctcgtcgcacgttgcctactgcggatcccgccgcgaacacgacgatcacgacggcgtggtggtgaggtgccggtagggcattctacggctgggtgctgggtggatggatccaaaaatttcgggaattggaggtttgaatggttatgggcttattgctggatacaaatacatatataggcggtacaaattgcaaaatgcaagtaaaaatattactactacggttaggggtggattgaagattggtcgtcggtgagttaaattttaactatgcattatggacctggtggggagcgtgggtgggtggggctgaaggctgtgtcaggtactgtttagaacgtagcgccttaaagtgctatattatagaagttaaggaaatggtaaaatgacatatgatgagcaaaaaatggtaggtgaggaaataaattaatacaaaaggttttagatgtgaaataaaatagtgtaaatgtggtggagtggataggtggataataagataccgtcttggaaccccaaacccctaatacgaatttaaagatcaaaatattttatattatattttaaaatgaacttaaagattaaaattttttatattatgtaatgggggaaatatactattatgatactactagtaaggtcaatatataatccaaaagtggtactacagtttacaatcccatccaccccaggtttttgtttggtttagagcaatattaattaattgaatccaatcaaatgacgtttgatgatcttttacgcacataagtagaattatttatgataaaacaactgaaggagttgctttcgattagagtgtgaatactcggtgagcacgccagcagacgagagaagtttaagcgtagatgttgttatttgggtgatccaaatcctcttgtgttcgttcccccatggtggcggagctaggctgcgctacgccgctagctgtgcaattcgttgcaaagcagccaagcaggtacggtcccttcgtttcaggcgcatgctattgctacttgtcttcatcatatatgttcgttgttcaattttgctatatatttgtcgataaattttaccccaaaaatttgacagatataattagaatacaatcgtagtgtaattacactgtaacttacatgtaattacactgtaactatagtgtaacttgtacgtaacttttaaaaatctcttcgtaacatgttatttcgataaaatggaggttgtgggaataaattctttcacatatgtgtgtgctatgatttgttttcttcctcaccaaaacaaatcttgtaatagatctaacgattcaaaattatgtgaaacttacatataagttacattgtagttacatgcaagtcacagtataattacatataagttacaatgtaattacactacgattgtactataattacatctgttaaatttttaggagaaaatttgtcgacaaatatataggtggtccctttgttgttacccgtgatttactctaaagttctaaatttctccgaatttgggatctacaagagcagtagatacttccagtagatgagggaagttcaagtgcggaccggcgggcgcagacggcatcccggcagtaggcacatccgcggttaggtggcagcacgcggcgccgccgccgccggtcgttcgcagccagtcggcagtgttcggccgctgcaagaccatttctaacaccaagcaggcaagcaattgtgtcctcagccctcacttctccgtgtcttgctatctactccctcctttaaaaaaagacaaaccctgatttccgtgtccaacgtttaaccgtccgtcttatttgaaaaattagaaaaaaaattaaaaagacaagtcacgcttaaaatattaatcatgttttatcatctaacaacaatgaaaatacgaattataaaaaaatttcatataagacgaacagtcaaagttggacacggaaatccagagtttgccttttttttttttaatggagggagtagtaatcttttcatgtccccaaggtgtttgatgaaatgtggcagcgagccatataacctatgcgctgctcagactagtgcgtgagacaggggggggggggggttgtggtgtgaggattttcctttttaaaataagttcaaagaatattggtaaatttcagtctaagtaaaaaataggtggcccattgtgcagttcacctaacattgaaaatttcaaaatatttatcatcaaatggctatttactaatattccgtttctaccatatatagacggattacatcaaggcataaagatcagcttccaaatcttactgagtgtattctagccaagaataagcatggcagaagccttggtttttgttgtccttcagaaaataggagctattttaggggggcaggtgctgaatgaaataagatcgcaatttggaaagaagtcacttatatttgaagtggagaacagtgtgatggaactcgcaagcgagtttagggtcatgcaggcttttatcaaccatgttggaatgtgttcacatcaaaatgcagcttatgaggcctggttggatgaagtaaagtcagttgggtttgatgctgaggacataattgaagagtatgcatatcttattgcgcaaacatcaaatgaaggcggcttgattaagagtgtattacatcgatccatcaatgcatggtgccatattgcgacacaactgaaacaaattgaagctcgtttacagaagctcacagccatgaaagatcgttatggtattttgatcagtgaacaaaaactgggaagtaatcccagtcatgatgatctcaaacttatgtcggattctttgtatttttactctcaagatgatattgtaggaaatgaagaagaacttgcgtggatcacacagcggctgatacaaggacggaaatcccgtacagtcatctccatttgtggcatgggaggtttagggaaaacaactcttgcccgagttatatacaaaaacaatgacattaaaaaacagtttgattgttgtgcatggatttcagtgtcacaaacttatcaagctgaagatttgttgagaagaatattataacagctcctaaacatggatgggaagacttttcatcacatatatgatatggatcgaattagtttggcagaaagattaagagatcacctgcagtgcaaaagttatctaattttcctagatgacatgtggagtcgagatgcttggatattcttaaatcatgcatttgctacaaataataaaggtggacgggtaatcatcacaactagaaatgaagatgttgcaatattggctgatgaggaccattgtattatgctaaagactctacaatggaaggaagcatggaatctcttttctagaaaagcctttcctagtcgaaaagaaaatcaatgccctgaaagtgtcgtacaatgggcggagaaaattgtggataaatgtaaagggttgccacttgcaatagttgctattgggagtctactttcccacaaaaagaaagaagagaatgaatggaaattgttttataaccaactgaactggcagctgatcaataacccggagttgaactttgtgatagctgttctgaatcttagctttgagtatctaccaagcaatctaaaatactgcttcctgtattgtggcctatttcctgaagactatctgattaaaagaaaacagataattagattttggatagctgaaggttttgttgaggaaactggagccaatattactatggaagaactagccgaagagtatctcaaggagcttgcccagcgttcacttcttcatgttgcagaaagaaatgtgtatggaagagcaaagtcattccaaatgcataatcttgtaagagatatggttgtcagtaaatgcaagacctacaagttttctgatcttgtggttgaccattgtgttacaaaacacaaatacaagacgcgtcgtatatcagtattagaagctgatcatgcctctgaagcacctacctatggagagaaggttcgctcatttatcctgttcgataagaaagtaccttactcttggttggaaactgcaagtagagattttagattgctaagggtgctgtccttgagaagagcaagcatccataaggtccctgatgttgtgagcaatttgttcaatttgcgctaccttgatttggcctatacaagagttaaggtgattccaagatcactgtgccgactgaacaaattacagatgttggacctttggttcactggcgttgtcgaactgcctcgagaaataaagctgctaacagagattcggtacatggttgctactgtcatgagtgaagataatcacagaattttcaactgcttcctgccagttcgatttccttgcgaagtttgtcatctcaaggatttacaggtactaggatacatagaggcaagcaaagatatgatttctaatctcagaaacttgaatcaactgcgcaaccttttcatgatgaaagtggagcataattatttaacagagctatgggcctctatcaaaaggatgccaaatcttgtcaggttggatataatctcgtgcgacagcgatgaagttttcaacatggagcacttggaccctcttccagaattggaaacattccatcttagagcaaagttacaagatggtgttcttcccaagatgtttcatggtcttgttaaaatcagagacctggagatggggtggtcagggttacaagtagatcccgtttgtaccttttcacatatgtcgaaccttactgaattgcgtctttacagggtttatgagggggtgcttttgagcttccaagctggtttgtttccaaaactcaagaaactctccttggctgatatggagaacctcacatggattgaaatggaggatggcaccatgcaaagcctaaattttattgcacttattggtttaagaaacttgaaggttgtgccagaaggatttcaatatctaatgtcactccaagagatgttccttcaggatatgccacaagagtttataaagagggcacaaagagaagaccgggtttacatccagcacatccctaagatacgaaaattttgacaaagcaaattcactcctatgattgtaacctttttaccttggccttgtgctggaatgtaattatagcaaagtgcacggttggttgcagctgtgtcaactaggtctccaaattctcaaaatgcaaatccaggtcctagaagttgttaaattgcattattctggtcacaaactacgacaaccctttgagatcttacatggtgctgatgtagaattggtaacgatgctagtcggtgtagaattggtaatgatgccacgtcagcaccacatgagatcctggataagttgtgttagcttgggactagaatgacacgatttaacatgttccgtgacctggattttcattttaatagtttgaggacctagatgacataacaacacaagtttaaagaccagctgcgcacttactccaattataatattttccatgtgataagagtgaaatacatcatatgattactatgaatagagaactcaacaagatgccgatatttgaatgtccaattatcgaagtgttcagcatatgagtacctaatcctgagagatttttacttttgttactagagggagtaaaattttttgtcgacttcttgagcatggttacgtggttatgcctatagacggtggaaatggtggccatcgagaaagcaacaggggagacggaattagttgacttttgtacaataagccttacttgatgtccagtagtaagtctgcgtgggtatgcctatagacggtggaaatggtggccatcgagaaagcaacaggggagacggaattagttgacttttgtacaataagcattacttgatgtccagtagtaagtctgtttaaacacatcaaatggggcaacaaacaatggtagtgagttcaaccgtacaatccgtggttgaatttgttatagagaatacttctaaggcccttcacactaaggcccttcacagtacgagtacgtggctcgtgggttcgctacgacacgtcggagccggacttccacgtcgttgtgggtcggttcccaacttggtagcgcaggtctttgtgaggtatcgtgtttctcacctgcgcagcaggcaaacggcgctggatcttggctattgtctgctatggagtagtactactgaacctggacccacttaaaacccatttgaaaggcaactagcactgtcagagctgtgacccaaaccttcactaggcctattcggcacacgaagttccaatagtgcatacaacgtgtcaagaagcaaaagcagaatcagagaagaagatgatatcaatgacatttcacaagtcagtcgttgtcaccaaaattccacattagggtgatcatgttagacaaaccaatttatgtaacagtttaaactccaatatacgtcggatatattgttcagttgtaaatttaagagaaatcaagcaaggaggtcggccatctctttggtgttggggttgtcggtgacatgggaccgggagtatcatgactagaggcttgaggcagacacgatcacccacgtggcctaaccccctcggggggggggcccgagggtgatgtggccgcccttctctttgtctccccgaggggtcggaccgctcccgtttcggccccgagggccgaggcgccccgaccccttgtgggttttacgccgcatgtatgggttagg

SEQ ID NO: 16610 - DNA, 15698 bp, Oryza sativa
tttggaacgagcgcgtcacgccgcatgtaacgcagtgcagcgcgctcgtttatccggtctgtgaccggtcacagaccggtcagattgcgggttaggtggcaacaggcgatctgacacacgcctcgccccatcccgttaggatgagagcctctaggcactcgtccctagccggagccagcgtgctagctcctggagatggcacgttggtcccggtcagatatataccaggcttcatcccaaccattgcaagaaagacattgtatgaagaagggcagacatgcagtttgctaagctgacgcgtggaggacaaaaatgactggtttgtcaccgatctgacactggtcatgtcatcggtagacaaccgcgttcccacgttgaacctgcttccggcggagtggaggtaggtatgggccgtcccatcagaaggtcattcggacagcagccattgcaagtctccgcccatttatgaagggatgacagggtgatccccgaggtcagacgagtgaggacgcgtggccacactaaaaaacaagcttccaagagaaggcgagccaagttttagtaaagataggatgggtccccacccaaaagaaaaagaggtagaagtggtgcatgtggtatccccttgagatataaaagtctcgtactccaccgccccctccacgccaaagtcctaagcggggggaggcgctcgagagggtcgaaagatccgcgacttcaccgaccgcgggcgatggagaagaacggcgagacggggagcgtcgcctcctcgtctacggcgatggcagcacgccccagggcgcgctccaggctgcaggcgcgctcctacgtcacccgcccgtcgtccccgatccggagtctccagcccagcgttggctggacgacgtggccaacttggtcatgacggcacggcagcgcctaggtgctggtgggcggtcctccgccactaagacctctggcgctgctaccaccggctccatgtcgtcaaggcggagggcgcggcgagcggcggccgttgctcgccattcggccgccactccctcgtcagcacctccgacccgggaagatcagcgtggggggccggatgcccaccgcggctccgaacgccggcgtaatggtcgacatgctccccatgtaacggagggcgcctcctcgtccggagtgtcacctcagcacggacgcggggatcagccctccgtgcccccggttggtggtgtcggctgtagagcctttgtggcgagccttcggaatgtccgttggcccccaaggttccggcccaccatcaccgaaaaatatgacgggagcgtcaaccccgccgagtttctccaggtctacacgaccgggatcgaggccgctgggggtgacgacagggtcatggcgaatttctttcccatggccctgaagggacaggcgcggggttggctaatgaatttgtcacccgcatcggtccactcttgggaagatttgtgccagcagttcaccatgaacttccaaggcacgtatccactcccaggtgaagaagcggacttgcacgcggtacagcgaagggatgatgagtcgcttcgctcgtacattcagcggttctgtcaagtccgcaacaccataccatgcatccctgcacacgcggtgatctacgcgttcagggggggcgtgcggcacaaccgcatgctcgaaaagatcgcctccaaggagccccagactaccgcggagctttttcagctcgtggaccgagtggctcgcaaggaggaggcctggacttggaacccctccggttccggagtggcagcttcggccgcccccggatccgctgctcggacagggcggcgtgacaggaggaagaagaagaggtcagtccattccgacgacgagggtcatgtcctcgccgtcgagggcgcttcgcgggcgacccgaaaggggaggcctgcgagcgacaaaaagaaggaggccggcgctcccagcagggagcgcccaaccggcaagtggtgcaccgtccacaacacctccctccacgacctcgtggactgccgcgcagccaaaagtttggctgagcggacgaggaagtgggaggaggagaggaggcaggagcgccgagaaggcaagtccccggcggttccctctggcaatcagcgaagtgaggccaagcagaaggcccccgccgaggacatcgatgacggcgatgatgacttaggtttccaggagcctggggccaccattgccactgtcgatgggggagcgtgtgctcacgtttctcgccagagcctcaaggccatgaagcgagagcttctggccacggcccctactcatgaggcgacgcgtcgggcgcggtggtcggagattgccctcacctttgaccagaccgaccacccaccgtgtgttgcccgggaaggacagatcgcgatggtggtttcccccaccgtttgcaacgtgaagttggggcgtgtcctcatagatggtggggcagccctcaacatcctttcccccgcagcctttgacgccatcaaggccccggggatggtgctccagccgtcccagccgattatcggtgtaacgccggggcacacttggccgttaggtcatatcgacttcccggtcaccttcggtggatccgccaacttccgcacggagcgggtgaacttcgatgtggcggacctcagtctgccctacaacgcggtcctagggaggcccgcgttggtgaagttcatggtggcggtccactacgcctacctccagatgaagatgccgggccccggtggccctatctctgtccatgacgacctcaaagtcgcgcttgcttgtatggagcagcgcgcggaccacctcgccgccgcgtccaagcccgagggtggtgacgagaggcttggcacctccgtccccgccgccccgaggcagcggatgatcacgtgcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcgaccgggcgcaaggccagtccggcagaaagtgcggcggcaggccccggaacgtcaagccttcatccgtgaggaggtggcgagactactggaagccggatttatccgtgaggtcatccatccggagtggctggcgaacccggttgtcgttcccaaggcaaacggcaagcttcggatgtgcatcgactacaccgaccttaacaaggcatgtcctaaggacccttaccccctgcctcgcatagatcagattgtcgactccactgcggggtgcgaccttttgtgttttctagatgcatactctggttaccatcagattcgcatggctagggaggatgagaaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtgaagacacgcaaccaagaaactttactttcggatctggcggaaacttttgagagtctccgctccgcccgcataaaactgaaccccgataagtgcgtgttcggtgtacctgcgggcaagcttctcgggttcttggtctctgcccgaggcatcgaggccaaccccgagaagatacgagctatagagcggatgcgcccccccagcaagcttagggatgtgcaatgcgtcaccggttgcatggccgccctaagtcggttcatatcaaggctgggagagaaggcgctaccattatttaagctcctcaaacgctccgggccgtttacctggacggaggaagctgaacgtgccctcactcagttgaaggcgtatctcagctctcccccagttctggtcgccccggagccagatgaacccttgctactctacttagcggcgaccccgcaggtagttagtgcggcgttggttgtggagcgcgatgaggacaaccctcattccgcatatccccaccctgtgccaactcaacccgggagagagcagggaggagaggcccccgagccgaacggtggcccaaggcccccgacgaccggagttggccctctgcccgcttgtcaaacggtgccgggtgcccccaacccccaggatggcccgagggccactgtgggaaggccgcacctatcgccctctgaccccgaggttaaccctgtgccgacccgacccaggagagagcagggaggagaggcccccgagccaaacggtggcccaaggcccccgacgaccggagctggccctctgcccgcttgtccgacgacgccaggcctccccgacacccaggacggccccgaagccactgtgggaaggccgcgcctgtcgtcctccgaccccgaggtcatcggcacagaagacgagtgcaccccgcatggcctcttggacgaagagtgccccagggatgcggcccctggcgaagaggatcggccccgccgaaaggtgcagcggcccgtctactttgttagtgaggccctccgggacgccaagacccgataccctcaggcccagaaaatgctttacgctattctgatggcttcgaggaaactgcgtcattatttccaggcgcatcgggtcacggtggttacgtcttaccccctcggccaaatcctgcataatcgagagggtacaggacgggtggtgaaatgggcaatcgaactttctgagttcgatttgcactttgaaccacgccacgctatcaagagccaggccctcgccgactttgtggcagagtggaccccggctctcgaacccgtctcagaccccgaggccagctcgagcccctcgcagccgcctcacaccacccactgggtgatgcagttcgacggctccctgtctcttcagggcgctggtgcgggggtcacgttgacctcgccgagcggagacatcctcagatacctggtccgtctcgactttcgggcgaccaatattatggcagagtacgagggactccttgcgggactcagggtggcagctggactggggatccgccgcctcctggtgttaggcgactcccagctggtcgttaaccaggtctgtaaggagtaccggtgctctgacccgcagatggatgcttatgtacgccaagtgcggcgtatggagcgccatttcgacgggatagagcttcggcacgtgcccaaacgggataacacgattgccgacgaactctcacggctcgcttcctcacgagcccagaccccaccgggcgcctttgaagaaaggcttgcccagccgtcggcgcgacccgaccccctaggggagacggacgcgcctgaccggcccccgaggcccgtcggagtccaggcctcgggacccgaggggagcgttcccagctcccttagattgattgcttggatcgctgagatccaagcatacctcacagataagactctacccgaggaccgcgaagggagtgaacgcgtccaacgcatctccaaacgctacgtgctggtagaagggaccctctatcggcgcgcggctaatggaatcctcctgaagtgcattcctcgggaacaaggcgtcgagcttcttgccgatatccatgaaggcgaatgcggagcccacttcgcctcacgcaccttggttggcaaagcctttcgccagggtttctattggccgacagctctcaatgatgtggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatgtcgcgatcgacaagttcactaagtggcccgaggcttatccggttatcaagatcgataaacactccgcacttaaattcatcaagggcatcacagcccggtttggggtgccgaaccgtattattacggataatggcacccaattcactagtgagcttttcggtgactactgcgaagacatgggcatcaagctctgcttcgcctcccccgcccaccccagaagcaatggccaagtggagcgcgccaatgcggaaatcctcagaggccttaaaaccaagaccttcaacatcctcaagaagcacggcgattcgtagatcgaggagttgccagctgtgctctgggcgaaccgaaccacaccaagccgagctaccggggaaacgcctttcttcctcgtctacggcgcggaggcggttctcccatccgagctcaccctgaggtcacctcgggccaccatgtactgcgaggctgatcaagatcagcttcgcagagatgacctcaactacttgcaagagcgaaggcggcgcgcggccctccgagccgcgcgctaccagcaaagcctgcggcgcttccatcagcgccacgtccgggcccgatcactctgcgtcgacgacctcgtcctatgccgcgtccaaacgcgtgctggattgagcaagctctcacccatgtgggagggtccgtatcgagtgatcggcgtcccccagccgggctccgttcggctggccactgtcacgaccggaaataacccaacgggcattccttacgtgcgtgcattaatccttgtcccaggaggcaaggtacaccaaaagttgatacaaatcagagtttaacaagccgaagcgtaaatagttaacttattacatgggcagcgaaggcccagcacacacaaagacaaacgaaaaacagcggaagactagggcgacgaccacaggcgcttgacggcaggcacgagctagacaccaaagccttcatcttcatggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcaaagctattttgtaaacccgatcctagaactatacaatgttattaatcaaggtcgtgaacccacacgaacctgccttaacccaaggcctatgatgattcagaccgaactggcaacccgaccctgggtcccagctcgtcccaagccaacccaggccaaccattccacattttagttgttaagaaggttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacgaaagacgtgacatagtttccaacccatcctagccatagacaagagtaccgacccaatcccgcctacggccggaacccccgggacaggcaggcaagactgagcccccagcagcagggcaccaaccctctgccatgacatctcgactaccgggccgcagctcgtgtagccttcatttgccctggagaatgtccatcgatccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccatttttggggattttgaatagagggggaggtgtgaaaccaattccacaataaaccaacaattccagggtgtccaggtgatgagaatatcccaaagtctagagttgtaaaaccacctaatgttgtctaatttaattgcgaagcatctacctaaatttaaactagggataccacgagtagagtgtccactagttgaggttttgtttagtctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgctcaaggatgatgtgacttgccttgctcgctttcccaaccgacggcttcgacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaaacgggtttattgcgtcagccgagggagagggcgcgtggaccgggtccacgggagtggggcccacgcgtcagcctctcggtccacggtggaccgggagcacgcggctggcggcggccggcgccgtgggtcccacgcgtcagccgcacccgcgggcgcgggcggctgatggccgggcccacttggcagccgcgagggcgcgcccgaaggcggcctcgccggcacggccgacgggaggcggcacgcccgcgccccgatggtcaccgccggcgaccaccggcgcggtggagcggcgcccgagagagcggagaggagaaggaagcgaaagggcggtcttcggctcaccccgggtcgacggcgacgacgggaacggcggccgaagcggaggaaggcggcggcgcggctcgggacgacgaggacgacggcgctccggcggtcggcgagcgaaatggaggagcggccgaggtcgacggggacgcggcgaagccgaaggaggtgacgccgagacgggaggatgtccggagcgacgacggcggcgaaccgaagctcggcggcgacggcggagagaagatgcgacggcgcgagcgcgattccgacggggagagcgagtggcgaacggcggaaacggaggagagaggcacggggaacgtttatatagggttgggagtgagggaaggcggccggaggagatggaaaccggcgcggaggatccggccgccattgattgcgccggcgaggtttgcgggattgaatccggacgaatccgagggagagagagaggggaaagagagggaaacgggagagggaatcgcggggaataattcccccctcattatggcgcgcggggacggcgggatgcggcggattcggcggcggcggcggcgctagggcacgggcgagcggcgggagcggcgggaggaaggcgatgacaggtgggccctacccgtcagcgagggcggcgggcgggcccgcctgtcagcggcgcgcgcgcgggggaggccgatgggccgcgggggagaggagagagagggagggagagttgggccgagccggcccaagagaggaaggggggaaaagaagacttcttttagggtttttcttttttataaaccttttcaactttgtttatttcttttcaattattatttgtgctctgaaaattccactaaaatttatttacgcattttaggcttttaggaaatatacaaaaatcctccaagccttatttgacttttaaatttgcacattttaattgttggaggctttcacatgaattttaattattctcggcacaatttcgaggatgtattttagagtcgttttgggacgtgacaaacctaccccccttaaacggaatctcgaccccgagattcggaagaactggcgaagagatctggatgggctgccttcagctcgtcttcacgctcccaagtagcttcttcctcggcgtggttgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaaggcatttcttgagttgcgacacatggaacacatcatgcacgttgcccaaggaggcgggcagctccaactggtaagcgacttctccgcgtcgagcaaggatacggaaaggacccacataccgaggtgcgagcttccctttcgtctgaaacctgtgtacacctcgcaatggcgtgacccgaaggtatacaaaatcatccactgcgaattccaggtcacggcgacggttatctgcataacttttctgccgggactgtgccacctttagattatcccgaatgattctgactttagcttcagcttctctcaggatatcagtcccgaacacttggctttctcctacttgatcccacaagagtggtgtccggcacttgcgcccatacaacgcttcataaggtgccatttgtatgctggcttgatagctgttattgtaagagaactcagcataggggagactcttatcccaggtcttcccgaaatctaggacacatgcgcggagcatatcttctaggatctggttcagacgctcggtctgtccatctgtctgcgggtgataggcggtgctgaagtttaatcgagtacccagctcttcttggagcttcttccaaaagtgagaggtgaattggcttcccctatcagatacgattttcttgggaacgccatggagactcacgatcctagcgaagtagagttcggctagcttgttccctccataggtggtcttcacaggaataaaacgagctaccttggttaatcgatccacaactacccatatagaatcatatccgccttgggttttgggagtccggtgatgaaatccatcccaatttcatcccatttccattcgggtacttggagaggttggagaagtccggccggtcgttggtgctctgccttgacacgctggcacacgtcacacagggccacaaactctgcaatttcccgcttcatgctaacccaccagtatttctccttcaagtctaagtacatctttgtactgcccgggtgaatggaataaggactttcgtgagcttcctgaagtatcagctgtttaagttctctgttatctggaacgcatacccgctttccgttccatagggttccgtgttcatcctctgtgaaaccagcggctttaccctgtttcatattcttgaggagtccatgcatgtccggatcattcttctgagcctcgcggatttgatcgagcaaggtggacttggcttccaacgcggccaaaaatccacgaccaactatgtttaggttcagggcttccatctgttggttaagttcgggtggaatgccacggacgttaagagtgttgcaatggctctttcgacttagagcgtcggcaaccacgttggccttaccaggatgatagtgaattcccacatcatagtccttgatgagttctaaccatctcctttgccgaaggttcagatccgactgggtgaagatgtatttcaaactcttatggtcggtatagatttcacagcgattcccaatgagatagtgccgccagatttttagagcatgaactactgcggctaactccaagtcatgtgtagggtagttgccttcatgaggtcgtaagaaactgcggacttgagtaactgtcttgggttgcttccaatcggtgacggcggtcactgtttcgggatccacagcaactcctttagcagatatcacgtgccctaagaatttgacttcggacaaccagaactcacacttgctaagcttggcatacaattgatgttcccgcaactttcccaacaccagacggagatggtgttgatggtcttcctctgattgtgagtatatcagaatgtcatcaatgaaaaccacaacaaacttatccaagtattccatgaatactttgttcatcaagttcatgaagaaggcaggcgcattggtcaaaccgaacgacatcaccgtgaattcatacagcccgtatcgcgtggtgaatgcggtcttcggaatatcttcttcacgaatacgtaattggtgatatccggaacgaagatcaatcttggagaatacagtggcacctttaagttgatcgaatagatcatcgatccggggaagagggtacttgttttttatggtgacttcattgagagctctgtagtcgacgcacatcctcttcgtcttgtctttcttctctacaaaaatcacaggagcaccccatggggaaatactcggacgtatataccccttttctttcaattcttccaactgtttctttacttcggctagttcatttgctgccatacggtagggtcgcttgtgcagaggagtggttcctggagcaagatctattcggaactcaatctctcgcttgggcggcataccaggtagttcttccggaaacacttctccgaactccctgacgatggggatttctgacagtcctatctgatgaagttctgaacttctgacagaggttgggggtgcaaagaaaacaaccggttgtgccggtcctcggtacagagtgacagtgcgtctcgcgcaatccactactccttggaattgtgccaaccaattcatcccaagaatcacatccaagttcttggtgtctaacagaatcagatccgagggaaaaggaatcccctgaatttctatagggacggcagggctataatactttgctgtcataacccctccaggggtggtgatgagcagagggtttctaagcctttctacccccaactgatttctccccacgaatggcacagatataaacgagtgggaagctccagagtcgaacaaaattgtagcagggatggaatgaacgaggaacgtaccaacgatgacgtctggagttgtcagcacgtcctcggccgtcacgtgattcacacgaccccgaatgacgtccttaccaccgttgttggggcggggaggcgcttggccttgctgacgccttggcttcgggcatttatccgcaaagggcccgggctcgaagcagttgaagcacagacgctgcggaccttgagcatccctgcggccttgaacaggctgcacagttggcgtaggaggacggggcgcacgagtcccttgctgattctgctgctgctgcagctgtgggacgcgcaccacgaattgaggtcgaggcgcggggcgaggttgctgctgctgttgttgttgctgctgcgaggaggatccccctggatagggattggtgtagcggaccctttggttagcaccctgctgattgcggaaattcgccaagcgacgcttgtgcgactccagttccttgtgcttggcttccaagcggatgctcttgtccaccagtcgttggaagtccggatagtccccagagactagacggacggacagctcggggtccattcctgccaagaacttttcttgcttctcctcatcttcccgcacatcctccggagcgtaacgggccaggttattgaactcatgcaaatactccatcacggagcggttgccttgcttcaactctcggaattcccttttcttaagggccacgactccagcgggcacatgggttcttcggaaagcggcggtgaagcgagcccaagtaatcggctgtccctctggctgcgtagcctggaagtggtcccaccagagagatgcgggcccctgcagctgatgggcggcgaagacgactttctcctcatcgctgcactgcaccgtgtctagctttttccccacggcatgcaaccaatccaacgcatccacggggttgttggaactggagaaggtaggtgggcggatgcggaggaactcggcgagtttagagtgttgtgggggtggtggtggagcattctgttgtggcgggttttggaggtggtggaggaaagcattcatcatgttggcttgctgggcgaggatttgggtgagaatggcgttggtgtctggtggtggtggtggaggcggaggaggaggtggaggtgggttgccctggtggttgtggttgctgccttcaggttggttgccatcaccggtaacagcatttctcctagtcgtcaccatctgaaaaccccacacagaacccgcaaacagagagagagctaacaattaaaactaaccacccacgactaccataattcttgaatttattactgctattaaattggttcattaatgttcaagttgcttaggcgaataaaataaggcaggctccgacacagttatgccacacaccggcataaccatgccccacacgactcaacaagaagacaaacgagaaagaacacacgcgcaagcctactaactgctcgtctactgctgcgacgggccagggcggaaggtgagcaacagcgcaccctccgtgctaccaacgccggaggcttccccctcctggggaaccacgggcgcaggctcggcacgaggggtctcgacgaagcaagtccacgccagggactgacgaacaagctcgggcctggaggtgctcttgcgggcggtgatcttctggctgcggcagacgcggcgacgcttggggcggcagatctctccctgggcgatcttgagctggtgcagctgcgcctccactgcgtcgaggtccttcttgagctgcaggttctcctgacgcagctccaggatcttcagattgttctcgaccatcccgcgacgtaccatctggtggaagtcgatacgagccgcgtcgtacgcctccaccatgcgcgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgctctggcaagcggcggggaaggagtctccacccgcggtgactgtcagcgaagtccgctcgggagagccagagaggatcacggcggtgacctcccaaccagcgtggggctccgcgtcctcaccctcctgctccgggagcggcctggcctggtagtccaccccatggggataccctaagaccacgcacatgccccgtagctccaagacgaagccagtcatgtccaaaccacgacgggtgacgctgccggccatctacaaacaaaaacaaaaaagaaaagcaacattttaaaggtcagattttgatggtaagtgaagcagcaagacagagagagactagacagttttcacaaataacaaaggatttttatttttgaaaatattgctaaggcttgggatctacggctcgtcctagggtcaagggtggctctgataccaacttgtcacgaccggaaataacccaacgggcattccttacgtgcgtgcattaatccttgtcctaggaggcaaggtacaccaaaagttgatacaaatcagagtttaacaagcggaagcgtaaatagttaacttattacatgggcagcgaaggcccagcacacacaaagacaaacgaaaaacagcggaagactagggcgacgaccacaggcgcttgacggcaggcacgagctaacaccaaagccttcatcttcatggagctcctcttctgggcttgggaaaaattgagcaagactgagtacaaccaccgtactcaacaagacacacccacaaatgcagaataaatgcaagggagtacaagggaattataatataaagggttagggttgc

SEQ ID NO: 16611 - DNA, 23141 bp, Oryza sativa
attatgggaataaatcctagcctttacttcaaaggaagctagagccacttattacaaaattctctcaagagagcaaaacaatatggcaacatcaagcaaatccaaaaacaatccgacaatatcaagcaaaaccaacacataaggagtaaacaattatttaaatctatttgtaaatcttcatccttagttggcgaaaatcttcatgacgtaacttctcctgacacaagaaccatcctggtatgcaaccatgtaaggagcacggagtactaaacattacttcctccgtttcacaatgtaagtcattttagcatttcccatgttcatattgatattaatgaatctagatagatatatatgtctagattcattaacatcaatataaatgtgggaaatgctagaatgacttacattgtgaaacggagggagtagaacatatgaaaaattccgagaatgaagcacccactactgggtcatcatcaccaatctctccattcccgatacaaccaaaaccgctcggacagagcagccacagagcacccaaaatcctccaatttcagcggaaggatcgcatcaaatccatgtgagggggaggctgtcccgtagcagctctttgatgtcatgggtgacaaaggcactgcggatgcgatggtggcgtaacctgttgtggcctctcaggagggctctagcctccggggagcgccgcccaagcgtcgaagcacgctcgccaacctcctctgtgcccgagtgcatcgactactaccttgcgcctgctgtggtgatgtgtcacgtgtggtccgtgctgcggttggccgtggctgccgccgccggagccatgagctccaactcttggtggcaggtcttcgtgcttgggtacagcgccgtcgagatagatggaggagagagggggaagacgaaaccacttctcaaagcactgaaggagttgatttacaccggttctcaaagatggggggaggagttaaacccgattttgtggttggggattgcaattcgatcacgagcaaaacatcaggaacgtaaaatagaattactagaaaataccccacgcgttgctgcatgaatatatggtgaaaataatgataacgatttttataaatgcagttttatagagtggtatataatttctactgcaccaagcacgaatggttacactaccggaggaatgatctttgcatggtcgcctgatttccacaatagtcccggttctaataaaaaccgagactaaaaattgtttttagtcccggttataaaaattttgatctttagtcctggtttatgccctgtcagttagtctcggttggtagtatcaactaggactaaagattatcactttagtccaggttggtagtaacaaccgggagtaataatcatttagatctttagtcccagttggtactacaaaccgggactaaaaatctatctttagtcctagttggtaagtccaaccgggagtaaatatttctctcctatctctgatcggttaagtcccagaagaaatatttagagataagatcgtctctctccaactcctctcagatatcacccctctccaactccctcagatccgatccaagcctcctcgtcccctcccctctcctcctcctccttctccccttcctcctcctcccctcccatccgggggccgacaggcggccggcagggccaagcccagcggcagcgggcaggcggcgggcagccgtggtgagcggaggcagccggctttgttttctttttttttatataatctgtgattcattgggatgtataatttcgtgattcattgtacatttgtatggatttgagatgtataatatgtgatgtatttgatttgttttgtaatttttttaggatttgtgatgtatttgatttgtgtgtatgagtaactttaagttttgtgatttgtgatgtggatttgggatgttactttgatttggggatttggggtttgatttggggatgtgcatgccactcgattagggagaaaataaaaaagaaaaaaaaaaggggacatctggactgcacgctaccctctctttagtcccggttggtaacaacaaccagaactaaagatccctctctttagtcccggttatttcaaccgggactaaagatgggcatctttagtccggattgctactctcggttggaaacccaggactaaagggggttaccaaccgggagtaaaaaagtttctccaccagtgttaatttttcagcaatatgcttttgattggttggattacaaatatgatcgtcgttaaataacaaatgaaaataaaatttctgaaggtagttatagtctgaaaatacattcaattagcatatgaaattggaagactgttttgagataaatctttagacataaggtgggcagcacaaagaaaatcatggcgagttgggtgaccattagtgaggtactcacggtttatatgacgttgtttcttcaatcatgtagaccatcagcgtgtcaagtctggtatgcttttgtttcgaacaaaataaagtctgtttttctttcaaacagaacattacaaaatgctctaaaagtattaataccgtgctagtgaagtccttttgaagatgaatagtattgcattacgtgttagagaacataacatcttctgatatggtccttggaattacaatcggttgcgagttactcagcttcttggactgttactcgggatatcatcagatccgactaaaagaatccgactgcttgaagacctcgtttattacgcccttaggggccaactgctacatcaccatgccctttggattgaaaaatgtaggagcgacctatcaacgcataattcaaagatgtttttcaactcagatcggtcgcaatgttgaagcttatgttgatgatgtagtcgtcaagatcaagcagaaggatggcctgattgcggatttagaagaaacattttcaagcattcgtgctttcaagatgaaactaaacctggaaaagtgcatcttcggagtaccgtcggggaaattgctcggatttatggtatctcaaagaggtatacaggccaacccggagaaaatcaacgccatcctcaacatgaaaccgccaagctcccaaaaagacatccaaaagcagactggttgcatggcggcgctcagccggttcgtttcacgactcggcaagcgagggatgcctttcttcaagctgctgaagaagactaacaatttcccgtgggggcccgaagcacagaaagcctttgaagacttcaagaaactcctcaccacttcaccagttttggcctcgccacatccgcaagagccgctactgttatatgtgtcggcgacctcccaggttgtgagtgcggtcctggttgtcgagcgtgaagaggaaggccatgttcaaaaagtccaacgtccaatttatttcgttagcgaggttttagccgactccaagacaagatatcctcaggttcaaaagttactatatggtgtcctaattaccgtcaggaaattatctcactactttcaaagtcacccggtcacggtagtcacatcgtttccacacggggatatacttcacaatcgcgaagcaaatggacggatcgcgaagtgggcctggactattggactatgcattttgatgggtcgaagaggctcacaggcactggagctggggtcatcttgatttccccgactggagaaagattgagctacgtattgtggatacatttttctgcgtcccataatgtggcggaatacgaggcgctactccatggattaaggattacaatctctttaggcattcgccgattaatcgtccgtggagactctcagttggttgttaatcaagtcatgaaagagtggtcatgtctagatgataatatgaccgcttatcgacaagaggtacgcaagctggaagataaattcgatggactcgagctcacccatgtccttcgacataaaaatgaggcagctcatagactggccaattttggttcaaaatgggaagcagccccttctgatgtgttcgttgagcatctttatgaaccaaccgtgcccagaaaagaagcaattgaagccatggatactcaaggcgtaagcatgattgaagccgactggagagaacccctcataaaatttttgaccaaacaagaactccctcaagacaaaaatgaaggcgagcggatttccaggcgcagcagactttacattattcatgaagctgaactgtataagaaaagtccatcaggaatactgcagcgctgtgtatctttggaggaagggagacaattgttgaaggatatacattctggtatttgtggtaatcatgctgctgcacggaccattgtcggcaaagcttaccggcaaggttttttctcgcctacagctgtgttcgatgcggacaagattgtgcggacatgcgaaggttgtcaattttttaccagacaaactcatttggcagcccaagagttgcaaaaccatcccgttgtcctagccgtttacggtctaggggcttgacatggtcggcccatttaaaagggcagtcggtggttacacgcatctctttgtggctatcgacaaattctccaagtggattgaggctaaaccggtcattacgatcacagcagataaagctagagattttttcatcaacattgtgcatcggtttggggtacctaatcggatcatcactgataatggcactcaattcactggcggagcatttaaagacttctgtgaagacttcagcattaaaatttgttacgcctccgtggcacaccctatgagtaacggacaagtcgagcgtgctaacggtatgatactgcaagggatcaaagcatgagtttttgaccgactacgcccctatgctgtcaagtgggtagatcagctgccgtccgtactttggtctttacgcactactcctagtcgggctaccggccagtcgccgttctttttggtttatggcgcagaagcaatgttgccgagtgaagtggaatttgaatcactacgatttcggaacttcaatgcggagggctatgaagagggccgagtagacgacatcaaccgactagaagaagcccgagaagcagctttaattcagtcgactcgatatttgcaagggttgcgccgttatcataatcggaatgttcgatcgcgagcctttttagtcggtgacctggttctgcggaaaattcaaacaacacaggatcggcataaattatctcccttatgggaaggaccgttcataattgctgaagtcactcggccgggttcttatcgactcaagcgcgaagacggtactctcatcaacaattcttggaatattgaacaccttcgtcgattttatgcttaggcatttcatttgtatctttcctctttgactgctaacttcaagttttttcttgaagtttttagtcagggggctactataataataatggagtgtgatttttatcaattcaatttgcttacttgatgtatcattgccctgtttgatttcttggcttagtcaatgaggactgaaagttttttaacaacttttgcgggttttaggctcaacaaggtttgacaaaaaacttttaagaaatcaggaactaagttaagatattaagcacagcataaattcatcagtattgtacaaattgtgcctccatcatcattaatcgtcaaagtcattggtacattaatcagtatcagttttttcatcatcagacttatcagacccagtcggccgaaggtcgacatcttagaatctctcaactacatcagcagcaattttgtcagccgctttctgcgcatcactgatgaggtcaagagcagcttcttcgctcgtcctatctgcaaagccatcaatggcatcaatatcaactcttggataaagggatttggtcatcaccaacgccagacttgctcccatacttccagcttctttgatgttcttgaaatatgtatccggagcaactctcagcttgtcgaaaatttcagaagcatcaagtgcactcaggccgttgttattaaaaaacatcgcttgaacaattggggcagcagcgttagcaacctcatcccgggctccttcaagttttttgatcttgccaaccaggacatcgaattgagcttgagatttgatcttgcggtctgcatcaacagattcacattaataagtcagcatatggaggataatggcttttgaggtattgattgttgataccttcaacttcctttaaagccaggtctctttgttttgccagttctgccttgtcattttccagaatttgaatctgcttttccaacggagatatcttggcagcttgcactacattgattacggttaatcaagattgcaaagataacagtatgagtcagttgagcagagtttgtgcgtaccttttgatgagccactcagttcaaaatttgattcctggagattagcaatccgatccctcagatcatgttcattcttcctggcaagttctttcgcttcgtgcagttgattcctggtggcttcgagggtcccgagatgagggactaacctctctaaggttaccgttttggcttcgttcctaagatgaatcctctgcaagacagtttaaatagcgcatgaattaaatggcaaacaagatggttgacatcaggtaccagagggcttacatttacaatacgggttgcctgaccaagtgcctttttcagtaggcataactcttcatcctctttttgcttatttatcacgatcccttgaggctgcatgttgtcatcccaccacttgaccagaatcggaaggcgtgaatcctcagctgcttgtatccggaggatctcttcttcatcaccaattattggccctagtgtatccatgaacgaagatgaagcagccaaataaagtctgttggatcaaaatgatttcagatggcatgtctacctgtgatgattcccggtcggggacgagtggactttggtgccttcacaggagatctggtttctgattaattgtcagcatccttcccgagaggactgttcgtttgagcttcaatctcgggaatcttttggcttggccctgcatccgactggtttccagtcgggggctcctggttagcaccgacttcagcttcggccgactggttcccagtcgggggctcgttgctaggttctacattgtcggttgccggttgtttgtcactcggacgatcttctgcagttggcccggtttcttttgaagggtttgcctctatgtcagccagctcggggtccttttcggaaggatctatgtcagacggcttcctacgagtttgagttatgctgttagtattatttcaacagtgggtaagctgcaagacaaggaagatggccaaatggtttgtacctggaagactttctgatttttggcaaaggacgactggaggttttcttcttcggattagttggctttggggattttccggtcgctcctttttctccgagccttccggtatcatcgccttcctcgtcgcttagaaccagcttcctcttgcgagcatctgactggccgactggatcggaagcacttggtcgagcgttagatcgaatttttggtcctccactcgcctgaccagtttgctggcgaggtgatcggcgttgagcaattggaggatccgatttcatcaaagcaaattcctgggcatgatatttcaaactttcaattagcttaacagagggtaaaagcatacttttgaggaaggttgaaatgtttgagtgcataccggtggaggagggttgaatgcgttgaatggcacaacgggcagcagatgtgaatagctgacaacaatagcgtttgagaagatcttgtacattctttctttcatgaccttaaagtcgagagaatctggattttcccgatttggatcatgcttgccatcaaactcaaaagctgtgcgggacctctctttgattggagctaatcgacttttgatgaagtgccgagtgatctgttctccctgcaaaccttgttccttcagttttagcatgcgttccatcaattccattgcctgagcagcttcatctcccataggcaatgagttccatgtgtcctggtaaaccggaggaagacagcagtactcggggagtgcgggctcaggattttgaacatagaaccagtttgcatgccagcctttctttgaggttttgaagggcatggagaaatatttttggctcaaggttcctctgagttggaaaccagctcccccaacaacgcatggtttgcttttgtttggctggggcttgaggaagaagatgcggcggaacaaggcgaaatgaggcctaatgcccagaaaagcttcgcaggcatggataaaattggcaatatgcactatagagtttggattcaagtgatgcaagctaatcccgtagaagttcagaatcccccggaagaatctagaggttgaaagagaaaatccgccatagaagaaatgagcgaataccacgatttcgtgtgtgtcgggggtcgggaatgcttcgcagaacgccggtcgccacccgataatctccttcgctgggagaacgccgtgcgccaccatctccttcaggttatcttctgtcacatcggagggcgcccactgactctcgaagctttctctttcttctgccatgaatgtgaactggatggtttgatttggtccgagatatggctggagaggaatgggaatcggagtggtggacgcggggagaaatttcgtgaagtttttgagggttggagcagattgataaaccctagcttcgtcggtgcggttctgtactgtagcacggaatggggaatggcgagagtctcggtggggaagacgaaacgacgtttggacttcggtgtctttagggtatcgggagtactaatgggcctgggcctgtacagtacttcagcccaattatgttttcagcgtggcccgttgtgatccttaggaacttaggcgctttttgctttggcaatatgtgctcacaatgatgcggtccgatgctgttaaaatcctttttaacgcgattcaataattctttggaattattatgattcacatgagaaggtgcccgacagaaaggtgttataccatttttgtaagcttttttaggctacaaaagatgttgggttaatttgagatgactggtttattagtagtcattctcctagcatgttatatgcttattttgattatggtaagggttatagcctaagctaatgaacttcttaattaccatgatctttatcatatttggtagatcattttaagagtttcttactcggattcctaccaaatatatctatttttggaccttttgagtgtttatcattcggcccttttcatattttttatccttgatatattcaagtgagaagcagtcggctgggtattttattgagtaccatgcatgcttcgaaataaaatcacccggtccttgactatatgtttagttttttaactaatcacatagtcgggggctacacctaattaggtgcatctactcgatgcaccatgttttattttcgcccttcacagtcttttagcactcggcaagccgaagcaagttgaattgaagcactcggattattgttttttgtttcgagaagactattttggtcaactgtgaaggtctcggaggctactgtggagattatggttaccccatatctacatggcggttacattccagctggatatatggtaccaaatatagatagaatatctttatgaggactcgggttagattctaaacttgtatgacaagaaaatacccgggatcctagtcggttatgattgtattttatctgtaatcccatgttccgttaggatatggactgtattttgtaatacggatcccttcccctatataaggaggggtccgggttcctctcaggacgattctttttctcccaatcatacaatcaataacacactcggcggaatcatctccggacaggagtagggtattacttcttgaataagaaggtctgaacctgtataaaattccttgtctccaaacccatccactttcctagcttgatagccaccccttttattattgccgaaatcttgtttcgacaccatgccagagtggatggtcagagcatggtttaagtactgaatggttgtttgatggaatgctaaacagtaggcaatgcacgcactaacacgtgtataagctgaatttgaaatagaagtgaccagtgacgtagcctagggctcaacttgtataatttacgtaattacctttatcttccatgttttaattttaaggttttaaaatgtaaattttaatggatatttaggtttaggagtagggcagcagccctagctgccctacccttccgccactggaagtaaccaatttacagaaaactgatttttcactactccctccgtcccatttcaagtacaactatagttttttacgcccaactttcatcgtccatcttatttgaatattttttgaaaaaatttaaaaacataagtcacgagtaaagtaatatttatgttttattatctcataacaataaaaaatactaattataaaaaaaatttcaaataagacggatgatcaaagttaagtacgaaaatttatagttgcacttaaaatgggatgggtgagtatgtaataccggcagcttggtctaaaagattctaaaaatagaaaggagcatgaatacttatctctgatgaaggccgatatatgtttcatctaaaatttcgccaagcatgtaacaaccaatctctcaatacttgtacgccagacagaaaacttgcatcggtaaggttgaaacaaataaatttgcagatcaaagtacctgcgtagaaataataataattttatcaggccactcagctactaacataagagcataaacaaactaaataagcatatataaaaaaaatggcatcagctgacaggtgaaattaaagcagaattaataacattagagtcagagcaagagggaggaggggtgatgccgaagtagatgagcattgatagtttggtacaaaagaatcggagaatctgagtctgaaaatggggaaattcaatactagattatattcacagtgaattattcaccaataatgcgttatccattggacccgatgtggcggatgtgcttcctatcggtagcaatcaacagaaaggggatgggggaggcggggaggggaagcggcgggagaggggagaagctaacggtgctggtcgtgcttcccgggagctggaggtgcgcctctccatcaccgggaggaagagccgagggtgggggatctggcgaggggagccggagagacacgttgcggggagaagcagcagccattctgccgtggcctcgtggggaggtgagggaggtggaagcgtattttgcattgatgctacggtgtctattgggcttttggattttgggccctcctgggtgcatgtgtccaaccatcttggatcagatccttttttatgatcggacggctgttattttattggtgttgtggctcaaccacaatgcagagaattgatattaactatactaaagctatgttctttccctcattttctatataaaagttattttaaaaaatcatattaatctattttttaaaaaaaattagttaatacttaattaatcatgcaataatacgagcttcgttttacgtgtcgggctagatatgggcccagagcttagaggtgaaaccatccatccgaaatgaatgaatattgtctcaggcgacacctaggcgtcctttttctcctcgttggattccctctcctctccgtctgtggtggccattggtctagaggatggtcgggtttatctcatagtcaggtaaatcccgttgttggtcctctcttttttctttgttgtgcagatcgaaggaggtggtggcgtattcctcctccgtctccatcttagagttctccggcgatggaagcacttgctactccttgcttttggcatatgcggtccggttgatgttcaccgggttagtcccacgcgccatactacttttcggtgtctgcaacttaaagttctccaatttcttttgagaagaggttgcgccggccgttcacttcttttcggtaaccactcacataagggcggtgttcttctccttgggtttcggtgtcagatttgtaaggggcagctgtgatttgtttctttggccaaggtagcttcaaccaccatagtagaggcctcaactggattcgctccttggctatcttttgccatgttttcctcttcaccgtcgccgttagcacaggccaaatcgccgctcccgtggaagaagcagacaaaggacccaattgcttttgccccgttcttttcaagttcttttctacaaattttcgatgtatgctcaatttggccgttactgaggggcctttctacaaattggatgttcttcccgttgttgtgttttatcatgtgccttttgtatctaaacttttataataaactagataaattgtctgtgcgttgtaatgggtgaacactattttaattttgttattgttatacggtttaattaaggtgaaattcactgtgagaatttgcttggatatattgtttttcttaaaattcatgagctgcaattagtagtccgattatctcaagttagcctgtatgtttttttaaagagatttcttatacgactacttctgtattttaaaaaacgaacaaacttaaaatccgactcaaatacatatatgtatttaaaatcgaacgaacttaaaaaccgactcatacacggatgatataccaaagtaccagaaaaacatctcaaattcttataaagtaaagatatgtatcaaagtaccagaaaaacatctcaaatttttataccagtaacacatgcatgaccttaaaaaaaagaaatgaatgaacattctccaacctttgccacagcagagacgccgtctccaagcgaaatactcctactccgtcgacttatcaacggtctagatcgccttaagattcgtgcgaagaagagaaaaaagaacaccttatccctccctaccctcttcctctgccaccaccactcgaggagcctcctcggtgtctcccgatccgccgccgccgccttctccggcgatccggcagccgcatcctgaacgctcgccttcccgttgcccccgccgcctcgccgcggcgccctcaccgccgcccaggcctgacctccaaacccgggaagccaccctctcctccatccatggcgtccgccgccgccacctcgtcgtcggcgtcccttcgcctcctcaccaagccccccaagcccctcctctccaagccccacctcctcaccctctgcgccccggtctccttccagcgcctcgtcgccaggtccagcgcgtcgccgaccccgtccccctccgccgccgccgccgccgccgccgcctcgggctccggggtcgatccggcgcagcttcccccggcgctgcgcgacatcgtggcgctcttccagtccgtgccggacccgcgcacacggtacaagcagctcctcgcctacgccgcgcggctgccgcccatggacccggcgctcaagaccgacgccaaccgcgtccggggatgcgtctcccaggtctgggtccacgctgcgccggaggagggcggcgcgccgggcagggtcagcttccaggccgactccgacgcgcagctcaccaagggcctcgccgcgctgctcgtgctcggcctctccggcgcgccggcgcgggatgtcgccatggtgcccgtcgagttcatcgagctgcttgggatcaggcagagcctctcgccgtccaggaacagcggcctgctcaacatgctcagcctcatgaagcgcaaggccctggaggttgccaccggtgaggtaaccactgaggaaattggcagccaagaagtggtccaagaggtcgctgaacggcctgctgcgaaggagaaggaacccgagtttgcggctttcggtgcgcgagaagaagagggttcagaggtgcatagcccacaggaggaacaattggaggaaatgccagctgatgtgatggaagggaatggtggtttggggggtgggaggcaggagaggataaaggagagccttgagcgcgggctttcgccggtgcagctccagatcgaggacatatcgcacctccataagggtcatgctggggtgtcaggaagcaatggcgagacgcattttaatgttcgggtggtctcagaggcgtttcaggggaagagcctgctcaagaggcacagggctgtgtatgatcttctgcaagatgagctcaagaatgggttgcatgcgctctccattgatgcaaagacaccatcagaagtctaggtatctgcacgactgcatatacagttaacagagacgccatagatgcatttttggtcatgttatctttgtaaggtttagttttggatacatactgtagattttgaaagatcaaagcttctcagttctgataattttgtctttttactgcaataattagtgccttaatattatggcagagatacacatgaattttgtcatgccagaataagaaggaacgacttgttttattgagttaatatgtatggctcactgatcaatcttgcatgttctattagcaaaaaacagaaagtgattaggctgttactaccttccagcaaactcaactaatctaccctattaatgctggtcccagctgagaaatcatcatgcatgtgtcattgtttagagtatgaattcgatgcacataggtcataggtcatagcatctcaatgttacaaaatgggcttgaattcttcatgtagatttcaaatgcatgactggttgcttgctttttttattaaatgaagtgtcattaaaagttctctattcatgaaattctgttgggcacatattcactgcacaccttactgttttgatgtttttctttgcaatctggagattaaagcaggaatttctaccacaaaaaagtatagttttgcatactgaatctacatatttacagcatatatggccattagttttcactgtatgagttttgaatatttgaatgccaggagctgacaggatacaatgtagatatattggagttcacagctacctggaatgcttaattccttatgtaatatatagttttctgtatgctgcaaattctatgttgtgcataagttaaaccatgttggaatgcttgtatggaaacagttctatgcaaagcttggatgtctccactgataatgttctctcaaatatcctttgtttacagtaaattttgtattcaaattttaaagttttctcattctccattgtcaatatttttttattggtgcatgtgttagagaacaaatttaatttatttgctaaatatagtatcattcgtccttatctgtgaggttcaaagtcacttatttataccgcaacaataaaatacgcctaaccatttatactgtccaacaagtgaggaggctggagtcgtacagtcatgccccgtaatctagtgcaaggaataattcttgaagtttctactctaataatttgtcttttattactccagattatgacaaacttttctatcatctatgttccactgttaacatgatcaaattatttgctgagataaaacttcacaagtttggttggagcagcatagcctgtacttgcagttgcactaggtagtaaacattaataagagtaacttagacatactgatgataaatgttcataaggttgtgaggtacatatatcgcactctgactagctgatggatcccattataaccatcgctggttacttgatattgtagcctgtcaacataaattagcgtatcagtcaggcttctcttgcttacggctagtttgcagtttcttatttcaattgcagtccctcttggtgtgatggatgaaagtctgattattctgtttcaatgttggaagcaagattttgacgcagtctttatctgttggaatggttgtaagcatagaaattatctgtttgattgaggggattttattagcaatagtactacggtgtaccaaaccgaaaccaggaggggctttagagttcatctcataatttgattctacgttgaggtttaggtatttattgattttattcatttgctgcaatcctggttgcttgttgtcagtttggccttacctgatgccttgggtttctccattgtactgctactatttcttcctgaatgcataggcagggctcctgccattgtttctacttcatgtaatattaacgggatgtttgtagtccatgcaagatttagtggaatatcgtatgtacaagtacaatagacagtatgggtgttacattacaactccactgcttacatccttgttcaatgctggctgtctggctgtgtagatgttactctgttagagcttaatatgatatatagtctatcagggcttacgtcgcatttgtggttgttcctaaagatagcttgctgtgcacatatttgattacctgacaaatttgaagctggaagtaactttcaacctgtggaacatgaatacaacttgcagtagccaagctggattatgaagaaatgaacttgttcagctctgaatcaatacctggttgcagataactgaagcaaaaagctgaaaacctggattaaatcctcaaatgcaaaatggataactggtggtgagagtttgttgctaaccttcattttaatctgtgctaaccttcattttggtggtgggagtttgttgcgcctgtttggggagcttctagctactgcagctgaatcagaagctctcccaaacagtctagcttttggtccagattctgataaactgtaattgtagaatctagaaaatggactagaagccggaagctgggaaacccagcttttccagattctcagaagctggttaccaaccagctgcttctcagaatcttaagctccccaaacatgccgataatccatattgtccgttgtactcctccttcggtcccaaaatacaagaaaataccttatattttgaggccattttgggacgaaggaaatacttgatattccatttactacggtggtatggctgtccattattttagtcatttttttacaaaatcgacaacaatatttttgagaaaaaccccatccgaggcgaaaaaaagcagggctactgtagcgaatacgaaaacaaacaaactacatggcccaagttatatagtttttttttgcgctctggaggtctatagagaatagatattccacttctattcttgtgatgacctccattcttgcgggattgcgcgcaggtgcactgggaggtccctttggatattcccgcccctttcaaaccatccaagacgatcacccctgacggagcgtgaggctcctcaccgggagaccgcgcaggcccctctttgtcggttcggccggggacgctaggtgaagttctaagctctcagtctgtggaacgttcgcgagcaaagagacacgcaagacacaggcgatgtagacaggttcgggccgctgagaagcgtaataccctactcctgtgttctggtggatctgtgtatgaagaagctacaaagagccggagagcaagagagcttccactctcgaaaccctcttcctcctttttttcctctcgtggatctttccaagttccgggggatctcctcctccgggccccctcctaagtgggcagggtcctccttttatatctcaaggggataccacatgcaccaattctacctctttttcttttgggtggggacccatcctatctttactaaaacttggctcgccttctcttggaagcttgtttttgagtgtggccacgcgtcctcactcgtctgacctcggggatcaccctgtcatcccttcataaatgggcggagacttgcaatggctgctgtccgaatgaccttctgatgggacggcccatacctacctccactccgccggaagcaggttcaacgtgggaacgcggttgtctaccgatgacatgaccagtgtcagatcggtgacaaaccagtcatttttgtcctccacgcgtcagcttagcaaactgcatgtctgcccttcttcatacaatgtctttcttgcaatggttgggatgaagcctggtatatatctgaccgggaccaacgtgccatctccaggagctagcacgctggctccggctagggacgagtgcctagaggctctcatcctgacgggatggggcgaggcgtgtgtcagatcgcctgttgtcacctaacccgcaatctgaccggtctgtgaccggtcacagaccggataaacgagcgcgctgcactgcgttacatgcggcgtgacgcgctcgtccaaaacgcaataaatgcggttaggtgagccccgctgtgctcacctaacccatacacgcggcgtaaaacccacaaggggtcggggcgcctcggccctcggggccgaaacgggagcggtccgacccctcggggagacaaagagaagggcggccacatcaatctcgggcccccctccccgagggggttaggccacgtgggtgatcgtgtctgcctcaagcctctagtcatgatactcccggtcccatgtcaccgacagtagcccccggcgttatgccagggcgatcgcccccctcgagggaaacggtcgggcatgacgccactcctatggcctggtgacaggtggggccggtttctactgttgggcagaaacccagcggtcgcaaatcacgtacatcggcaatggtaactcgactgtcagtaatgagcggtctcttcaagactgccacattacttgagtagcacacgaatcgggacgagccggttcgttttgcctggagatatggtgatggcgcttcggtcggcgagcgtaattaacgcgcgcacgatatgttccatctcgactgccacagccgcatatccacctcatgcgccgcaaacgggcgaatgggattagtggaagcgtgggcgcgagaaacgagggggcgagatagtgggcgcgagaagcgaggagccgggcacagcgtttggcaagggtataaagacgccgaggaagagatttgcttccttcctctcgccattattccccttgtcttcgccgcttgcgccctaactccttctttcccgtgcccttccctcaccacacgcgctcgctctcaaacatatcttcttccggcgtcatggcacggggctccgttccgcttgacggtagcgtgctgccgccttcccgcatcgtgagcgagaggcaggccgggctgccgcgccgcttcatgccggaatctgccaccggccaggaggtggtcgcgctgggtgagggacgcccggcgccacactacccggggcggtccgttttcttcctccctttcgcaatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatctctccggctgttccggtggttcttcaccgttcagccggtgtcgccgccgtcgatagtcggtggctgctacttccagccgcgggggccggtgttgaaccgctacattccctgcgtcctccgcaagaagtgggatgactggaagagcgactggttctacacccccctcgccgacgaagcgcgcctctgacttccgagccagcccccggtgcaggcctccagctggcgggtgccggtagatctgggagacggctacgacgctgtcctcgaccgcctggcgggcttgcgatcccaggggctcacaggggccatggtgtacggtgactaccttcgtcgccggatcgcgccactccagcggcgcgcccggggcgcctgggagtacaccgggtccgaggactgtatgaggacccaccggggggtcaaatgggactgggtccctgaagacttcaaggtaatgatccaacgggtgctgaatctcagctccgtggaggcatccctcatcccccaaggagtcctccccctctgcagcgatccagatcgcgtcaacatcctgaccatcatgatgacggtcggggcctcagaggagcgagcttctcgaggccatgacggcgcgggcgggagtcgcaggggcgaacaatctactccaggagggggtcgtgcttccgggccccgtgacgagggctcgggggacagccgccctgccgacgcccgagggaagaggaagcaagagggtacctcctccccatctcctccccgagggggcggggcagcgcgtgtcagcagcaggcgcccggagggggccgcgccgacgccgcagcccgagggggagcggaagaagaagcggctccgcaagatggggtggacagaaccatcccggggaaaccttatttcccctccaaggtggtcgtttaaccgaccccctcacaggttcgtcccacgcccattgtggctgtattcattctcccaacgcgagtttttactcacccatcttgtttgttttctggtctttcttctgcttcagcgagatctcgtcgcgtccctcccgtcattccaagtccggccaatctgaggccgaggatacggcgaccgcggaggcccggaggcgggaatctgaccggcgagaagccgcggatcgtcttcgggaaaccgaggaggccgcccgggctcgccaggctgacgaagccgctcgggaggaggccagactccgccaggccgaggcgacgacaacctccgaggcaacccgcgaaactgaccggcaagaagccgcgaatcgccttcgggaagccgaggaagctgcccaggtggccgtccgaactcgccaggctgaagaagccgctcgggaggaggccagacttcgccaggccgaggcggcgacgacttccgcggcagctcgcgacgaggccgcgggcgcatcgcttgggcccactccctcgggcgacacttaggacaagccaggtccgggggacgtccccgagtccggcacgtccatcggcgggccaagccgcgcggcatcctcaccgaggcggttctcccccatgccttccgttgccccgctgagcgcagagccccttctgcaagccttggccgtcgcaaacaccacggtgttggacgggttaagtgcccagatggaggccttgcaagcagagcgggtggagctcgacgccgcatgggcgcgtgtcgaagaggggcgtcgctcggtggaggccatggtggaggtgggccgcaaggcacaccgccggcatgcctcagagctcgaggcccgtaagaaggtgctggaggagatcgccagggaggtggaggaggaacgggaggctgccctcatcgccaccaccgtgatgaacgaggtgcaggacaacctccgccttcaacacgggaactgggaggcggagctagggaagaagctcgacgccgcccggggggtccttgacgctgccgctgcccgagaacggcgggtggcggagagcgaggcggcgtcccggcagcgtgaagaaaccctcgaggcccgtgccatggcgctggaagagcgttcctgcgtcatggtgaaggatctggcggaccgcgaggccgccgttgccatttgggaggtcacactggcggcgcacgaagccgcctgtgccgaagaggagtccgcactccgcctccgcgaagatgcgctcaccgagcgggagcgagccctcgaggaggccgaggccgcggcgcaaaggttggcggagagcgcgtccctccgtgaggctgcgctagaggaccaagcgcgccgcaatctggaaggtacccgcgccaagagggccgcactgaaccagcgggccgctgaactcgaggcgcaggcaaaggagctggatgcaagggcgcgtagcggtggggcggttacgggcgacagcgacttagccgcccgcctcgcagctgccgaacacaccatcgcggatctgcagggcgcgctgaattcgtccatgggggaggtcgaggcccttcgcctgacaggcgagatagggcctagcatgcttcgcgacgtcgtgtcccgtctggaccgcgccaggcggcaggcgggcctctggggtgggcggactgtgaagtacgccgccaaccaggggggcctcgcccagcgcctctcggagatggccgggactctccagcggctccctgaggagctcgagaggacgattaagtcatcctcgagggacctcgcccgaggagcggtggagctcgttctagcgagttatcaggccagggatcccgacttctccccttggacggcgctggacgagttccctcccgggatcgaggacggcgcgcgcgcgcaggtccgggacgccgccgaccatatcgtccacagcttcgagggttcggcccctcggctcgcgttcacccccaactccgacgaggagggcgataacggcggtgtgggcgacagtggcgacgaggctggcgacccgggtgcatcggagtgagcccccaggcccccgccaatctttaaatagttttttcttcttttctttcttctgaggccttcgggcctctttcttgtatagattaacttaatctgcaatcaaaataaagaaatttctgtgtcaatttcattttgctgtgtgtatgaaaacgaggatgatctgtgccatggtccttttgcgtcttagcttgaacaagggctcgtgcccaggtcctagtcctcaaatggctcgggtcggggctagtgcctggggagatccacgtgtcgagactggccaggccgggagcgtggtgaccaagggttatgggtgacccgattgtgggtttttgccgattcccccccggagttcaccacgtcccggggcacggctcggttctgggcccctttttggcgattttagccggcccgagcccccgagggcaggattgagcacgagtgacctatttcaagtcaagattcttcaaaaggaaacaacagcacagacacagcctttaagaaatcgaaaatgcttttattgaaatacagatagaaaagagataagaatatgcatgtgtggtagcccccggccaaccctgcacgcccaaggggggtgcggggttggcccgagcccaaaacctgacacccgaaccccattaggggtagaagcgacgaaggtgttcgatgttccacgggttaggcagctctgtgccgtcacccgtggctgtcacgtcccaaaacgactctaaaatacatcctcgaaattgtgccgagaataattaaaattcatgtgaaagcctccaaca

SEQ ID NO: 16612 - DNA, 1105 bp, Oryza sativa
aaccccactgtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggcca

SEQ ID NO: 16613 - DNA, 2465 bp, Oryza sativa
acaaatcgaagaattggagagtaaaggttatgtgcgacctagctcatccccttggggagccccagtgcttctggtttagaaaaaggatggctctgagagaatggtaatcgactatagagccctgaatgaagtaactataaagaacaagtacccgttgccacggattgacgatttgttcgatcaacttaaaggagcaagagttttctcaaaaattgacttgaggtcaggttaccaccaactgaaaatcagatctgaagatatcccgaagaccgctttctcaacgcgttatggtctatacgagttcacagtaatgtccttcggactcaccaatgctccagcgttcttcatgaacttaatgaacaaaatctttatggaatacctggaccagtttgtcgtggtgttcatcgatgacatcctgatatactccaagaatgaggaagaacatgctgaacacctgaggctgataatggaaaagctcagagatcatcaactattcgcaaaattctcgaaatgcaaattctggttagaccgagtagcatttcttggacacgtgatctcctccaacggtgtcgaagtagatcccagcaaggttgaagctgtacttgcttggaacccgcccacgaatgtgtcagagatccgcagcttccttggcttagctggatattatcgaagattcattgaaggattctctaagctagccagacctatgaccgagctgttaaagaaggaaaagaaatttcaatggtctgcagcctgtgaagacagctttcaagaaatgagaaaaggttgaccactgccccagttctcaccttgccagatatccgaaaagatttcgagatcttttgtgatgcatcaagacaaggcttaggatgtgtcctaatgcaagaacgaaaggttgtggcctatgcatccaggcagctcaggcctcatgaagtcaattatcccacccatgatctcgagttggcagccgtggttcatgctcttaagatctggaggcactatttaatcgggaacagatgtgaagtatacaccgatcacaaaagtctaaagtatatcttcacacagaccgagttaaatatgaggcagagaagatggctggaactaatcaaggattacgatcttggaatccattaccatcccggtaaagctaacgtggtcgctgatgcgctaagtcgcaaggtctattgcaacgtagctcaaatatggcctgaccaagatcgcctgtgcagagaattggagaagttgaggctgaccgtggtacagtcaggtgtccctgccagcttgacagtacagcctaccctagagtcgcaaatccgggaagcccagaaagacgacgaagggataaaagagttaataaaaagaatacaggagaagaaagacaccaatttctccatagacgatcaaggcacggtttggtgcggtccacgcatctgtgtaccggccaagaaggagttaagagatctcatcctaaaggaagctcatgagtccgcctactccattcacccaggaagtacgaagatgtaccaagatatcaaggcatacttctggtgggctggaatgaagcgagatgtcgcagaatacgtagccctgtgtgacgtttgccaaagagtcaaggcagaacatcagaggccagctggtctgctgcaacccctatcgattcccgagtggaaatgggaagagatcggaatggatttcatcatcggtttgccaagaacccccagcgggtacgactccatttgggtaatcgtggaccgactcacgaaatcagctcatttcgtgccagtgaaaaccacctttgatggaaagaaactagcagaactctacatgacccatgtcgtatgtagatttggctgtcccaagaaaatcgtgtcagaccgaggcactcagttcacctcaaggttctggaagcagttgcatgaagccctcggaaccgatttaaatttcagtacggcctaccatccgcagaccgatggtcagacagaaagggtaaaccaagtcctagaagacatgctacgagcgtgtgccttggatttcaaaggcacttgggatcgttgtttgccgtatgccgagttctcatacaacaacagctatcaggccagcattcaaatgtcgccgaatgaggcaatgttcggaagaaagtgccgcactcccttgtgcttcccggagctgctcccttaggtgctgaatctcgaggtcgagattcttgttaggggggttggtctgtagcgcctgttccgtcgtggcgcctagcgggaaaattatctcttaaaaaccctaattgcgaaatttgtttctttgcttgttgtctagtgtccgtgccatcccaagatctcaatccccgatctatcatcgagtccaattccgaatccaatccttccaaattaaattcctccgcaaaagtctattttgcctcccccgggggtcgatgggccgatttcctcccggcccatctccccctgggggcg

SEQ ID NO: 16614 - DNA, 821 bp, Oryza sativa
cggcccgcgtggcagccacgtaggcgccacgtcggcgccagctcagcctagaccgggtcgagccgaccccggtcagtccctcgccgtgcgcgcgttccaccgcttgccgtgaggctgcgcgtgggcccgccgcatccgcgtccaccgcgaaccgcgcgcgtgcaccgcgtctctcccccgcccgcgcgcatgagccgcgtactccctccgcacggtgagccgagccactgacaagcgggtcccacccgggaccgcgcatggtgagcccggtccaccggctctctctctcctccctcccgcgcgcgcgcgtcttgggccgctttgggccgccttcttgggccggccggcccgttaagctcggccgagccgccctttctctcgggccgcgccctagccgcccgaggaaagtctatattccctccctctccccttttcttttctttttcttttccaaaaaaaagggatttaattaaatccttttcctttagaccaaaaatccaataatcttagaaattcaatatcttcccaaccgtaaatccgtttgactccgttcgaattccaaaatttctcaaatctcgagatctatctaatggcacgcttagaggtcattaatagggctttattttcgccgtttgttgagttatcccgttttgcgtatagtttcggagcccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttc

SEQ ID NO: 16615 - DNA, 4089 bp, Oryza sativa
atccttttaaaatgcaactgaattgaccataatgtttttctctaggaaattaaaaccgcgttgtcatgcacatgctcctacaggtatggaaaggaataaacaatacaagatgctggaagagaatggtaaaaacttaatagttatccaagtcagtagagaacaaatgaagttttcacatgtggcaaggcctacgtcaagcagtctattggttacctagttgtagctgtgattttgcaaggcttgtactgttgcaatgcctcatgttattccccctttacctgtaggctgtagctttgttctagttctatttaagtcttttggactgtgcattcctagactgtgaacatggactttgagaaatgagcaattatattgtctgatggtaaatttattttcttgttacaaaatgtgagtggttacaggagatttctaacttgtatgatgcatatttatataatgactaaataagttggatgatttgaactcatagaaaggaactaacctgaatattgtctgtataaagaatatattctagaactctacgtcaacttgtaatttttgtgacatttgtgacataaaaatagaaaaggtgctccacattttttttctactcttataatttttcaaatctttttgtttttttccacaaatagtaccaattttttgtttcaatatctaggacaaaattagtgaaatttcaaggatatatatttcgataattttgctttatccccatgctttactctttaccaacacgatcaaattattaatctatcaatattgaacaagaatcacagccaacactatttttgataatcatatagtgtgttattgtaagattgataaaccatctacatgtaacatatttgtgcaactcatatattatgtgttacgaggtgctttgtagcacatgtttgtgttactgtctgtatccttgtagcacatttattcaccctactaaaaatgtgttacgggatctgctaagaacacaaagcatgtgttactggtttatttccctgcaacacagtttagaatgtgctactgccatgtgttgccatagctatattctgtactagtggctgctgctagatgtgcagaacgattatgcgcagatggtacaatctccaagcgatatgcgatccagaaagttatgtttccccatggatattatatattctcgaaaagataatcgagtctactttcagttccaacaaacggctcatcgtttttacttaccatgacggagtaatgactattttactatagctacacagaagctgaaaaggctacgtgaacctcctcgggaatgattgtaggaggcctttgagctagcccagttcaccgaattacattagttgtttcatccccatctaggatggttattcttagtataaatatcccctgtgttttatcatttcgaagacttttgacaataaaaaaaatgaacacctttagttcagctatatgctaacaaattgagatactgatctctacctcttttactcttgtggttttcctgtgggattatagaagcgaccactttatcggctcccaattgttgctcctactgcctttgaggtttttatcgattgattgttggttgtgttggttagttctttgtagtggttgggcgaatccttgattcaggttgctggttaaagacggtggttagcttcgagttttatttggcaggttgcactacgtattttggctgcttgcagctagttattttggtctctttgcagctagttatcctttgttgtgaagactaggaccacaccccatatcaactcctatggtcccaaattgatatgccattttataactatcaatgacaaagagcgcagttttactttacatagaaaaccctcctctctcttctccatgtcaccctaaaatcaaaatcctacacaaaatgccataagtgacatcacaatattatagatgccaatggataattaagtcgagcaagtatatattatcagcagttaccaccccatccatgaataagccaactaagaagtttcttgattaattagaaaatactcaagctaacatggttttaaaaggccagctgcaagttaaacgtatatcaaacaacgcaaacagaagggaggtgaggtagcataagtgagatgagagagtagccagcactactggaggaactatctttactgggttgaccaaaaaccacattatttctgggttgaataggaaccgaccctaaacatcttttttatcccggttaaaaagcccaaccaatttttttttatccttagttccgggtggtaacctaaaggtcatttttattcccggttcaatagttgtaagcagtggcaagcccccccagagatttttagtcccggatgggatcaccaacccggcactagaaatatccccccacctctttaatctcccacgcctttttcttgatctcctcgatcctgtctctctctctggctttctcggtctctcccgatctctttcgatctccctgtcctctgctctctctatctctccctctgctctctctggctctctctatctctctctctctctctctcttgttgtctcgacggaagcaaccgcagtgtccaggcggtggcccggcaggggaagcggcggcggcccggcggtggaagcggtggcggccgcggcctccccgccaagtccagcgggaggggaggccagccggcagtggccggcgaccttatcctctcctccgctagatccggccggaggagatgcagcgggatgggaggccggccagcagtggcgatgttgtggatgttgttgatctgtgaatgtatatgtgcaaatttttctaagttgtgaatgtatttgttaatgtttctgtgaatgagtttgtgatgatctgataatttgctggtgttgtgaatgaatttgtgattaattatctgataacttgcaagcaaattaacaaaaaaaagggaaaaaaggacctttagtctcggttattggtcccaatcgggactaaagatggcagtaccagtcacgtggcgctgccatctttaccgtgactaaagatgtatcttagtcccagattcgtagtcccggttgcataaccaggactaggggggttccgaaccagttataagcacttattataggatcgaatcacaataactaagtcaactagaggggggggtgaatggttggtatacccaaaaactgaaaaacttttagcggaaataaaagttaccctcgaattcgacggatcgcggtctgaccgaagttgtcttgccgatctgatcgcatggttgccgtcggtctgaccaagattagatctccgatctgaccgccgagatcagctgctattcgctgtcgtcgccgccggtctgaccgccgcttgccgccggtctgaccgccgcttgccgccggtctgaccgccggtatatcgccggttggaccgtcgaaacccggtaaacacaaatcgaagaactcttaaagtggatgacgactttattgattctctctctgtgtttacaaagtgcacaatcagcactccttacaaaaatttcgactaaactcgaaaccctaactcaaaactcaactcaattgctctcaaaagcgataccgggaagcctcatgctccccctctatttatacatgaggtaggcagcctaaagccacgaaccaaactcatactaagagtcctaaacaccttaggaaaccctctagtacaagaaagaaactttacataaccaatcgtaccaaatttggactccttctaaatttgactccgcatcccatacgcacacaatacctccatcgtatgccatatggaatctccatcaaccacgtgcatcaactctagcctaagtattccacatgatctctgaccaccacggacgtcgtcttatccccaagccgactcccggtccgtcaccgcaaatactctcccaaggcatcgagtcacctacacatggaataaacaaagaaaccatattccgagaccaagctatctccaacttgactcattagtagcaaacaacagtattacataagtatagtatccatctagaagccagaatcatgaaataatcacggatatccaaactaataacc

SEQ ID NO: 16616 - DNA, 808 bp, Oryza sativa
taaggggattggatagagatccaatatgagcttaattcggatagggatccgaataggagtcctacgggccttggaggcccgagtgatggatcctatatattcgtgaggggtgtgaccggcggaggcatttgcatcacgtaagaaaccctacccgtcacttttggaccttggggcatagattgggttggacatggagatgtcaccaaaacagcacaagagtcacatatgatgtgattagcaaggcgttgcttacctattttgatagttgtctagctgtgattccaaagctcactagacactaataataaaatgaggatcttgactcactatgttactagagggaattttgtttcacaatacatagtgggagtatcttttgttaaattgtttaatcaaaggttaaatgtaaatatgatgctgattttgcatacatatatttctattgtagatcatggcagctcctgcaccatccaattttaacttgtggtctattcttgagaaagagaagttgactagaacaaacttcatggattggtatcgtaacctaagaattgttctcaggtaagagcacaaaaagtttgtgcttacacagccttttccagctgactttcccaacaatgctcctgccgctcaacgtagggagcatgaaaggcgatgcaatgaataccttgatataagctgtctgatgcttgctactatgtcccctgagcttcaaaggcaatatgaggcattggatgctcatacgataatcacgggactacgtaacatgtttgaggaccaagcaagggctgagaggtttaatacctca

SEQ ID NO: 16617 - DNA, 5273 bp, Oryza sativa
  unsure (1)..(5273): unsure at all n locations
attcccacaatcaggaaaagaatgtagtggctcagggtctcatgagcagatttggtgtgtgtgtgtactactctttgttctatggctttatgcactacctcacattctcacaacccggtctttttgtgttttcttgatacatatatatttggtactggcgttttaaataaaagcaaagtaggtagactctctaccaatcgagggatcgaagtatcacatcaatgaagatgtatttgtggcaattgctagttataagtaacttgctccgcttaactcagaagtatatgcatgccccatgtaagttctaatggagagtaccaccaatgtgtatgttccatacaaaatttaaaaatgtaaagtgtacataccaatgtgaaaatcgtttaagtatccatggcccaacttttcctttcattttttttccacgaaaacagtccctgaggcactgttttgttaatccccaagaggagggtattgaagggatttatctgacacctattgtggtgtggaataattctccttaatctccataaatcccctccaaactgaacaaggcccgatgtggagaaacctaatctaaattgaaaatcataaaagtcccacctgttcttgatgtcatacaagtgtacaaaccgaaaccatgttcattgttccacctggtcagcgtgctcgaatgcagccttttcttgccactgctcatcctggagccaaccaattcctagtaaaaatctaacggacatatgcaaccatgctatagcattactgttcttctagtccccaatatttttcatggtggtagaattcacaggcatgcatggcgatgcccaaggctgagccgatcaaagcataaagcagccattcagagatgcctatatggtgttctgcaaacagtgagaacagcagcagaacaccatagaggaatgggaaaaaacatctctattgccgtgaataggtcacacgaggaggagctttcatccccggtgcctttcatgcccatgtttggctgagcatggactaattaaaattaaaaaaggaacttatcatttgccaggcatgtgtgcatatgcatgtgtggtagctgctgataatttgcgcactctacctgagcaatagtgtgacgtttgctatgttggagatttgtcaatgtaggattagagggttgcatagagatttgtcactcatgatatttttttagcgttatatttagattttagggtgacatggagaacagaggaagattttctatgtaaaataatgtacttcatgaatgatactccctccgtttcacaatgtaaggcattctnncnttnctcatattcatattaatgttaatgaatctagacatatatatctatctagattcattaacatcaatatgaatgtgggaaatgctagaatgccttacattgtgaaacggaggaagtagttataaaatggccaatcaatttaggaccattgggagtagtatgagaggtacatgaattgagatggtcatggctagatagctgcctcttgataccacagttgcagtaaaaagactctgcctccagataaagttttaatatgctgatcattaactggcgaatttgtaatttggcttatggagagaaagacatatcctatttgttacggccttaaattccaatcagctttcccatatctatgttttctttttcatacgaaagcatcaagtcatcccaaccattatgttctctaatacacagaaagaggaacccgctcaatgtagaaaaactttgctagaaaagggtgaaccaaatttatcggagtaatcagagtggtagaaagtccaaataggccatatcaagaggccttttatagtaccttccactaggaggtggtagtagtgtagtaggaataaatatcgccgctgatttcgatggtcaatttagtcatttgtttaaattaggtgaaagggcaattaagtaatcattggcaggccctaagagcctgtttggttggagggagttagtgatgggaatgggagtttatgatatctgggagtttaagtctataatttggttggaagacttggaaattcgagggggtttgggatagggaattaagaggtccaattcccaccacggcttgtttggtaactcgagggaaggggattgagagtttacacgagggaattgatgatgagattaagatgggaatttgatttttaatcccaatatcttgtttggtagaggtgatggaaattcatagggagtttatttggagattaggtcattaataaaaacggatggctgagatttgcttagaaaaagtaaaggaggaattccctcccaattacctgcccctacctagatattgaaaaggagggagttccttcctcaattccccatccccgtcccaccaaaattcccatgtctcccaaccaaacagaacaattaatagcctcgtccctctaaactcctagtccctcccaaaaactcactccaactaaacgggccactaatctcttacctgggggaggcctgttaattcgtgagacttgtagggaattcgatgtgaaaccaaacaatggaagaggactaaaaatataactcctatgaccaatcccaccatcaactccctcttgaaactcccattcctctccccttctcttgccaaacaggccgtaaggaggacggctcaaacatcagtcaatcgttcccatggccaattcgtcgggcacggcgcacggcgagcacgggcacgcgccgccgcctgttcgccgttcacccctttcacttccaaccccgatgtgcgccgtcctttcactgccaacagccggtgcgcatccttgcgcaagccaacactcgacaccactcgccccgtccgcctcctgacgccgcgctgccacccgtcgacctaatgcgcccgcgcgccggcgccccctctcgctctccttgcgcccggcatgaagtgttgattttaatatatccagaattgcggcatcaagtgctgatcttgaacatacatgttttgctcgcagcttcatgatggataatcctcaaaagctatgaaattcagtcttcataatataccaattgattatcttgactagtcgcaaacaaaacctgaagattctgaaacttatttgtttcctgcgattctgctaactaatcacaagggatctaaaccttaattattttctgcaactgtgctttcagtttaattaactctttcattaacgaaagtattaatgatcccgcaaaataattaaatctgaatctttaatgtgccctcatggttgacggtagtagaatttgtgtaagccaggcgtcaaccatgcctcaaatcagaagtctgaatttctgaactctggcatgacctgaagaaagtttcatagaaaaaacaacctcaagaaaaagcagtacggccggaagggaaaagaatccgacgagcgtgctgcctccggaggtggcacagcagtgatggcctgatgggagcagcggcggtgccagtgatgggtgtagggttcaaaaatcacgatctaaagctattgattaattatttttctttttatttcataagtggactgcatttttatagacccaagaacaaatcacaccctctgccaaacctaaattttcaaaaatgtcacaacaattttttcttccagaattaccattctactacactcctgcaccctgttacactaggtgcagtagcaacgtacatcctccgttggatcccatccttgaacggcccacattgatccatgggtactttaaaaaaaaatcccaaattaagcgctgaacaagaacggtagaatagtagcctcattcttacacaagtataccatgccaacttctgccgtacatcttgtgcagtagatccaccttgttgactgatctagattcatgatatcaacagctcatgtggcatgggtaactagttttacacagatcgagtcaacaggatttctagtgccacccatgcctacaattgaattggaaatggaacattcctttgttttcttcattgcagcacacaagaatatggattatttcaacatagagcgcatgcggaattttgccttatagtagagggggctggactgtgcgtgctctagtgctcgggcaagctatatatatatatacccgataaggttgtagtatatagttgttggtatattattctttgcaaccagccaaccacacacagctactcagctcccctgctcttttctcctttgtgcaactagcatatactccgcacatgtcattaactaaagacgtactcaaaactccatcaaaggtagttatacgtacttcatgtgtttgtggaaagtggggagcttagttcagatcatcagagagttctttaattttcccgttttgtgcagttattgccaattatgagctgtctctggtaataggctatcacagtttcagcaaatcccacgcactgtaccgggagattgttttatgtcttgaggtgatatccacttattttgttatgttacctaaatagttattaaagctttttgaaaaaattgataagataggttaatatgagatatatcactatgcaaacatgtaagcttaaattcgacttctacaagttctaacaaatataactgtgaatttacatcaactaattttaattaattttcttttattataacttgtaggttctaaatttgaccttgtatgtttttttagtgatatatctaatattccactatcttgttattttttcttaatttttataactatttaaacgcatgtaagatatgaggggatgttgaatagtataggatattccttcgagggatgaaaaaaccatctcccccaatgaaaaatagttttggtctatattttttaataagcgcaattgattttactaaatcttaaatttttagatgctttcaaatcccctccaaattgggtaagaccttgttaaatttttcatgactttgataaccacaaattttgttatgcttttgatcccagcaaaatttgctaggagtattaaatttgctttgacttggatgtccaaaattttgtcattgttagagagaaaacagggatgcattagtgtgcacctcattgctcaaaaagaattttccagcacgcaacttaattgtaataggatatatatatatatatatatatatatatatatatatatatatatatatatatatatatatatatatatatatatatgcactacacaagcagtacaaattccatccgatcgatcgagccatccaattttacatggatgtatgctagattctacagcagatcacaatt

SEQ ID NO: 16618 - DNA, 1926 bp, Oryza sativa
atgccaaaggagtggtgattgcgtggccttcaatatgtgtatgttagttgtttctaccttggttcatgtaacttaatgttttgctgtacattctagcttaacaaccaaagtaatgtttgctacgtgcaggtttggaagattaatggttgatttcgcttccatctcaccctatggattgataaaccggcaaagactttcaagaagaagaagaagaagacgaatagattatcattttgttatattttagtatgaaagactgttattctgaagacttgcttttctcaaatggattatcatttatgttttgtaatgatgggaaggatgttttaactattttgttatgcaatgcaatctttattttcactaaatgtgatgtgagtattttgtgagatatgtggtgcttttgaaagaaaataataatgtcaattaaattttgttcctttaacctgatcgtgtgtgtgtgtgaatatgtatatactaaagtttgttcccacaaaatgtattggaataaggaaacatgttgctaatcatattacatttatgttactacaactcaaattatgtattcctggggtactatgcagtatcacataatatgtgttcttataggtgatatttgtgtgttacaaggtagcaacacattcttagttatatagtaatacatgttatatgttgcaacgtattgtaccagtaacatggcctacaagaacacttatagattgtgttactgggaacgcttgtaacacctatactgatatgtagtaacacatgtacgtgttgccaaagccccttcctgctgtagtgagcaggccacaggagcgtcagatccgatagtggcgatcctcaggagtacctcagtaggtctgcagctatgggtctgtcagtggtggggcttggtgccgcagtgagtcctttggctaggcgaccgtgatgacgaccacaacaatggcgtggggtcgctatcggcaggtcagggcagttttaggcaaaattttgtggtgaatataggtgaaattttggggattttttttgtgtgaattgctgtgtgaagtacaagaattttggggattttgaatgtgaatttgaatttagggacttttttttttgctgaaaatgcatcctatagacgagcttcataatatgcctgcatgtggaaatgcatctccactgacaggtgtcctagtacgctctcgcctgtgattttgattttcaccgccggctgtttccacgccttaaaaattactccctctgtcctaaaataagtgcagttttgcattattcacaacgtttgaccgttcgtcttatttaaaaatttatatgattagtatttttattgctattagatgataaaacatgaatagtactttatatgtgactaaatatttttaaatttttcgcaaattttttaaataagacggatggtcaaatgttgggcacggatatccacggctgcacttattttgagacggaggtagtaacgatttctaagagtcgtttggttataggcagtgctcagatccttctgcgaaaactccatttgactgtctagaaaattgttttttatgggtggtgtttgaatcttctaaaagatgaagataaagattaagtggttcacgtaaaatgatgtggtaataacatatgattaattgagttttagttattataaacttgaaaaatggattaatctcatattttagaacaactttcatatagaaagtttttatatgaaatgcaccatttaataatttgaagagtgtgctatgagtatccaaattttcatccacttgttaaagaagaaacaaaggggaccatagtcttgtatctactgctgatcctgaccctctactgcgcgtgccaattctacttacaatttcaacgggacaaggaactactccctccgttttgaaatgtttgacactgttgact

SEQ ID NO: 16619 - DNA, 3519 bp, Oryza sativa
gaaaaaatgtgtacatcttatgaaacataatccaaaacattatttccgaaaagcagaagtaaacaaatccaaaactatgttgagaaactgtcagataaacactttcacttcaatctattattttaacatgagaatttttacggtatttaaaaacaatctcgaggtaactaaattttacactaaaaattttggtacctatcaagataccaaattttatactagaaaatctaataccttctgatacattctcaagaatgctaaaaattaccatttgaacataggtcatgacagagatatactccctccatttcaaaatatttgacaccgttgactttttagtatatgtttgaccattcgtcttattcaaaaatatttgtgaaatatgtaaaactatatgtgtacatgaaagtatatttaacaatgaatcaaataatatgaaaagaataaataattactttaaattttttaaaaaagacgaacggtcaaacatgtgcttaaaaagtcaacggcgtcaaacatttcaaaacgagggagtaattaacgaaactcgtcttcccatcaccgaggttatagctgggtagcataattcccgcagaaaaactatagaacggtgtcccgtcggagggacaatgtagttaatcacgttcatccatcattacacctgacgcgtggtgcgccgagctgagaagatcgcacgacgcgtgcgtacctgtctagcgaaggggagagcaacgtcgccaaatgtgcttgtgccaacctcaaagctaactagagggcagcagtgtgcaggctagtgtcctagctactattctttctaagtatcacctgcaaaatagttgcaaccatcccagaccaactcttctcctattatcttcttctcgactttcattgcttgtagatattattcatatgtatctatatgatatatatctcgccctttttttggtttttcttcaatttgttttgcgaatttggtcaaattttattaaaatttaatcaaaatttgttaaaattctaaataatttcgtgcaaaaagttccaaaagtcttgaaattgctgaaatttagatttttttctacaagtgttaaccctggatacgcctacaatatgtattatacagattaaatatagacgatacccatgaaacctatatggtactatgatatctcgtggtacctccaaatatcatgggtaccagtaccatggtaccttgtgataatctatgttacccagatacggggatacggacacggatacacgacacggcgatacgacattttccaaaaattaaggatatggggatacgctaatatatataaaaaaaataaaaatacagaaaagtagtaaattgaacagggtaaaaatagattgtgaataagtgctagaccacaaatagtgcatagaccacaaattaatagttcaacggtatatccaaacatcgcaatgaccatataagttcacaaataacaagttcacatccagcccacagggcacaggcacatagctagtttataaataacaagttcacagccacaaatagaataattaggatagaccgatagacttgttcaagactataagttcaattcaataaacgaacgggaaaacagatcggcggtgacagtgctgtgccgacgtcagagtaggaggcggcgaggcacagcccagtgcgcggcgccggtgcagctcggcggcggcgacggttgacgaggcagcccggcagcagcgacggcactggagcgcgtgaggggcgttggtggtgacagtgttgggccagcgtcggaggtggagagcagtgtggcggcgccggcacagcccgtcggcggcaatggctgatggggcggcggcggcgctggagcgttgggaaagagaggcgagagtgagagttgagaggcggcgcaggctgggtggatatgatgccccccacacgcacgcgggttttgataccgacgaaatattagggttaaacgaatcgggaccgtatcggaacgtctcataaatgtatcatgaattactttatttattttaaaatcaggataaataccgatacgtcccggacacgtatccggccgtgtccgatacgtgtccgtatccgatcccgtgtcggacacagacacgcgcctgctttgccgtatcagtgcttcataggtgataattccttgaatgtaccatagtgcttacacaacgggataccgttgcaacgggatattttaagtgactgtcccttttccttttctttgtccccgtgtgctccctggtacctgatacctggtatgtccacttgtactctctggtacctgatacccggtttgtcacgccccgaactagtcccgaccggaactagcccgtgacgctccaaattaacctgttaatcgataccagtcccaggaaacagtgctggtatcacagggagacagaatatcacagcaacaaaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggaattatttatatagagcaagggtgagtacgggagtactcagcaagccatgggaaataagtgtttaatgcaggcttcaaggaaaggctggtgtttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccaggccaacaacttttcaaacggccacccgggcctacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacgactgttcgaacagtttgttaacctctgcagagggggtacactttaccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggacccggtccttaagtgcgagagcgggaaaacgtacactgatgagctactg

SEQ ID NO: 16620 - DNA, 6601 bp, Oryza sativa
actattgtgggtacggagttgacagagaacatacccatcacaacgtctggagcatcctgagcggtttcagcttgaatgtggttcacccggcctcgaccaaagttgttggaaacacgtgaaccttgtccacttgcctgagagctaggacgagactgagctgccgctggggtaggagttctggcagtgctgccattcgcatgccctgagttggtgttggtagggttctgagggcactgtctagcatagtgacccatctggttgcaccggaaacactgaactgctgacggtccctgcggtgacttgaaagaggtaacactgtttggcgcagtattgcaaccaggggcacgctgctgtggctgaggggccggacggttcatctgaggacgaggggcgtagcctggttggcggttagcctgagtgaccgactggtggtattgcatgggttgtccgtagcgagggcgaggtgcgcctcgggaagaatttccctgatggttagacttgcgtttcttgtattcttcggtagcctcttttctagcatcctcgagtagaagtgccttgttgatcatatgttgaaaagtggggaaatcatgagcaatcaattggagtctcattccaactgcgattcctttcaagaatttcctgatcttcttcttgtctgtgtccacttcctcaggggcgtaccgagccaacttgttgaacatacttaggtactcattgacactgctgttgccttgcttaagtctgttgaattcttctttcttcatatcaatagcgctttcaggcacatgagctgtacggaaagccgtagcaaactcatcccaagcaatgttagtgggttcagggtgtgcattgcagtaattctcccaccaatctgcagcaggtcctcttagctggtgagaggcgtagagcgtcttctcaaccggagtacactgcactaagttgagttttctatcaacatcttttagccaatcgtcagcctcgacgggctcgacggtctgagagaactctggcggacgagacctcagaaagtctgtcagcttggatctattgttgcccacgtgagggtggccatttccatgcgcattatgctgaaaactggctatggctgtggttaatccctgcaagatttgtgtctgaactgccattaagtgctgcatgttgttttccacatgaggtggggaaggaaggcgttcttctccagaattgtgactggcagtgcggtgagagcggtgagactgttccatctctgcatcacgggaagctgtgcgatgcgagcggttgctgcggcggggttgctcaacttctgcattgcgggaagcagtacggtgtgaacggttgctgtggtgagactgctcattagctgactcatgatttgctgccggctcggttctaccatattcaaaaccaaagcgggctggtgcacgagctgcacggcgggggcggctagccatctaaactcccagaaaagggcgggggaagagtcagataagcacttaggagagcaaggagcaaagtaaatagcaactcagatagcacacactaggcataaactggatttttcaaatcataaaaacacctgatacaacgggtgtggacaagtcacagagctacgccgagcttgactgggcgcacaccacctaggagaaccagactaccaaacaacacccacaacaaactcacgcacgcactacctcgccacgactccaaaagagttggcggcggaacaaaagggcctaacacacggacggctgctgaagactgcctcctctactcctcgtcggccaggctgcctccagtagtcggctcctcagtcgaagaaacgtcgatcggctgacgcgaagggaccggcggaacctgtcgagggccgacagcagcacgggccgctggcggtaggggagctgggtagtggaaacggaacacggtggaagaaccaacaacacgcttccgcgcagtgcggataaagcgtggccacggcgggaggaagcaactggggtgtgtccgggggtgtatgaaagggctaactgggtgcgggtagggggagtacactggtgagtacggcgcacgcgagctgggggagcgcgggccactgggagtgcgggcagacccgcgggagctgtgggaggacaggtggctggcgtggcagaggcgacctgagtcccaagagacagtgtcaactgaggtgacaccctcctcggccagacgggcctccagagcggcgtagcggcgggcaagggagcggtaagcctcaaggagtaggtcgtgctgagtggcctgagcctccgaaagctcaaccatgtgagtcagtactggctgagactcgctgtacggacaagggtacctggcgtctgagtggccagaaggaaggcgtggaagctgccggaaggcggagcctccgagacggtggctgtagtcgtgggccaggcgacaaagcgcagtccaggagaggtcctggtatgcgatctggagggtgggcctagccacagtgaagtggtgtgggcgaaggccagctccgtgtatacctccatgggggtaaaggtacacagagagctcacagtgagggggaacacggtccatagagtaccccgtgtactcgggacacgagaagccaaggaaacgggcgaggtcacgaagctgagcgacgtggtgaccctcaccaaaaccgtgggaactgaagctggcgttcactgccatctacaattttgaaagagggagaaggatcagtacccattttagaaacaacctattgaaaataaagaaaacaaaagatcccttagcttttcgcaagtagttttgactttagtatccttagggttcgtcttaagcgtcgggtttcgcctaagggccaagcttgggttttaatcccatctcttgtcacgccccgaattagtccggacgggaataagccggtgacgttccaaattaacttgttaatgaataccagtcccggaaccagtgttggatcccagggagccagaatatcacagcaccagaggtctctttattatagagtagatgtacagtcatgttgggctgcggacagatcccgagctcacaactgcattacaaaaggaaagcggaagccaggacttggactaatcaacacaggcgcgacttgggaactaggccgaaaccctaaaactcatcgtagccggctagctcctggaagaactcctcatcagcaggatccgcttcatctttttcagcaactggggggggaattatttatatagagcaagggtgagtacgggagtactcagcaagccatgggaaataagtgtttaatgcaggcttcaaggaaaggctggtgtttttgcaattaattttatttgaactcttttctgaaacaactaagtgagtgcttctcaaacgacacggatgagacagtgcgtctcgtccggtcggagtatgtgcaatgtatcagtctttagaatttaaacaagattggcacccggccaacagctttttcaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccacacgacattactaaccccgatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgtttcccggtctgcggttttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcgcaactggatggttacaaggggaaatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactacgggtcttcgggctccgaaactatacgcaaaagggacaactcaacaaacggcaaaaataaagccctattaatgacctctaagcgtgccattagatagatctcgagatttgagaaattttggaattcgaacggaatcaaacggatttacggttgggaagatattgaatttctaagattattggatttttggtctaaaggaaaaggatttaattaaatctctttttttttggaaaagaaaaaggaaagaaaaggggagagggagggaatatagacttccctagggcggctagggcgcggcctgagagaaagggcggctcggccgagcttaacgggccggccggcccaagaaggcggcctagagcggcccaagacgcgcgcgcgcgggagggaggagagagagagccggtggaccgggctcaccatgcgcggtcccgggtgggacccgcttgtcagcggctcggctcaccgtgcggagggagtacgcggctcatgcgcgcgggcgggggagggacgcggtgcacgcgcgcggttcgcggtggacgcggatgcggcgggcccacgcgcagcctcacggctcgcggtggaacgcgcgcacggggagggacagaccggggtcggctcgacccggtctaggctgagctggcgccgacgtggcgcctacgtggctgccacgcgggccggcgggaggtagacgacgacccggccgcgaatggacggcgggtggcggcgccgagtggcggagcgaaccacggcgatacggacaaaagcgagcacaccgggcggttgctcgtgatgaggggagacgagccaacggctcggatttgccggaggaagcttgacggcggcgaatcgcggcggcgacaaccggcggggagggaagagggaaacggcggcgaggccacgaggggtcgattcccggcggtgagagcatctacgcggtttcgggaactcgatgctagcgtcggattggacggagctacgccgagcgaggctggcgacgtgtgggtgctacggagctcgagcggcgacggcggcgagcacgcggcgagcgacggcaacggtcggggcgacgccggctaactacggggagtctacttgagctactaccgaaagctagggggaagagatggagcgaggcggaagaacggagggaggcatcaccgagatgaggaggggcgctgtgacgagaggccgacggcgcgggagtaatctctccggcctcgggccggggaagaggaaggagagggcgcggccgaagtccccttccgcgtccttgctcgtgccgactccttcgacacgcgcaacaacgaacggcgacggcgaacagagcacgggggcggcagctatggcgaggaggcgaaaacgagggagattggaggggaaggagctggggtttaaagggggcggcaatgtcggtttgggaaccgacttagggcggtcaaggcgcgagctggcgctcggcggtcgcggccaaagcggcgacagggaggatgacgctggcgggggaaaaggggaaaaaggagggggagaaaggggcttgcccttttgccgatccgggaaaaaggaggaggggagcgggggcgacgcggcaaagggaggaggggcgctgcctccgtcccttggcggcttgcgcgcggagtggcgggggccgggcggtgatgacggcgatgacggcgggcggtttggagcggcgcgacgacacgggcgacagacgcgtgcagaggctgacggcggcggcgaccgggcggtcggccactcggcatgcgcgcgcggcttgcaacgggtggcgtccgcgcgggcgtgcgcacgcgaacacggcgcgcgggaagtagcagcgagggagcggagagggaggacttggctcggcgcgggcggcttacgcaggcgcggcagagcgaggagaggggaagggggcgctcggcgcggcggctcacgcgcaagcgcgcgggcggagcggaggaggaggagcactcggcgcggctcttcgcgcacgcgcgcgcggcgcgcgggcgaagcggagcggagctgagtgggggggggagagagcggagcgcgccggggaggggagagggccgggggagagaagagagagagagagagcgcccgggagagggggagagggagcgcgccgggagggagagggccgggggaga

SEQ ID NO: 16621 - DNA, 16178 bp, Oryza sativa
cccccaggggtcgatgggccgggaggaaatcggcccatcgacccccgggggaggcaaaatagacttttgcggaggaatttgatttggaaggattggattcgaaattggactcgacgatagatcggggattgagatcttgagatggcacggacactagacaacaagcaaagaaataaatttcgcaattagggtttttaagagataattttcccgctaggcgccacgacggaacgggcgctacacggttggtacctggtacctggtacctttggtaccgactaggtatcgatcgatgcctgatgcctagtacccaagatactgggtggtacctagatatcagaccttggtacaaggtatcaagcatgatacttgtggggtatcagagggtaccgtaaaaaagagagggaaacgtgagggagggagcgctgcaacggcggaggatggcgtcgaggaggcacggcgaggtgagggacgtgtgctcccctagtacctggtaccttaggtaccgattggtacctagtacctggtacctttggtaccgattaggtatcgaccgatacctgatgcctggtacctaaggtaccaggtggtacctaggtatcaaaccttggtaccaaggtatcaagcctgatacttgtggagtatcggagggtactgtcaaaaagaggaggagatgtgggggagggagggctgcaacggtggaggatggcgtcgaggaggcacggcgaggtgagggtcgaggcccgagccagagagcgcgagaagtctcgaggaggagccgaggaggaggttgacggctatacctgctgcaggttgacacaggctgccggcgtccatcccggaggcgcaaagtggcaggccgcagcggggacgacggtgacgccgaggccgagggcgaggatgaggggagctcccgcttctgccctccctggggcgacgactccccggcgcacacccgaccgacgagggagtcaagtaacccatgcatatgaatctgatgggtaccagtcaagtattaagattttataatccaacccaattaacagtagctcaacttgtacatatacatacgtatcatcatggagtaccatgaaataactcttaagtatcgataatgttgtattattcagctaacaagttgtagtagtagctatagctatttccaacaaatccagaaccatttatagctatcacatacgtaccggtgacacgtaactgtgcttttgcacagcccaaatccaacagatggccaaaccatgctatgataccttgctaggtaacctcatgctggtgcggagagcagagctgcggtctgcagagcgtgaagagaaactttgtggacggcgtcggagagcacaactgcttcggttagttgcagcgagtcaccgccggcgaggtatcaagtaccttcctgcggggggagctaggggtggggagagcaagctgcttcgggccagatgctgccgcaaggactcgtcgccggtgaggtcgcgcgctccgcgcgcgatacagagctcgatcttgccggcgccgacgaggtatcgcgataccgaggaggaagatcttggacggagtgggaaatcagcaccttgtgaagagagacattaatctctggctcatttaatctatcccgtgacatctatatccaacggaatcccgtgcgctagctgtctaattcccggacgtgcacggcagcatcccaagacctaatataacaccggcagtgcatcgatgtacctcttgtgttcggttgctccctccatctgtatactgtgcgtcgaccatgctagggctgatggatggtagagaacagcaagtatgccctgtgtagattccgagtagaggggttctcattcccggtgtcttccatgcccatgatctagaaagttaggctgtgcttgcgtgtttaatttggtgctctgccttgctctctttcgcctgtgaatgtgactactctctgatcttccttctgcttagagcaagtttaaaagtatagccaactactagctccaattcatctatagccaatctaatagctcattcatacaatagttacatactacattattaatacctggtcccacctgtcatacacacatagtgtcttggagtccgtgctgcagctggctacaaatctgtagcccgctgcccttctctctttttatttatctccttaaaatatgtttgcagctgacttatagcctgctattgtacctgctcttatctcacagactctctttggttcgtgctctgatttctttcgttccatgtttttcttctgctgtgtccttcttaaagccatgttagcctggttgtgtcagcattcactagtaatagcttgctctaattatcagtggcatttcatcacattgatggtttgattaaaggccactaatttcggtttggaaccaacataattagatcaattttcagttactgacgacgcatatatcatactcccccgtttcagattataagacgttttgattttggtcaaagtcaaactattttaactggtcaaagtcaaactgttttaactttcactatgctttggacattaacaaatattttcatccaaacacgtaaatcagcttgagggtttttgaagggataaaaaactacaatgcttttccgtgcttattttagtaactttggaattattcctggtaccctgacattaagaaggtacggactatggagaggcaccaacaattacaccagaaaaacttgatacattctcgatgaaaagaaaccttcgtatacactcaaataatttgacaaaggctgctgctgtgctgcaaactgttgattacagtgatactcaaaataagtcgccttcgtacaattaaaatgacctgttttgataccctgcggagctttcagctgatgaggatggcagcacggactgctaagaagccttggatatcctggatcggtccaaaaatttccaaaattttgaacaaaatttagttgaattttaacaaatattactaaaattcacgaaaaaaattaaaaaattccgaccgaaataatatcgtaccggaggggtccaaaatgaccgaaatttcaaaaatttcgttcctgaatttccaaccctggatatccagcatgctgtagagatcacttgtcaagtgcttaggctctcgttggtttgcaaggcaaagacaaaatgtactgatttagcttgtcttgtatgtagaaagatatactctgaatcaatgaacaagcaaccccgacactaactatttcccgagtactctcaatcccacagtccaaatccccatcaattaaaaagaacccagccaatgattttccagaaaataaaataagttccaacttcggtcttagctagagattctatatgattagcagaacgacaacaaatgaaaaatgtgttttttttttgcccgtggaccttttctaaaattgcagcgatcgaaccacgaacgtcggtatgtatgggatgtgcaaattctagttaggggttaaatgcaactcaaacttaagaatgttgtgctgtagatgcgttgaggtgtgagttgactactgtcaactcaagaccaattgtggggcatgaactcctggtgtttcccaaacccaccgactatttatactcatctgatcggggaataggcaaaccgaagacatcgtatatatatgtttccctacatcacctagagaaatcgtatgttctgctatctgagactgagacaactcgaggttgtataacaatgtcagctatatacagctcctttcatggggtctgattggttatctcaagctctcccacgctgtagtatactgctatttatcatcgcagatttataggccttataattgttgatatgtgccatttcactcctcacatgacataaattgtatttgtacccatttgccttcaatttactcatatttgtcaggggttggtgcatagtgtgctactcggtgctattggtacacaaaagattttcctaaacaaggagctcccattttcccagacgaaccgttttcgtgtgcgtctgcaaaaattggcctcctattttcgcgtgcggacctttaagaggcccgtacgcaaaaattgattttcgcatgcgggactcttaacggtccgcgcacaaaaataagcctcacgtgcgggcctcttaagtggaccgcacacaaaaatacctcttcctcttttccctctcactcacttcaaaattttcatcttctctctttcttttcccttttattctccctcaatcactcctccctctctctccctttcctctcctctcctctagctcctccccttcccaccgagcgcacaggacgcggcaggcgcccggctcgccaccgctgccaccgacgaggcgatggccgggagcgagcggatactggcggaggcggcgcggcgggcgactggccggatccacgtcgcgccgacaacgaggaggaggaggagcccgggagtggtgatggcggccagttgcgacggaggcgggctcaggagcagcggctgtcgagataggcgggctcgggagcggcggtggtggccgggagcggcgggctcagaagcggcggtggcggcgcgaccaaggcgacaacacgaggacattggcgaccacgagcagcggcgtcgggcgattctagggttagggttagggttttcgattttttttcattttttttgtgtgaggacggtataatttgaccgcacaggataattgattatcccatgcggtgtgcggtccccttaatcggaccgcatgggaagatgaattatcccgtgcggttggccacccgcacgcgaaaatatggattttcgttgacacatgggtgcagatggaccggacctctgcacggaaaaatgcattttgaccgtttggaaaaatcttgtgtgtactagtgtgctctcaccttctgctagttcacaacccattctatactatgtaatccatattttgctgtcattaaggacaagagtttttctctccaccgagtgattagtgaaagtgtgaaacagctagctagttgaaagattattcatataccctgcccgctcgcttagaacacgtgccattgacgcacacactcctgaatgcatggctggctgcacgcagtgatcgcaggaagaagaaggaccgattcgattcttggcacgttgcgtgtgccggctagctaggtacgttaatgttcagcagcctctcgacccgacacagcttttcactagatttcacccctgtcgatcgatcgcatatatgctcccacccctcagcgcgcacagcattgtttctcttgcgagcaaagtattttaaggtctttccatgcaaaaacttttcaccccgtcacatcgaatgtttggatatgattatagtattaaatataaaaaaaattaattatacatattgcgtgtaaattacgaaacaaatcttttaagtccagttgctacatgatttgataatgtggtactaaacatttgctaataatgactggattaattaagcttaataaattcatctcagaatttacatgcaaaatatataatttattttattattagtctatatttaatacatttaaaatgtgtgtccgtatatccgatgtgacatgaaaaactttcaacccctgatcttaaacaccgcctaatttcttcaccaccctgtcctgacaagctctccggtacgcatgcatacgatacgatcgagccgcctacaaatactgcgctctgcatgcattggcaagacactactgcaagagagatggagcactactcgagaggcggcggcggcggcgaggggaggtgggtagtgatgcgggacatcgtcatcaacaacaagacggtgtgcacgacgccggggccgatgctggtggcgacgttcgcggtgtcgcccgacctgcgcacgacggagaagttcatggtgacgacgacggtgctcatgaccttcctcggcgcggcgctgttcgccgtcggcgtcctcggccgcttctccggcaggcacaggggccactcgtcggcgacgcgcatcttcttcagggcctccttcgcgctcttcctccccttcatgtccttcatgttctcccaggccaagggcagggacctccccttccgcgcctacctcatcctcctctggatgctcctcgtcgagctcctccgcaagaaggtcttcgccatggtcgcccccgccggcgacgccttctcccgcggcgtcggcaggtacagcctcttcgacgccgtcgaggacgccgcccgcatgatctggatcggctacctcgtctactcctacgtacacggcttcgccgtcaagtccctgttcgtcatcctctggatcttcagcgtcgccaagctctgcaagcgcgccgcctgcatccacctcgccaagggctccttcgacctcgccaagaacgccacgctcgtctccggctacatggcgcagctcgtcggggagcaccgccagctggacctgcaggttgtcgacgacggaggcgacgtccgcggcaaccgcaccatgagagcatgcaactacacggtgatgggtgagagcgagctcaagatcaaccggacgccgcacggcttcgagatcgacggcctcgaggacatcctcgccgccggcgggacgagcggcgatggcgatggcaatggcaagacggaggagcagctggtccgagtgagcaccatctggaagctcgccgagagcgacccgctgttcaagtacaacgtgcggaggaggcagaagctggaggacatctgcctgggcatagcgctctacaagctgctccggcggaggatagagcggtgccacatggcggagagaggcacaccggaggcgcgggcgttcgtcctcaggggcctcctcgccctcggcggcggcgaccggggcggcgaggccgccgacgccgagagggcgttcgacgtggtggagatggagctgaggttcttggtggagtactaccaggcgatcatcccgctggcgctgccgaagccggggatcttcatcgccaacttcgccttctccgtcgtcttcatcctcctctactgcatcgccgtgctgctcgtcaccggcaacggcaacatgttcagggtgctgggctccctgttccggggattcatcggcatctccatcgacacggtggtgcagttcaggtgcttccgccaccaggtgtcggcgctcgtcggcatggtgtgctcctcctccgacctcatcgtcaccttcctcctcacgctcaccctcttctccgtcgagacctacgagctcgcgctgtacctgctctccgactggttcgccgcctccatgctctgcaactacgcccggatgcggatcaaccgcgaccaccagcgcaggcaggcggcgcagcagcgccacgcccagcgcgccatccggagcggcctctgggtgaggcaccggtcgcgccccgtcatcaaggcgcaccaggtcaccatgctcaagctccaccagctgcacccgcgccgcgtgtggatgctcgcgtcgcgcatcctctcgcgccgcctcgccggcctccgccccgccgtcgtcaccgccgaggccaaggtggccatcgtcgcggccctcaaggccttcctcgagagcgacggcggcgacggcggcgacctccagttcaccagctgcgtggccgtcctgcgcaggcacgggttcttccaccacgggcccgagtgggcgtgcgacagcagcaagggcgccgccacggtgatcctggcgtggcacctcgccacggcgctgctcgaggcccgctgcgacggcgagccgctgccgcgcaagggcgaggcggcggtgacgctgtcgaggtactgcgcctacctggtatcctacgagcccgggctgcttcccgacgacccggagtggacggagaaggcgtacaacgacgtgaagtcgggcctcggcagcttcttccgtagctgcagctgcgccaccgcgggccggcgggagaagctggtgcggttcggcgacgactgggaggcggaggcgccgtccgccatggccaggggggtcaagctcgggaagctgctcgaggaccgcgcctccgagtcgaccgagggcttcgaggaggtgtggacgatgcttctcgagttctgggcggcgttgctcgtcgtcgtcgcgcagaggccgtcggcgggtccggaggggcacgcgctggcgctggccaacggcggcgagttcatcacccacatctgggcaatgatcacgcacgccggcgtgcgtgtgcacaggcaccacgactatcagagctttcctgtcactcatgtggtatagataaccacgcttaattaagctcacaataatggagtagtagctcaattagagttgcttgacttctaatatagtactccctccatctagttttaataggcattgtttacacccaaatttgacacctatggacgaaataggggaaaattgtcaaagtttggaaagtaccgggtttccttcgcagggccggtcagaccgcaggtatatgggcggtctgaccggctagtagggccggtctgaccgcaggtatgtgggcggtcagactgtcagggtccgagtccgagtctgttttcgtcgggtctcgggtttccttgcttgggaaggcatgtttcgtgtttctattggtttctatcccgagttggatgtggagaagggcttgtaaagggcaagaccaaccctcatttaagggaaaaggccggtttattgtaaaacccctaatacaatttacttgaatcgttcttttactatgtttttctattttaccctagtttagtccatctttatcggtttgcgccgtaaaccgtctgccgccgctgcgagagtgcgacacctctttgtaggtttgtcctgaaaaccttccattttgcccacgagacgggtagttatcctcatatcgatctaaatcggcctagaggctgattttgatctctaaatcggctccactagccggtttagctgtttttcctcaaaacccatcttgatttggccgtttagctagattgaggtggttagcgactccataccaccgcaaggcgtttaggtgttgcgatcatgcttgtcgacttgtcaaaaaagttggcaacacgatttttagcgactccgctggggaacgatctaatcggccatatcacggccgaatttcgtttaatctagtcgtctcgtcgaatagtttgtttcggccaaacggccgaaattaatctataccttaattagtcgctgcactgttcttatcgctggattaatctattcggcggcgaagctatttggtcgttcatcaaattcatataagcacttgccatgtcgtgtgtatcgaaaatcattatcaggaagcagcagacggcttggcaacgtttcctttttgtttcacacggcaacagagaaaaagatcaggctcctagagccgatctaccgggtcacaagcagcagaagcaacatcaatctgttagtacatacattagcacatctactgaggagaattaaaaaaaaatcaaagccgattcatattgtttcggctgttattgtgagatcgattttctgaatttttgcttacacacgaggagacagaagcaattctgttttacttgcacacacgcttgttatattcaaaggaaaaatcaagaccggatattaatttattcggtcaaatatttcggctatgagctatatggctggaattaatcaaggaatttcttcatcaaccatgatgagcgggaacgagatcatgccgatctcattggatgatttcgaaggagaagaccgcaagtccatgtaggagtatatcaaggagatcacacaggaggcgttgataagggcgtgcactaggactcgtcaaggtgtgatcattaagcccgggccacttcctaagctcgctcccgatttggtacgcaatggagaggtaacacaatctatccaacaacaagtagcatctacaatagattcatccatgattgtttttaaagatagattagatgcaacttttggaggtaaatttgatgagattttaagatttaaagttggccctctcttggccgattttatttgtaaagataaagcctctaccactgctagccaagctcctatagatcaaacaagcagtggaaccgatggagcggcgcatatagacggtccgaccaggcctgatggccggtcagaccgcgacttcgccgtcggtccaaccggccaaacggccggtctgaccgggtattaccccggcagtcagatcgggactcaggccggtccgaccgcgcctctggatgtcggtcagaccaggctctggaccggtcagaccggcgcaatcataccgattcaggggatagatccaatgaccaatgctagttatttgtatcatcttagaacatttgatcctcctgtatctactgctgcaactaatccccaagttcccccacatgtttctaatgcttataatgatgttgctaggggtatcctcccgatactaggcaaggccaatataaccatattgcgccgcaaacacaacctattaggccaccaaatccaccaccaaatcaacataggcctgataatatggaggaaataattagtgggattattagggataaattcgggattaaaactaggaatcgtgctaaggtttaccaaaggccgtatcctgattattatgataatgtactatatcctcgtggttacagaattcccgaatttaccaaatttagtggtgaggatagtaggaccacatgggagcttgtaggtcaatttttagcgcaatgtggtgaggctaatagtgatacttttaaattgcgcttgttttctttatctttgtccggtactgcttttatatggtttacttctttactggcaaattctattagtacttgggctcaattagaacaaaaatttcatgattatttttacactaatgaagctgagtttaagttgtctgatttaacatcggttaggcataaatacaatgaatctgttgctgattatattaaaaggtttagagatattaaaatccgatgttttagtttgaaaataactgataaagatttggccaacattgcatatgatggattgcttgattctaataaagagaaattgaatggccaaatatttcttgatgttgatcatgtgttgcatgaagctctggctcaggaaagccgagtggatgacaatagcttaaatgctagtttagatgatagtgcaatatcatgtatagccgaaccaagcgatgattcggattgtgttaataatttgtgcaatgatgccataacgattatagccgaaccaagtgttggttcggattgtcttactagcttggatgattatgcaataaccattatagccgaaccaagtgttggttcggattgtgttactagtttagacaatgatggaatagccgaaccaagtggtggttcggattgtgttgctagcttggacaatagcatcattgaagatatagccgaactaaatgacggttcggattgcatcacaagtgaaagtgaaatagcattatcacctaagaccgaatcacaaatcagtcatgtggatgttggaaaagatgatgataatgtcttgcgggatagtagtgaaataaaatccaatgtagctatgcatacatatcaaatgccgtatcctgagcacgtagattcgatctcatatccgcaaggatttgaggtgcccaacttcacgaaattcatatgtgaggatgctagaacaacaatggagcatatcggccaatttattgatcaatgtggtaaggccagtaatgatgatttgcttaagttaaaattgtttcctctttcgttgtcaaactttgcatctacatggtatagtttacttgctcctaattcaatttctacatggtcacaaatggagcatgagtttcatggttatttcaaagatgcaagcttgatggagcaaagaccgattgatacttcatcggtcacttgtgaaactatttcggttacatctatgcctaagaccggaatcgttagtgatcatctccctgttagttctattgatgttggcaaaaagaaagggaaatgtgttattattggggatcctcggcccaagaataggacaaaaaatgcgaaggccgaagatcataaagttacaaaagatgactcatctagttcccaaaagactaaaaagccgaaactcacttttgagatgcttatggctaagtacaagaaaggattagccggtcaacgttttgataaccaaactagtgattcgaaaagaccaagatcatctcgtaggaagagatttggtcaaacatcaaagcaatcggagccatcaactataccaactccatataaacctccggttgtgatgccatggtatccatatccaatgtcactatatggttatccttttatgtattatatgccatggatgcctcaaccacctatgccgtgtcatcaaggatggaagcaatcacctaggacggtaccaactcattttaactcaagacaagaccgtttcccacgaaaagaatcggtccggtggatcaaaggtgtcacgtcctgataaattcatcccgaaataaaatttattttctaaaagaaataatagaattaattaaaattcgaaaagaaattggcaaacactaaaatacatacaagaaaaattcgaatgtggcccggagaatttttgttaaattctccttggtctaaaatgagccctcaaattttacttgaattttcagagcaccggaaatatttattaagcaacaaaaacaattatcaaagtttactaaaaagaaaaactaaaaataaatcctccttcctcctttgggccgagcccagcccaaagtccttccctcctccctctctttttccttccccctctctcccttgggccgccctccctccttccccggcccactccctcctcctccctctctccccgggccacctctccctcctctcctcctgggccggccgcccggcccaagcctcgtctccacgccgtcctcgtctccgtgcagccgctaccggctgccctcgtcgcctcctcgcccgccccggtcgtcgtcgtcgtcgtcctctcgtcgttcccggttgtcgtggcgttcgtccctccgtcgagccgttctcgtccgtcgtccgtgtccgtcaagcgagccgcggcagccccgtcgtcgtcttcgtcctcggctccgcgtcgtcaagcctcgtgccggccgcgtctcgacttcgtccaaggatcgccgccgaagtcgttccctcgccgttcgcctccgtcgtccccgagccgtctccgccgcgctcgttcgtcgttgtcgttcccacgcctcgtcgcgtggtggtaaggatctctcctttcgctgccccgtcctcgtcctttcggtgtcgcccgtgcccgttgtgcggttgtcgaccccggtacccgcgtaccggtgtcggtagtcgttcacgtgtgcgggtggtgaccgtgtagtgtccgtgttagtgtgcccgctcggtagccgcgtggtttccacgtgtgcagcccgtgtggtgtctagtggagtccgtttgtcggccactcgcctcggttgacacacggggtccgcttccgtcgacccgtggaccgtctctgtgtactcggtctaccgcggtcctttaggttgacatgtggggtccgcatgtcaacggcgcagccttcctgtcttttccaggctagcgcttacacatgttttatagttgcaaaacctaattataataatccgcaaatctccatataacagcattaaacttcggatgatcatatcttgatcatacgaacctcgaatcgacccgttcaagtctcctaatgtttgttataacctaaagaaccctgtgctttctttttatgtattgttattgcttctttataggcttgtagctttgcttgtgtgcttcgcgtagcttctgtcgttccggaggttcccgaagcgtggttcgcggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgacattattattgctattgttattattaccttgttcaccctagaataaataaaaccccaactaatgggtactctattcatggttccactaatatgaatttaggtagatgcttcgttgattaattaggcaacattatgtggttttataactctagacattaggtaaggcttagtttgtggctcagtctggttataaacaaaagtacacggatggagatggacgaagtcgggggccgaaggacatctctaggacaaatgaaggctacacgagctgcggcccggtagtcgagatgtcatggcacagggctggtgtcctgctgccaggggctcagtcctgcctacctgtcccggaggttccggccgtaggtggggttgggtcggtactcttgtctatggctaggatgggttgggaactatgtcacgtctttcgtccgtatgccgtggtggtatgtggcacgtggttacacgtgaggaagatgtgtcttgtgggtaaagatgtacacatctgatcagagtataatctattcgaatagccgcgccctcggttatgggcaagcctagcaatatacccaacttagtgttttaaattcttaaaacctgcttaataactaaaatgtggaatggttggcctgggttggcttgggacgagctgggacccagggtcgggttgccagttcggtctgaatcatcgtaggccttgggttaaggcaggttcgtgtgggtccacggccttgattaataatattgtatagctctaggatcgtgtttacaaaatagctttgggcaactaagtgacttttaaatgctgtttactgcaaaacttaacccctatattattaccccttgtactcccttgcattaatcatgcatctcccggtgtgacttgctgagtacggtggttgtactcattcttactcaatctttccccccttcagtaagagaagctttggagaagaagtcttaggtggagtcctggcttatatcccagttgagcgcctgtgaagatggagccgtaggcccgctagtccgctgctgtttatttttgattgtcaggcctaaagtgcctttgtaataatgtaaatataatcgatataataaagatgtgccttttgtatcatgtttgtttggtgtaccccggcttttcctgggacggggattaatacagtagcgttcgggaaaaggtaattttctcggtcgcgacaaaaggtgaaaaaggtgaagaaggtgtgggtgagaaaagaagccaaagctccggaggtcgttgttgtcaaggaggagtctcaagatgttcatgtacctactggagatgccgtggaaaccatgcaagcaaaggacatcgaagctgacgccataactgtcaacattggcggtctaaccgagacagctggccgatctaaccgcctgtctacagccagtctgaccgaccctcctggccggtctgaccgacggcttgcaaccggtttgaccgggcccagaggccgatcagaccaaggggcattaaaggtgagcgggaaaatcgagagcaacacaggagcttctatttcgaccaaaaatattaagaatcattatttagctcctggaaaacaaccacagccgaagtggataccttctggcttatctcgctctcaaaagaagaggctacaacgtcttcgggccataggtaaaaaagaaaaagaggccgaagatgtggagaacaaaacatgtaataatttagagcctcgaatgacacctaagcgagtgtgtaggcctaaagaagtaaaagttaaaagatcggtgctttcacagagtagtgatggattcaatttggtgagagaagaatcatcggtcattaaagataagtctccttcacatgatgctatgggtgttagtgcggtattcatcttgccttcgaaatcgtgcaatcaagaaagccgattttgcttggggggcaagacattaatatgctcatgagggaaccaagagaagaagaatggcaatggatacaacatcacatcttcgagccgccgttcgttggatgctaaggcaaggtatgggtttatggtgttcatcgttatattatatgcctatgtcatgttagaacattgcttgctatctagcacatgtgtgtttttgcttatcaaattgatattat

SEQ ID NO: 16622 - DNA, 1528 bp, Oryza sativa
ccctgtaactttgccccaactgttgtgactagctgtgggatcggtggatactcccatctcccattatatccttgtaacttgttgcatctatgtattggttgcctttaaggccattggtccaggcattgctctatttttttagttcaatttactagctagtagtttggaggaaataatttactaccgacttattagcgctgtctcaaaatgctaaatgctcataactcgactttagagagatcacgtagcgtgttctaacaaaatatacaagagatacttcttttgaagaaaaatatatatgtataagaggtcccatgatgatgtcgtatttcagtcccatggaaagatggacattaagttttgccctcagtgagaaacagttcaaaataataccatcgtatagtacaagccaattgtctaaaaaaaagcttttcgtaaatccaacttcgttagccctgtcccaattaaatgccctcagattgctcgctctgcagctggaagatcctcctcctttcacggtagccaccaccggatgctgtgcgagaaatggcatctcaatggaacctctgtatctcgggccaaacatccaacagcacgcacaaaccttcatcattaaacgggtttcagtctatctccaaacaagctcttcattgcacgtaggaaatgccaatgacatgagcgacaaaatcaaaccatacaatcgtaggatcaatcaagcaaagagtactctgtacagtttgcaagggtgaatgtgcatccaatacgcggtggtcgcgaggtgagatcagcatcaaggcgcacaaccaatcggtggatgtgagctcacctcacccagactgaacctgataggtggtggctcagcagccgcaggcgttggaagggcggcgagcgcgcacccaagaatcggtcatgagctcaccggatccagactggatctgacgggcggcggccgtggacatgccctacaacgtgtaaaaccacagggaagctctctgcatccattttgacatgctgcatttgtacttgacagatgcccggtccctcgtcagtctcagcggcgctccaagaagctgatagatgtattcctgtgaccttccattcccaacatcaggaaatgcatgtggctccgggcctcagaagcagattaatttggtgggtgtgtactactctttggtccctggctttgtgcttgctcacaacccttttgtgttttcttgatccatatatatttggtactggcgttttaaatatgaaacttttaagacaagctaggttgactatatatccaccgagtgatcacctaagatgtatatgtggtaacggctgaatattaaataacttactccacctaactttggctgtgttctacccccattttccccaggccgccacctctctcttttccgtgcgcacactttttaaactaccaaacggtgttatttatgcaaaaattttctatacgaaagttgttttaaaaaatcatattaatccatttttcaaaaaaatagttaatacttaattaatcatg

SEQ ID NO: 16623 - DNA, 1380 bp, Oryza sativa
atatcctttcgtttccttaggatacccacaaagaagcatttatctgatttaggtgtgagtttgtctgattgcaaacgttttacatagacctcacagccccaaatctttaggaaagacaaaatgggacgcttccctgtccatatctcatatgttgtcttatccactgattttgatggaaccctatttagtgtgaacgcagctgtctctagagcgtaaccccaaaagcttagcggcagatcagtttggctcatcattaatcgcaccatgtccaacaatgtacgattcctccgttcagacaccccattccactgaggcgttcctggcggagtgagttgtggaacaattccacactcctttagatgattgccaaattcaaggctcaagtactctccaccacgatcagatcgtagatacttgattgtcttgcccaaatgattttgtatctcattttgaaattccttgaacttttcaaaggactcagacttatgcctcatcaagtagacataaccatatctactaaagtcatcggtaaaggtaataaagtacccaaaaccacctctggcagttgagctcattggtccacatacatcagtatgtacttggtcccaatagttcacttgccctttcactttgacccgtgaaaggtgcctttgtaattttgccaagttaacaagattcacatgtctcaaatgattcaaaatcaaacgagtgtagaagtccattttaatgagcttctccatgcgtttctcatttatatgacccaagcgacaatgccaaataaaagtgggattcaaatcattaggacgttgccattttgcattaatgttatagactgaacatccatcaagattcacaatgtataagccattcatcatgggtgcatggaaatagaaaatgtcattataatagactgaacaaccattgtccatagatctaaaaccataaccctctgcttgcaaacaagaagcagagataacgttcttacacaaagctggaatgcaataacaattatttaactccaaaactaatcctaacggtaaagataatggcatagtgtcgaccgcaacagcagcaactcttgctccattgcccacgcgaatgtccacttcgcctcttgctaagctcctacttcttttcagcccctacaacgatttgcatatatgagcaactgacccggtatcaaatacccaagaatcagtagaggaagtagcaagattaatttctataacattaatacctgaggtggaactctttccatcctgctgcttctgcttgagctgctctaggtatttcttacagtttctcttccaatgacctgtctccttgcaaaagaaacactctgcatccttagcgggcactgtcttttgaaccttgggctta

SEQ ID NO: 16624 - DNA, 2549 bp, Oryza sativa
ttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggttggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgcactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatccttgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagtctaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatataagaacactacacaatcttatatgataagtctaattacaggtcgaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatatatatatatatatatatatatatatatatatattgcatttcacgttaacgttcgtcctcgttcgtttgctcgttcacgttcgttcgctcgttctcattcacgttcgttcgcttgttctcattcacgttcgttccctcgttctcgcttgtcttcgttcgatcgttctcgttctcgctcttgttcgttcgatagttctcgttctcgttcacgttctcgcggcaacgtacgttgacgtgttcgttctcgctctcgttcgttcgatcgttctcgttctcgttcgttaacggcggtgtggcggcatcggggcggc

SEQ ID NO: 16625 - DNA, 2595 bp, Oryza sativa
cccaaccgggagtaaagatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctccccactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcattccactgtcatcaatcattacgcctccaccagtcaacctaacccattggcaccggaacagaggaaccttgagaggaccatagtcaagttcccatatgtcctcgatggcaccgtaatacgtggcagttgttccatcatgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcgggaaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctcgacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtacttattattcgcttaatattcgtggagtatccagatggtacctttatgctctccaagcattcaaacatactttccttctctgccttgctaagagtgtagctggctggactcaagtaatggcttcctttctcctttggtttcgggtgaagatcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaa

SEQ ID NO: 16626 - DNA, 6709 bp, Oryza sativa
atgtgttgaggagttgaggctaaggcattctttgttctgttttattttttctctttctatttaaacaatctacagttacatgtaatctgacagagtaactagctacaaactaccattttttatgtcaagaaaagctatgcacgttgcatttttttcgtgttttataatttctttaatcagaaaagttattatcgttcatccgatgaacacacttcctctctacaagggaaaaaaaaagataaacacaaatgtaatactactgcctacacttagactgcgttcgttcgggtaacattgagggagataacagctcgttttccacgcgcacgctttccaaactactaaacggtgtgttttttgtaaaaatttcctatagaaaagttgctttaaaaaatcatattaatccatttttaaaatttaaaataattaatactcaattaatcatgagctaatggctcacctcgttttacgtatcttcccaatctcctcgatcaccttctccttaaattcacccttattgtggcaaatagtttggccaaatgtagccacgactcatgtgtcaatatacgtacatggaaatttaagagacaacttttatttcaacatctccccctaaaaaaaagaatatgtgcgatccaaatacttggcatgacatgacattatgcaggcaatctatataggctataccagtaatattaagactgtgtgtttatttcacagaagagggaaactcggggagacaactttagaggataacacaacatggtggacgaaacagcgggcaattgatgcacgcccatctctgttggctttccagccaaaaagatctcgtatggcgcctgctttctgctctgtgtactgcatagcacccatgatagcgtactggatgaacacatccaggagtaatctgggagataggccacagctggatttccggtgccttccactcctatgtagtcaaattgtatatggaacaggtacatcctccattcaaaatgaatccatttctaagaatatatttggataatcgtttgtccgaatttcctatcagatgttggggtttttctatgattggaaggaggatatatatgagtatgttggttagtccttgttgctgcagactgtttactctttagctagctagctgctttggaacatttttctttttctgacgtttttatatagggttgcagcgtaaacatgttacacacaactgtctcgttagatttgcttgtcaactgaacacaaatgagattagcatatattcagcagttatctcccttgactaatttatattgacaaacatcaaaggggaaaaaataaatccttctacgtacattattatcttcacattatttcagtaagctgactttctccataagatacagctaattaacggtaggctaatacgcgcgcagcgcttgaaatagtagttcgagcgccacacctgatctcctattttcctcttttttttttcttcctcacccctttcgatttttccatgccacccacttctctatttttccgttcctactaacttcacgtctcatccctttcacttttcccttctttttccgttaccatccatctcattatctcaaggaataaattccattaccacccaccttttcatctcatatttcatatttagtaaatgagttactatgtattatgagcttcaaatccgtacactcagctatcttacaaataaacaaaaatggattaaacaaaatactggcttcaatagatagatcagtcttattaagcggagtaaataaaaattgctagcctaattttacgcatggcaagagatcagtcttataaacatatatagtaaataaattactaacactaaccgagagagacggatcttataaaagattggagagtaaataaattactaaaagaattatccatcgactccatcggtaaaagaattactcacccattggttgccagaccatagtagtaataatgtttgcagttgaaactttactcccatccagtaataataccgtagtaatacttttgctactggagtttcatatccggaatgacgatcaacatatttttaccacgtattgatacactaaatatcgatctatacatgtaaaagaattaccacgaataaaatatttacaacacgctcatttgacaaaaaaaaaagaagaaaaatgccagccgacgggtgaggatgtgaggacaacgaccacgatggctgcgaagtggcgatgattggacctcccgctatcccagcaagattgccacgaggattcagaaccaggaggtggtgacgaggagcgacgaagccggtgcacatctggagggagcacgaggagatcagagcacgtggactcgcagatacgtcgtcgatgacctcgactcgacctcccctttggtcgccctcatggtagaactgtccgcacggtccgccacctgctgcacgccgggatctgctctccctgtcgctggcgagaccgcgtcgtcgcgcgctctcgatgcagagctggagctcgtcgtcacccgcgccgccaccccggaggctggccaggattgcgccctcgacgagagagaggaagacgacatacgcgttgtcgccgccgccgccatcaactagcaggaacaactacataattacctatctaacactcgacctaatttgaaagtacatccaaagaaacggatgaagtacatccaacgaagacaaacgctaccagaaaagtgattttttttacgagacctcataaattttgcaaatggaccataactagtggcgtctgtaaaaatcgagggtcatttttcccatacggctgcttaagtggcccgtatgaaaaaatccaagccacttgagaagccatatgcgaaaataaaatttgaaaattttgaaaaattggaaactagtgtatctcactcatatgaactccaaattggatgattttctttctaaatgtttctaaaatcatgctctatcatattattgtgttcttattggtattattttggctattttttcttgtgactttattttatcaattaaaaatttgaattttaaaacttcaaataatattttgaagcaggaaatgattttatctaaaaaagtcatcaataacaaagttgtataactcatcaagatctataacttctattttggacatttcttcatccgacaaagtgatttgtaagattgttcacaaaatgtgatacagcatgatttgttattgatgactttgtaaatgatagagcatgatttgttattgatgactttgttattgataactttttcagatgaaatcatttagtatttgaaaatgttgtttgaagttgtcataatttgaaaatcatattcaaactgttcaaacaaagtcatatataaaaataactaatacaaaagttgtagatcttgataagttatacaacatttttttagacaatttttttcatttcaaatcatttactacccaaaaaattatttgaatttcttatattttaaaattcaaattttatatagtctaatcaaactcggatggcgaaatgaccaaaagaaaaatggtagatctcaatgagttgtacaactttgcttttgataactttttcgcatgagttcatttagcatcttaaaattcgactcaaagttcatttaataccaaattaatatttttaataattatttttgcatgcggtcctcttaaatagccacatgcaaaaatctattttcgcatgggacggttaggtggtccgcatgtaaaaatgcccgcatttttttagtcctcctctctctctttccctcctcaccatttcaaaatttttcaaccacccatttatttttctctttctttatctcctctctctccctctctctctctcctctcctctcctctctctttcttctcgccggcagcaggcatgggtgcaaggcgatggcgtcggcaggcggcgagggcagcggatctggcggcgccgtactcgggagggccggatccatcgctctagggaggagctcggcgctcgacggcgggcggcgtgcatggcgatggcctgcggcggcggatccggcggcgccgtcctcgggagggccagatccgccgccgtagggaggagctcggagctcagtggcgggcggcgggcacggcgacggacgacgccggcggatctgggagcggcggatccggcggcgccgtccacgggagggccggatccgctgccctacggtggagctcggtgctcggcggcggatctaggggcggcggtggcaacgacggtctcgagcggcgacggtctcggctggtggcggcggtggtctcgggcggctgccgacggcggcgacgggaatggaagcggcggctgcgacgagctctggcgggtggcggcgctaggtttttttttcgtttttttaatttttggaattttatttttttctctcgattttttctctttgcttaagcgtccgcatgcgaaaatccggattttcgcatgcaggtgccctggccgcatgcaaagatttgcattttcgcagacgatttggtccgtttgcaaaaatggtttttgtagtagtgaaagtctcaacattgataattacaaatttgttttctaatcagttcaaccgatttaaatatttcaactttcaaataacagagagatatatatctctttaaggattggagaaaatattgtgctcctaatttacataaaagggggcacaccattccacagagcactatctcgttaaaaaaaaacgaaccaaaacactcggcgcaacgagacacgagagccagtagagccaaggcagcatgcatgcaccaacatatttgtagatccgcaatgtcgcccactacatcgtgaactgctctgaatccgtggtaacacatgttctatgagcaccggaaaattcgagatacgcatccacaccaacacgcagtgaccaaagcagagtgaacgggatttctagtgccacccatgcctacatacgatagaattgggcatggaacatacgtcttggttcttatttgtatgagagaatgaggaggttatggattaactgaacttagagcaagcaaattttccttgtacatgaagggtctagattttgtgtgcgttccgctgctcggccttgtatgtgaaatatatactccctccgattttttttatggagtttcattcaattttaaactaaacgatcgacgtcatatattaaaggttttagtattagttggtttattaattctctccgtccatgcagctgtttggctactctccatcactccccagtgcgcatgcgcatactaattggcaccatttggcacaggtccatcaaatagagatgattaaaaactccagttagacaaggttacatgaaacgttttgatgcatatattcgtgatagttcagatctatacgtacggaaggtcttttttcccgtgttcgatcaccaccacataaaccatcagtgcaggttaattattaaaccgatattaaatatgtattcatatgagtatatttgcgcatattgtgaatgtttatgtttgtattgtgtttcttaataatgtattgctgcgagttattgtgtttactgatggtcaggtttttgtattttcttggggtcatattcttcataaaataattaaaattttaaagctgcatatacggatgtgatactcttctattccttcctgctcacggaaataatctcagcgcgcgggagaaagctattggcggtgtttcttctcttgagaaatcattcaaatttctgaacaattatgccggtcaggtactagtgaaaacgcatacttcatcgaaggaaataatagaccgtgcaatggatcaattccaactatgcatataatctaaattggacaaagatagacctccacagatgttcttgactttttttataatgaaaacggtttacattttcggtcttttgcctaaatatttttgacgtaaaacatgtacacaagcagacaagctgttgtcgtcaccaggaaagtgagcttgcaaaatgcagcgaccaagaccaaatcgaaccatagtgtagtcgtatactgatgcccctcatgtactattctgctgctatatgatcgttgttgcactactgaataaccgatctttgctgggtgatgtaaaaactacattagttccaatttgaatagaaatcgggactaaagattatttttagttccggttaaaaagtgcaacgggactttatgatctcatagtccaagttggtgttacatatggatctttagtaccggttatttcatcggggactaaagagagccatgtttagtccctgattcggggtcccgatttgtaacccggcaatgtagagggatgcaaaccaggactatatagggttttctcagcagtgttggataggtcgcaagagaagaggtcttcattcctgatgccttccatgcccataacctggaaaagaacatactggacgacggacacaaagatattttgttgtttttatgatccacatatgtattttaacgccctcaagttgatcacgagcttttctagtttgacattttttttctccagagtttctttttcaatcgagcataacgcagagcagtttaattctggcaaaagtataaaaacagaaggggctatccatatttataatgtagtgcatattacttgtgatcaaattttaaggatgtatttatactataattacattacaatatttattggcttgttggct

SEQ ID NO: 16627 - DNA, 3336 bp, Oryza sativa
ggttcatccaacactcgtccaactgaattagcaacagccaacaagcagccgattacaatttacagataggaatcatagttacaaattttcatatggcaatggtgttgctgctgctgtctagatcagtgaagtgaatcagtgatcgtcgcagtgattcagcaaatcagcaacaacaagacatcaatcaggcatcagtagaagtacaaaacaatgagcgacggcaacggcaagaaacctgcgcggctcggcggctgcgcctcggcacctcggcctcgcatgggcgtcgcgtggccgcggcggaagaggaagtgcgtgaaaacggccagcggacggcggcctcggacgagatggctgcggtgttgcgacggcgttggtgccagcggccgcgatctcgcgtgaggacgtgaggcgtgagcggcggttgggcgtgaatgtgatcgcgttgatggcgtcgggattctcgggaacctaccatccgcatacatctgtttctgttgggcgagagaggggtggcgggtggagaggggcccctacgagtcgggggcccagagcggccgcaccgctcacccccctccagggccggccctgattgacagcatacacaaaccatgcccgtcgtccaaacatgccagctcacatgaatccagctcgtacttaattaccacctctcatgctcagatctgctgattcccagcacaaatttacatgggtaagaagccgtgacatcaccatgttgatcaccccatctgcaaatttcgccgcgatcgtgaaattcatggatgcccacagaaacacccaaggccggaacaaattaagcaataggcagctgttgcatactgcccatctggtgttctgcggcctctccatccatctgtacactgggcatcgacacagcaacagctgatgtatgggacggaactatagcgttgtagtgaccatgtcgctgaaggaggggtgtttattcctagtgccttccatgcccatatgatctggaaacgaacacggtgtgctagacatatctgcatagtgtaggtgctctggtttgcactctttcaatattgtgacctcgactaccctctactcgacattctgctagctcttttgacatcaatatagtttacagtgcaaatatctcatcgttactttttaactatatatttctacaaattatttagaaaatacaacaatgtgaaagcatttttcatggccaactaagacggggagaactagcgaaatccctaactggcagccgcttgcgccccccccccccctcccggcggcgcaaccgtgtggagcatacgtagagggaaagggggatcccgtgcgcatctccttcccctttttcctttttttttctttttttgttttttcccttttttttcttgatttctttcctttctaatatgtatatatacaaagtttgtatacatatgtatacaaggtttctatatgtggttttttcccctttttcaatatgcacttatacaatacaaactttatacacgtgtatatattttttatacattaaagtgtacacgtgtgtatgtaatgtttgtatatgtacatgtaaattttgcatacgtacgtatacaaactttgtataggtgtatatattttgttttataaattaaaattgtatacacataaaaaactatacttatattgtatatgtattatgtatatactttatatacatacgtataaacttcatacataaatatataggtacgtagaggagagactagatcaggagggcgactgaccgcgtgggcgcacggctgatcgcccatcagcgcccccgagaaggagacgaggcagcgaggggtgacgggaaaaggaggtggtgccaacagcgcgagaatgagaggcgatgtcggtggcgcaccagagcatctggggtaaaatgaaaattgctaactttttctccaagagacatgaaaggactaaaaacaaatagaagattctcaatgggacaaaacgatatttcgccaactatacgatttaacagcctgaaactcgcggagtagaaatcagacggtatatatttcttcaacgacgtggcacatcctccttccagaaagcttgctttcacctatacagatatctactagcaccattctttcatattaattaaatcctaattgttgaaaatacaacaatatgtgtgtgagaggcagctgcggataacttgctctctttatcaacggcacttcattattgaatgtgaaaataaaccacaaataaactgtcgtcgcggttcggcagtgcgaaatcgtgacgaaatcgcaagacaaacgcgtgatactgatgaaagggtgatgacacgggtggtctcccaaggtgaaaatgcaagatcggcctcgggtgatacatgacgaagggtgatgacatggcggtctcacaaggtgaaaatgcatgttcggcctcggtgtcgctagttcgccgagcgacagggctattgagcctcggtctcgtttgatggccgagcgagatggccacaccggcagctaataacacaactaatcatactaattagtgatactaataacattaattaatacattgctaatgatgttaattaatttattaatagcgcgagtttgtgtggtctcacgggctcgcctcacgagaccgcggtatcgcgcactcgcctcccggtctttcacttcaattctgtgataatggtatatttatgtcatccccttctaaacgtgtatattcttataaaatcatcggaaacaaggtatattttcaattttttttctttcttcaatacgtaatgcggatgtgtggtgtaggagactaggagttcaaaccatgtataaagattaactttgaaccagtctccgcttcattccaagttttattgtgaatgttacaatcgagtgtccattaggaatcgacagcattcgcgttttcttttctcagctcataatctcactatggacagcgctgcccgaacaactcttggatgccatatgcatcgctggaatgccaatttggtcgcaatctaccggtttgtcgttgtgcacccagtttagctctttgttgaaccatgaaggtcgagtgactgcccactctgtggcgcgagcaactgagcacgacgctgtcctcggctctcacattggctgcaccgaccaacacagtgttctctcctctgcccttgctctaaaatcctgatacctccccgtctatggagcatgcatgcacatgattaatgcacacagatgtggacaacattttctggacggattctgaatttgccgcaactcgcctcggatcgatcgatgctcccaactcccatcatatcctccgaatttttagcttagtggttgc

SEQ ID NO: 16628 - DNA, 310 bp, Oryza sativa
ggaataccgaatctatgaacaatatactccaaaataaagtcaattacctccgcacaagtaatattctcgagcggcacggcttcggcccacttagtgaagtaatccattgctactagcacgaaccaatacccttttgataacgaaggataaatttgaccaatgaaatccaaagcccaatctcggaacggccatagtttaatgataggattcaacacagcggtacccgctaattgaacattgccgatccgttatcaagcttcattccctctatagcatttgaaacaatcatcaattattttcggccaatgaa

SEQ ID NO: 16629 - DNA, 2862 bp, Oryza sativa
gttgtgcctcggggtatattcatgtcggcgaggaccttgttaacactttcttccacctagcgttcatgctagcttctagttcttgaatgacctcaaccttaagttcggccttcaaacgagcgtccctctcttccttggggactttccgtttcctgtattgggagctgtaccgtgggagtccatgcttccagggcacatcgctaccaattcccctagtccggccaggatgttctttggttccgagtgccttggtgaggatgtcatcttcgcgcctcttcggcgcggactcaacctcgctttgtgaagcttgttcagcaaccaagcccaactagaaaaaaaacagttatttatacgaacttctactttatacgaatggaaattagttaggttaagtagtgaactcaccagttcctgatagacgacggcatcacttttgttctcaaatgtgacagagccgtccgggttgaccttacccctagcccgcgcccagttgcgagttctttgttcagggatgtctgaaaacgggacagggacattcgctgctgcagcggctgcatcttcttggacccatattgcctccttgccaatgtaccctgtggtgcccagccgatgtgggtgctcattccgctgttgcagtaggcgatgtgcctcgcttgattccctaaactcttgggtgttcttgagagaaaagaattcctcccacaccgcttcggttatttgagggtattcatcgaatggcatatgattgccgggcgggttgacaaactcggtgaagagcttcgacttccaattcttccaagctttgcccatcttctggaatgtcttccgcttgagcctatcctttgcttcagccggaaatgtgaaccatttctccattgccgtccaagctcgctctttctcggcttctgtgaccttgccgatatctttatggaggatcccgaagttctcacgtgccaccagcccgcagtagttagaccatcttccaatgacagtcctgggcaccgtgggcctaccactagcgtcaacctctcttataacttgcactgtggtcggccatatattttgtgaccggggatttctactcgacctacttgcacttgtcccgcccgacatcgatgtatgttgttcctgcggcaattttgcagcacaaacagaaggcaacatatgctaaggggtgctagctaaaatttatgtggtcatgtgatgaaaatttatcctataaattaccatgaatttcgggttgttcgaccaccgttgtcgagggatgaccttcggcaactgcctccgcggctgggtttgcttcttcctgtatcctcacaggtgttggggagggcgggtttgtgccgggcgttgtcatggtctaattttcgcgaaaaagcttataaatttcctactattatactaaatagcattagatccaatgtaatacggggtatactatgaaatatatggccttagttttgcttagaaattatgcatcaattaccatcatttgcatgaagggaaaaaaagaggaaatcataacatcaaaatctgttcttatgcataaaaaaaacaagtgtatatagtctcctcttatcaatctagaaaaaagaacaagtgtagaaaatctgttcttatgcataaaaaaagaacaattgtagatactttgttcttatctataaagaacaagtgtagaggtatataaccactgaatcaatcatgcaaatttaaaaaatagcagcagcaagggtacagatagaatgttattgacataaaacagtagcagcaggagtatatatgccacaggggcagcaacagcagggggaaattcacataaaacagcagggtgaacaagtagccacagtaagaccagtagcagggcaaagatagtccacaagggcagcaacaacaggggcaaattaactaaaacaacatgtctagatagtctcctcttatcaatccagaaaaaagaagaagtatagataaaaaaataaacaagtgtagttaatctattcttattgagcaattcatcactggccatttaacaaggaacacattgggcagcagcagcaggagcaaagatagtccacaggggtagcaacaacaggggcaaattaactaaaacaacatgtctagatagtctcctcatatcaatccagaaaaaagaacaagtatagataaaaaaaatgaacaagtgtagataatctgttcttattgagcaattcatcactggccatttaacaaggaacacagcagcaacagtagcaattgcagattaaaaaaaatgaacaagtagcccacaataacagcagtagcaggggtgtattaactggccatttatctagttaaaatcatgcaaaattcaaccaatgcaggaaaattaatcctaaaatcatctaatacaaaaagactaattcctctaatattgcatatatttcatccacaaatagtccaaattcatcatctcatatatttcacatctcaaatatgcatatatttcatcaaaaaaaagagacagtactactaacttcatctaaacagcaattcatccattcaattctagcaagtcatccatccaaactgcaattcatcaattcatcatctcactaggaggagggggcgtcgcacctggtcggcggtcgaggagaagaggtcggggaggcggcgtcttggcggccaatgttcgggtcgtggatcccggcgtcggggaggtcggggttggcggtggtcggcggtacagttgccggcgtcgtggatcccgacgtcgtcttgggaggtcggggacacggcgaggacgacggccttgatggtcggcggtgcaggccggtgtcgtggatcccggcgtcgggaaggtcggggtcggggtcggcggagagggcg

SEQ ID NO: 16630 - DNA, 1267 bp, Oryza sativa
cagttagagcccgtcacaggtgagtttgcctacagcaattttattttattttatttcacttagttcttttattttccttaacatatttccacatacactatatatttttgttatacttaattattttatttcactaacagtagtaattgcacttcattattttactaattctattattttatttccaatggttatactaatttaattattttatttcacttctagtgggtgcttaacttaattattttatttaactatttcatcagcaatatactattgattatttcgaacatattagagtcatacagataacagacatgtagacataaactacgtacataaattacaaaaataatccttcctcatggtcgacgcgtgcatattgaacgtcatcttcttcttcctcctcttctagaggtatttcttgacctatgccatggacgtgctggttgtaatcatcctcgtctataatattgtctaatccaacaattctccttttctcttcacgaacaacatgtagtttcttgttacacgagtcaactatgtagaacacttgaacaacttgtttggagagaacgaacggttcatccttgtacgcgttgttagccaagttaacagtggtgaaacctttcttgtcaacttttacattgcgaagatctacccatcgataacgaaacaacgggactttgaacttcaagtaatctagctccaatatttgctcaactctaccatagtattgatcacgacgaccaccgtcactagcagcctcgatgcgtaacccactgttctgcactatatatttgctgtcttgctttaccgtgtgaaaggtgtatccatttatgtcatatccttgccaggtggtggcactccattcaggaccctgtgacaaccactgaagtgtttcactagacaagttctgcaacctagcaattcggttcttcagccactcgttgaaagaagacatgtgcttatttctgacccaactctctgattggcctgggttctcctgtcggagaactgcaaggtgttcgtcaacgtacggcaccacctcagtcatatgctacagtaccatgaaatgagctttatcgtacaccttccgatccaacctaacagtctttcttccaatagtaccaacaccatcaagcctcccttcgtgatgagatagtggtaatccaattgaagatatttctgacatgtagtccacacaaaaatcgatgacctcttcggtggtgtaactctcgatgatactcccctcgggatgtgaacg

SEQ ID NO: 16631 - DNA, 1276 bp, Oryza sativa
gtagttcatcaagaaatgaacacctggtatgctatacacataatatgctactacaattaaaaacaaattattatgtgatctgatccaatttttctaaactgttaggctgagttggaaagcctcatggatgaacaacctgagctggatgaagatgatcaaggaagagttgcatggaaaggtgatgccttacatcaagttttaggtgaagagaaacctggacaagtgcatggtatgggactacttccagttcccaaccatgtttatggccaaacatcacaccatctcaggaacattaatatcactaccgtagagggtacaccacatgaagtagcgatacatattattgatgatgtggagaagttaaaggagcatgcacagaagcaagatcagcttattcaacaactgcttaaagaaaagactgataggaaaaacaaacaggaaaaggtgtccttgaaaaaaaaaaagctaagaaaggtacaaattttatctgaaccttcatacaaaaattagttctaaattgatatctttttcaggtcaatcgactaaaaggatatcatagcaactctcagctacaagcagtacattctaaaagaaaggtaattgttatagcttccaaccaataatgttattttggttgtattattcttacctttgtttaaatttagagagtccaatgcgacgcagctgatcgagaagacctcctgagtcagcaaagatatccattcaaggtaatatttgttactaaattgattcttgccccataattcatagtactcatatgtacgcacgtgcggaaacacaaccattaactctaattaaaaaatattgtgtctacatttaactaaagaatcatcaaattctgatcgactaacaggacatatatgaggacgatgacttgtcattctctactgaaaaggttagcaaagggcactacaattattttatagcaacaaaaagactataacaatatgataaatgatttttatgacaattctagtatcataatgatgcaaaccaggaagaaccccattatcaagaagcaccaccatcaccatggtccgctcattcctttcgacaagaagaggtaaatgttttcagatatagtgtgatatatatgcgtcaaataaaatattttgttgtcactctctagaagtaaggatacgacatgatgaaaccctagcaattgtcttggaactagttaattgccttattttgtctagggtgtttcagattaagcatttaaatacctgaaaaaatataacaaagctgcaggcat

SEQ ID NO: 16632 - DNA, 5025 bp, Oryza sativa
  unsure (1)..(5025): unsure at all n locations
atcgcagaaattatgactacagaatcaccaatgcaatggaagcttatttgagagataccttgcatatatgccctttgtactcttgtaacagttccccagtggacctaatcaatgcaacaaaagataaatggatcaatcaccaaaagaaacaatttaatgatgaaggtgcacttgcagtgggttagggccctccacatagcattttgtaaaaacaacacccacgaattctacaaaataacatggtcagagtcacaacatcccctgttcagtcagttttcataatggaaacatggtagagttttttttttcttttggtctgagtcagagttgaattttgtggcagcatgtaccacaagtccacggcattaaagttagtgatgcactctaaggacttgctaggaaataattaaaggatagaaaaaaccaccctttacaaccatagcctctcccttcaaaaaacaaaacaaccataacctcttacattccatattgtactataacagaagcaggtctaacctatgaatgacagacagacaatcataatgcagacactgtaagtagttaagcacaagtgcacaacaaaatcatccaaagtagccaggtcacgtggaccacaagcaaactatggctcctaaaccatgctgttggtatggatttgttcactaatacatggtgtggcacaacaatggcacattaacttcacttggcttgacatttgttgcaaagaccaaggacagtggtccatttgacattaaaaaggtaaacagttccataacacaagttaacttgaagctttcttttccacaaaacaaagtagtgtctaaccaaattttgcaatacaaactcccaaatggtttctttaaaggaaactgcagatgcaaaaatgaagtagctccacaggcaacaacaccaacaatgttcagcacagatgcaaaatatagttgttggactcattctacttgctcttggaaagcaaattttgctagcatgtttaaaaggaaaatggcaaatgagatcactgttgtatcaaagccgagcaaaaaaccccccacggattgactaatttaataagggaaacagcatgttatccagtaaaggaatggagtgagctccctaactggtgagaaaagtaactaatatgtgaaattagtgttagcagaaaatgctgttatgtcgtcttccaaattaaaaattgacagagggtgttgttttgtcactcttgaaatagaggagggactgccgatgttgaagtataaagtcagcttgcagagaatacttacttgtctagaagcctcacagtagaatccaaacaattagtaataggcaattgcggtcatttgacaaagatatacacctgacaggatgccccaagttgtcgacagtctccctgttatcagcaagagggtaacagaagcatcagacacagtggataatctgttgaagcatggataagcatctgaatacttctattcaaaaagagaagcacccaaagttccatttaggaaagctaagataacaaatgagaattggttgaatattgattgtgaaataagaaaagtacttacctacccatgcgaatgtcaaatgtgcggatagtaccatcaacactgccagcaattatttctgtgttggttaaattaactgacattacactatcttgaaaagtatcaattgtctgcaccaagtgaaaaaaatcaccagaaacccagttacccaagtatatgagaaacaaaggggaaataatactactaaaatcaatgggtccatgttcttcaacaataataagaatacctgaatagggtcactgctctgtgatctgcaatcaaatgcacgcactgtgcgatcatagccagctgagactacaactgtgttaaactcattaaacttcactgaattgatctatggaagacagaattgaggtatgtaagcaatattatcaaggatcaaaaacctgtcaccgaggttgttcttgatctgttttcagtatcccaataatcatattgacgatgtgcagtgctagatttaaaaggaagtacaacaacaccattacagaggtatcattacagcacactcattttcacacaattcaccctgcaattgactagttgtgactagatcgataatgctagagtgctgatttcgtggtgttctccacatagcacaatggaacagacgttgtttgattataaacagtgccaactgctctattccactacaatctcaggctactgctaatcctatcataaacaaccgtgctctctctgtatagataaaatcaatactagtattgaaatagcagcggcgcttaacacactgatagtatggtgctgaaactgcttaatagtacaatttttcatgagcacttctcacttgctcaatccaaccgcgatcaccaaacaattacaacagcgcggtcatcatcacagtgagaattggggtccatacctcgctgttgtggccgcggaacttgcggatgacacgggcagatgcgacatcccagtagaagacctgcctgtccccgccgcacgacaccagcttggcattgtccctgcaagcaaaggatcctcaaattccccactggtgctcagctcctccaaatcagacaggggaagttggtgttggggggacggaatcgcagcgaggaagaggaagcgaagtggcttacgaggaggagttcacgtcgcggacctcgcggccgtgggacttgtagggcttgacgagggcgccggtgtgggggttccagaggcggatgatccggtccttgccgcagctcaggcagtagttcccgtcccgattgaatcgcaccgccagcaccggcccctcgtgccccgacagcaccctggcctccgtccgcggcagccgcgccgccgccgccgccgccatctccccgcttcctcctccttcccggcgtcggtgacggtgacgaactaggtttcttttttttcttttttcttttttcttttttttcttttgagatataaacggcgacgggttcccaacttgggctggcccatgggccgtgtaccgtgtacgagtcggattcccccgaggcccagactactactatccatccgtatatccgtacgccggagagccccgccgacgtagacgaaaccggccaaaactaatccaatggcggcggcggcggcggcggcggaggggagagggccacggcgcgtgcgcaacacctgcatcttggcgcacgtcgaccacggcaagaccagcctggccgaccacctcatcgcggcgtacggcagcgagcgccgggtgagcgagaggatggccgggagcgcccgcgtgatggaccacctggaggaggagcagcggcgggccatcaccatgaagtcggcctcgatcgcgctccgccgcggcggggaggacggcggcggccaccgcgtccacctgatcgactccccgggccacatcgacttctgctccgaggtctccgccgccgcgcggctcgccgactcggcgctcgtcctcgtcgacgccgccgagggggtccgggtccagacccacgccgcgctgcgccaggcgttcgtcgagcgcctccgcccctgcctcgtcctcaacaaggtggaccgcctcgtcgccgagctccgcctcacccccgccgaggcgcacgcgcgcctccgccgcatcgtgtccgaggtcaactccatctactccgcgctgcgctcgcgctcctacttctccaccctcgacgccgcctgcgccctctcgcaagaactccccgacaacggcgacgccgccgacgaggaggaggacgcgttccagccgcagaacggcaacgtcgtcttcgcctgcgcgcgcgagggctggggcttccgcctcgtcacgctggccaagctactagcccccaagctcagagccgaccccgcggagcttctcaaaggcctatgggggcagaagtacttcgacgagaggagcaggacggtggtggggaaggaggccatggcggcggcgacggccaacccgaacccgaagccgatgttcgtcaagtacgtcctcgagccgctctggggtcagtaccacaagatgaagcggaagctgcggctcgcggaggcggtgttcgacatggtcgtggagtgcactcccaaccccatcgccgcgcaggccaccagggtggcaaggctcatgccggccgccaagacggagcagctaacggcggccgcgccgtgccccgccgctgtcgccgcggaggtggagaaggtgaggaggtgcgtggcgacgtgcaacgcgagcaccagcgcgccggtggtggtgttcgtgtccaagatgttcgccgtgccatacaggttcctgccatccaggggcgtcaatggcgagcccctgaaccacaggggatcatcatccagcgccgaatcaggggagtgtttcttggcgttcgcgagggtgttcagcggcgtcctccgtgctggccacaaggtgttcgtcctgtcccccatgtatgatccactgagaggaggggacgacgcaatgcagcagaagcatctgcaggaggtggagctgcagcacctgtaccagatgatggggcctgacctggagatcgtctccgccgtgcgcgccggcgacgtgctcgcgatcgaagggctcgggcatcacgtgctgaagaacgccacgctgtcgtcgaccaagaactgccagccgttctcgggcatgatgttccaggtgtccccgatgctcaaggtcgcaattgagccctccaatccgtcagaattgggcgcccttgtcaaggngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16633 - DNA, 7342 bp, Oryza sativa
atcatccacatatacaccaaccacaagtcgtgagttcttctctccttgaatatacacagcactttcgacaccactcttgacaaaattcaggctcacaagactagaatccaatttggcataccatgcacgtggtgcttgttttagtccatatagggccttcttcagtttcaacaccttgtcttcttttccatcaacaacaaaaccaggtggttgaaccacataaacatctttttccaattccctattcaagaaagctgatttcacatccatgtgatgaacttcccatccctgatgagcagccattgcaatcagcaatcgcacagtctccatcctcgccactggggcaaacacttcatcaaaatcaactccatgttgttggacatatccctttgccaccaatcgagctttgtacttcacaatggcatctttggcatcacgtttgattttataaacccactccaaccctattgctctgtggctagagggcaaatcacagagaaaccaagtgttgttaccttcaattgagtccatctcttcaagcatggccttcctccagcagctctcctgctcagcctccaagaaatttgctggttcctctgctgccataaggcattgatcactgtaatcaaaatcaaggattggagctgtagtggcaagcgtgtttgccactgttctgtacctcctgggcccttcattagtcccttcactagcatcagttggagaggaacagaattcaacaccagatggcagagttattgcagttccggtgcttgatgttggtgatgttgctagcatggtaggagtgactgctgcatcctgggcatgtgtctcacccccttggactgggactgtgaaattctccaccgtaaactccacataggcatcctgatctccttcttcatcagtgttgctgccccagtcccagaacgtcgtcccatcaaaaatgacgtcgcgcgacacacacaggcgtcgcgccacaggatcatacatcctgtaggcttttgatccttgctcgtagccaatgaagaccatcctcgtgccatgatcatcaagctttctcaagtttggcttggccgtcttaacatagcccacacacccaaacacacgcaggtgttcgacagtgggtcggcgaccatgccacgcttcatacggcgtcaccccatcaagactcttcgttggtgatctgttcaggacgtagacggctgcaaccaccacctctccccagaaatatgccggcatgtttgccgccttcagcatggacctcgccgctgccaccacagtctggttgcgccgctccactacgccgttctgctgcggtgagtagggtgcagtgagttgacgcttcacccctgtatccgcgcagtactccatgaactctacagaggtgaattcacccccgcgatcgatgcgcagcgccatgagcttccgattgctctccttctccacgccggcttggaactgcttaatcgccgccgatgcttcgtgtttggcagagaggagtcgtatccacatgtgacgactcatgtcatcgaccaggagcaagaaatacttcttgccccccggcgtcgccggcgtgattggtccgcagaggtcaccgtgcaccagctcgagcgccgtctgtgccctgtactatgcctcctctgggaatggtgtgcgacgttgtttgcccgcgaggcacccgtcacacaactgatcattatgatcaatttgctggagcccgcggaccatgcctccttgtgccaacctccgaagtgcctgaaaattcagatggccaaatcgtgcatgccatcgccatgctagctcggagccgttcgccgccatatagattggtgtcgcaagattaaacttgagaacatacaggtaacttgaatcacgatttaccttagctagcagcatcccttccgggtaacgcaacgtgaaaacaccatgccaaatgtgtgcgtcgtagccgcgcgcgtcgaggcgaccaacactgacgatgttttttctcagcttggggatgtagtacactgcctccagtgagcggtgatcaccattcttgcactgaaacaccacagttccgtgcccctggatgtcaatcaccgagccatcgccgaatttaaccgtgcccacaacaccagtgtcaagctccgcgaacgccgagcgtgcgcccgtcatgtgattcgtggccccggtgtccaggaaccactctgaagtcttctcctcctcacgcccatcctcgcggtcaagcacaaccttcttctccgtgagatgcacttcctgcacacaaggtgttcgaccaatggccgcttcgccggcgagcgacacccccatcacgtgtgccatgagcagagttggttcttcctcagcctggaccagattcgcattcgcctctccccgacgttggcgacgcggcttacggcactgcttcgagtaatgaccgtattcatcgcaattgaaacacttcaccttagagatgtcacgacggccatggccgccggtggccatcttctttcccttcggtgaatcgccggccttacctcgacggttctggttgctagagcccgcccggcccttgttgctgctgctggatccctcctgctcccgctgcttgacacgggcctgccactgctcctcagtgaggtacaatttgctgccatcacttgcctcctcgtcatcactgtaagagtcgaccgtcgacagccgcccgacgagctcctccagggccatggtcttcacgtcgaggagctgctcgagggaaatcgccaccggcttgtacttcttggggacaacacgcagcagcttcttgttgatgtgttcgtcttccatgactccgcccatgtcgcgaatgtccgcaacgacggcagtgagccgcattgcaaattcctctggcgtctccccgtccttgaagcgcatcgcctcgaactgacggcggaatccctgctccttcgcctcacgcacgcggtcgacactgacccgcatggttttaatggcatcccacgtcgccttcgccgaattgtgcttcgccaggccacgcaacatctcacgcggcacagcttggagaatcgccgagagcgctgcacgatcctcgcggtactccgcgtagccaggatcgatggccgtccagagcccctgcgcctgcaggtttacgcgcatcaacagtgcccagtccggataatttgtcctcgacaggatcgggagacgggcagtgtgcccagcatctctcccctgaggcactagcgggagtgatgcgccgtctgcgcaattccccacgccgctgccgctcgcgctgccgcggccgttgccgcttcccccgccgccgccaccaccacggcggccaggcggtgtgtatgacatcaccggatcgtctcagcaaagctctgataccaaatgtcagaaaactcatgcgaactggctctcaatctcacagaacacacacactgacgcttgcaggtgcagctacagttaactgaacaatttttcagtaaaacagagcagaacagaacaactgacgaacagagttttcgctgcgtaatgccgtgcagcttttccggttttctcttctatttattcatctccacacggagtttgttgcatgcataacagaatcacgacaatctcggatcaactactcaccgcgccatcccacgatccgagccgagtcatcgcagctaaagaatgaagcaaatatgctaaaacagaaaatgctattctaccggccagaattcagactccaaccgaactctacatgcaacaaaacaaaacagaatataaatgctcaagattacaatccaacagttactactgatgaacactcctgactagtccacaaggtagcacgagaaatatcgctgctgatcaatagacagtaggcacatctcgatcaggcctggttctttcttaaatcagtaagaaaatcatcagggtcttccgactagctttatagggcggtgggttggcccgcctgggttagaagcctcacaatttctatttatttgatattagaccattttctaatattcgtgttttttttctttgttcaatcaatggaaattcaacctgtagcttcttttaatttctaatgccagcagaaaaaatatggatcaagacaacttaggggttgtgagttagcatagggccgggatagtacattatacagtagacaccttagctgctcctaatccagtacattcttttccaggtcatgggaacgaaagggaccagaaatacagatcaccggccggtccttggacaccttcatggcaagagcactagttttggccatgcagtggctggttggctgcagtagggccgatgaggataatatgctgatggacagcgaaactgtagaatacaactgtgtatagcatgttttttggacgagcaactgtatagatgttgtctctgtggctgtcgaaatcttcccgctggcttcgtgaaatgtttcctcattgcgaaatgttttctcatccagattcagatttcgggaagggacgtgtattagggatcttcgagggggggggggggatcatgcatttcgtgcaattgatattaattcttgatgtctgtaggaatttccttgtcaaaaatgttagtaaatctggtcatctgtttaagtggaagtaaattttaactttcatactataaactgtataaggtacaagtggccagagttaattttgaattttagaattattaaaatagaagaaaaaactaaaatggaaaccgtacaacttatatatatagctgtctagcatagcatgttttccatggcctcaaggaaattagaatatgtattctgtctattgccgaaccaaatgaatgaacaatttgtaggtttggggggcaccaggagttcatgtcccacagcaccacttttgcagtggatgacaaatgacaattcactccttgattctgtaaaagttcatcggtgtgccactcaattgctccgtcgttccgaggacatcttgatccgtcagatgcatattgcatcatgagctccggcgagcagatgattaaagtatcatatttcataagatagttttacttagccatccattggaatgtgttacgtttcatgctcgtgaaatcaagctcataagtaagaagcttagccccaatgcatggctcccaagtcatgaaaacttattatatataatcagaaaacgaagcgatccccgtccttccattatacgttcgaaatgtctactgctggaattttacgtacataacagtgtatatgtcttttctcattacaaagacatgtcagtgcacacatccgccttctgtagttgaaggctatcaagctcttactacgtcattgcacgcaagaaaaaagatgatatagtatagtttgacaagttacagtgccactatatcagtccatgacattatatttatcttctatctatctatcttctatctatctatctatctatcttctattatatactaaaagtccattaaactttctataaacgctctcaagccgccacgtggcacttctacaacgctcctagatcgccacgtggcaatgtctaatcacaccgtcaattttcacttaaatcggtggacccaataatttggaccattagattagattacatgtattatatatttaaaaagaaacaaataccttactgttcaccagaaaaaagaaaacaaaagcatatgtactccatatatccatatataggtacgtacgtagtatgcaaagactaaaaaataatcaataatcttacctactgttcattgtaaggaaaaaaaatacacacagacttactataaaaaaacaatagagccaaaaaaaaaaacgtacgtacgtactaccaataaaaattgattatttttaagatagatttttttcgactatttaaagataaaacctattactctataaatttaagcaaatatagctatagattttgacttaaatgggtgaatctaatattttaaaccattaaattagatgtatattattttaaaaactaataccttattactctgtgtacataaacgggagaaatatataactgttaggctagaaaaagaaagaaaacacataatctcatcgtcgttttcacttaaataagtggacctaataatttagaccattcgattagattagatgtattttatttaaaaataaactaataccttactgttcaccagaaaaagaaaacaaaaacaaaagtatatactccatataggtacgtacatacataagactaaaaaacaatcaatcttacctattgtttattaaaaaaaactacgcacagctatagaaaacaataaagctaaaaaaaatatacatacatagtaccattaaaaaaatcaattatcttttaaaatggagttttctactatttaaatataaaatctattactctataaatttaagcaaatatcaccgtcgattttcacttaaatctggtaacccaatatttttagaccattagattagatgtattttattttaaaaacaccatataactctgtgtatgtatacgggaaatataagtagtcagtacgtgcatatgacctgggaaaagaaaagaagtttacctactgtccttcaatatctactcacggtggttttctgaaatagtattttcaaaatcacttactataaaaacaataaaaaaatatgtatcattggaaaaagatcgatggtcttttgaaatagtattatctactatttaaagataaatatattgctctacaaatttatgtaaatatacgtagttaaactaaatttatattataaatatgaaatatcccatcaatgatctttattcgttctatcttaacatacaagactaatgtatataataattaatgctatgatatttttttgtcaaatatcacttgacgaatatacaacgctaatttaaatcaatatttgtaaaactgaaaacaacacaatttagttgtttcattttacaccattagattagatttattattgacaaataatacaattctcctatatacggatacatgaaaaatatataactgttgaccggaaaaagtactccgtacatagagatgattgaaagaaaacaataatgcttacatatcgtctgacggaagggaaaaaaaagtacttatgataaagtaaaacaatcggaagtctttaaaaaagatttttctacaatttagggataatacccctaaaaaacaatttaaggataaaatataataatcttcaaatttacacaaatgtaaatttaaaatatccaatcaatgattttaagcgttctatcttttaaatttttttaaaattatttatccaatttgtgattcagtagtattcctttaaataaataaactattactccctcattccctaaatgtttgacgc

SEQ ID NO: 16634 - DNA, 5198 bp, Oryza sativa
ttatgataataatttcacatcacattttagtgtaagaaaccacttgacgaatatataatgctaatttaagtgtacatatgtcttatccaaattactaaaggtgtctcatgtgattagaacaataggggctgaaaacaaaacagacactgaactaacatgcactaccctatagatatttgtcaaagtatgataccgtactttggattatcgtgatagtattttaaaaaaatcactttctctcagttacatataaattcttctattattttggaataaaagttaactccttccatttatgtgacggtggtaatataagtaatataagtctatgtttgattagatgaagtagtatcattagctatatttttaatagtaaatatctttcattaatatatagtaaaattaaaatgttacttaaagtcatctataacatacacaataaaaaaagttatataaagttgggaaactctagaaattttaaaaaaagaatcacacataacacaaatagatatgaactaattctattattgtgacatattttttctaataaatttgaggatatacattttcaagtaatacgcccaaaccaattattaacgaacatacgttttaaatagagtcaaaaaaatatttcaaaaatatgatccacacataaagattcgtaataaaagttcaaacaatattaaacaacatgcccgcgcattgcgcgggctaccttctaccttctggttcaacaaaaaagacagcgtgtgttaagaacttcctgtaaaaagagatacatgaaggctgcagattcagcgattattatgcttgcatatgaccctacacggctagcgcagtcttcgttctttgcttgcggctagcgattttatctgtgggactgagagtaatctggaaatcaggtgtcgatgctacacgctgagacagtataggagtatccatttcgatatgccatgcatgcaaattcagcaccatatcctactctcggacaccaacgactgtaagcagcagaacaacgagaggggacttcttcgcaacaagatcgtaaggctcgttagagttccgcgcggccatgctcatcagctgaaggatgcaggatatatatggcaaattatttgaggtgttttggtcattttggtttttgagccatgtcaaatcaacatcaccttaacgcatcgatccaccatcaaattatttgagagtatatatgtgacgttctctttcaattgataagaggtaccaaacatttttaataaaaatcttttggctcctctccgtgtcttgctagtgctcgatcggatactgggagttatgcatgatgcagaagctgggatttttattccattatctgaaaacgataccgggagttatcgctaccactgtttttttaattaaattactgtaggagattatcgctagcagtattaagcaccgaaacttgatggtggataccgtgaaaggtacagtggtacgggttaattggatccataccactataattgtggcaaatcagaaaaataccactactatttgtgttatcggctgggtaccactgaaaatttctaaaattaaaatcatgccactcccttcactctttccgtcctcctctctcatcgtcagtagcagaggggtgcggggagcgggcgcggccgcggccgccgccggcgaggacggtcgaggaggggcgaggatatggcggaagagctcattgacgacggggaaggagataccatggccgccttgccttctccccgtcctctcgctactcgccggcgccgcctcatcctcgccgctcaccggcgctgcttcgccttatccccgtgccgaagtgagagaggaggatgacgatgtgagggaggatgacgatgtgagagaggaggacggaaataatgatgggagtggtatagttccaattttagaaattttcaatggtacacatccaataacgcgaatagtagtaatatttttctgatttgctatgtttacagtgtcatggacccaattaaccctacttcgaaaccgactctcttagtacgtacttggtcaatcttaaccatctgtaaccaagtgcccttgttaggtagagcaatttatcaccacacgcacatacacgtcatctgtctattgaattacattgtagatagttcttggaatgaataattagtgaacatgactctgtttgttcatctttgactttctcccaaaagccggatcaatgcaatttgatctgtcctaaaaaaataataattagtgagcacggatagatacaacccaacatcaacttggctttaaaatgacagtagcacgaaccaaagtcttcctgtgagagctatagcagaagggagagcagatagtagccaagtcacgagttaaagggcgtgcaagcctgcagagcacctgctacacgatatgcacacatgatctcctgcaccggtgttcgtttccagatgatgggcatgggaggcaccgggaatgaactcccctccttttgcttgtgaccctgctcacacaaacagtgttgttcgccccgattcatcagctgcagcagggtcgatgactcgatgcacacggtcacaaactcacagactcgcagacaacaatttcatctaagcttggggatttgttcctgcgggctcacagtagcagggtgtccctttctacgtgcaaagcttgctaattctgtacgatgtatttctcttcaccacgaacatggcatttgcagcgcgttcgtccgatcgggaaggaaacgtgcctcgccctgcttgtgagctgtgaaccgggagcgacaaatatttttattctccatatacccttctctattaaactatatcatccttttaatttatactccctccgtattttaatgtatgatgccgttgcacgatctatcacaaaactacaggtttaagaatatgtttcacaaaactacagtttcagtgtattcgtttatcataaaactacagttcacaaaacttcatatttaaaaacttgtttaacaaaacaacagatttaatatcttcatttatcacaaaacaacatgtttaatgttttcattatcacaaaactacaggttttaacattgttaaaacctgtattttttatgataatggagatactaaatctatagttttgtgataaataaagacactaaatgtgtagttctaggataaatgaatacactaaatctatagttttgtgaaacaaattcttaaatatataattttgtgaaacaaattcttaaatatatagttttgtgaaacaaattcttaaatatatagttttgtgatagattttgcaaagtacatgtagttttaggatatatagagacactaaatatttagttttgtgaaacaaactcttaaatctgtaattttgtgattacttatgctaaatacctgtagttttgtgaaatttactctaaaatttataaaatgcatgttgttttaccttttttttcatttatcctatatatatctataaagtttatccccactaagtgcaattaatactaattctctcttatctcatgaagccatattatctcaattatttttagcctttggatgattcatcaatggtgtaaattgcatctcttccccctcaaaaggtacaccaaacaattcaatcatttatccacatttataaatgaggtatagctattttgtcattgtatggctatttggtactcctagacagtaccttatctaccacttcaaactgaaggaagaatttaatattagctagtagtatgataaactgcagcctaaagatatgtgtaattgttgtgcttgctcgaagtgagagaatgaaccagttaaggaaggatatattcatgtccgatggagttgtgtgccatgtgttacctctatgaggattgggacatgcgcgagacttcagggtcagacgagttttggctactaattgaacaaatctttatatactcctcatgatccaccctagatgcatatacaggggaacatcttttacatattttctttatcgttaggggtagcaggcgtcgggaagtgatctggttatgaaatggtatggtgccaaccagtagaacatgaatattctcctgaaaagataaaatgattcctgatgaagatcctctaacttacttccctgtaacttgtatcactgacatgtgggtctctatccaatgggccgggacatgtcagtgccttaaagctagaagaaagtaagtcagaggatcctcttccaaggactccagttgcaatagtctgccctctaacactccaataaaattttgaacatccaattcatatagcgattttaataaattcttagcaaaattttgagggtgatggaaagcatagcaatcttggacatcgaagtctcgtagcaggcaaggccgtccttcatttttgaggggattgaaaccaaacggggaattttggaatatccaaaactattttctccttttgtacgaacgaagagagaatgcttcggccaacccggctataaatatatggggaatatgcttaaactgtgatagcctattatcgtcggagacagctcaaaattggcaatatagtagttgaaaatggttaaaggagcgtcatctatgatgatcttgcactgtaacacacatagggtgcaagccggacggccaagctgggttttttttcgcttatccacttctagttttttttttctaaaatttatactaccatgcatataaaaaataacctaccaagtaggattttatgtgggtaatgggcttgctcacttacatccctaaagacacacgcatcaaagtggtccatatatacattcgcctgtattcttgaatggcctctagttaatataatggtgaagcagaccagctgggtgtagctgcgtggttgcagtgttactataaaccaccaagtacaaaaccttatatatgtagtagctagcatgcccgatcacaggagcacacacaacacagtccaatccgacgacctaagttcgaatccccaccccttctaattatttgatattaggttcttccctaatattcgagtcttttttttactgctagaaaaaaattccacctgctctatgcatgttcaagtaatccatatcctcgatcgctctgctacaacaaattaaccaactagacatatgtttgatgttccagttcgatcgcaggcatgggcggcaccggggatccctctcgctcgatctccgga

SEQ ID NO: 16635 - DNA, 1116 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatctgcgcgacgatcgtctccatgttgtcctcctctggggcaacaaacagcaggccgagtggctcggcggaaaggggccaaa

SEQ ID NO: 16636 - DNA, 623 bp, Oryza sativa
tctcctcctactccgctcaccgcaggcggcagcgccgcctctcccatccccggtggtgtggcctctctctctctctctctctgcagatcaggtcgcctctcccttcctcgacaaacacccaggtggagggcgacggtactggtagtgtcgagctctcccctctcctcacgacggtcgggggaccacagcggcgacaaggatagcgagctcaccggatccggccgcaatcttgctggatccggtcacaacctcggcgggtaggtcggccagtagaggcgatgagttccgtacagtggaggttgacgtgattggcagtagcgagctctgtaaggcagaggaaaatgagctgaagctctctttcctctcctcacgatggttgggggaccgcaacggtgatgaggataacgagctcgccggatccagccgtaattttgttggattcggtcgcgacctcagtgggcaagtctgccggtgaagtgaagggtgatgagctccgtgcggtggagggcgatgagctccacgctgcataggtcgatgtgatcgatggcggtgagctctgtgtgatgggggatgactagattggcggtgacgagctttgcatgggggagtgtgatctcattggg

SEQ ID NO: 16637 - DNA, 5347 bp, Oryza sativa
atcttaatgctgcagctgtttctttgtgcatgaaaagcctcttaagccttggtttgattggaaagtatcgcaacaccttccttggtgctgccttctttctttccttcttagttaatttagttttatcctttttgtttttccatcttgaagctccacacttagaacaaaagtcatcattagccttgtctttccggtatagttggcaattatttggacaaacatgaattttctcataactaagcccaagttttccaattatcttcctagcctcggaaaatgttctaggtatattgctaccatttgggattgcttgttgcaaaattgctagcaaatcattcaatgatttattgctccacttgttaatggattttctatggaacaaaagcacaaggaatgaaagttttgaaagttcacatcccggccaaaaaggttggtcggcctctctaattaagtcaaagaaagcttgggtttcagggttgtcacgaccggaaataacccaacgggcgttccttacgtgcgtgtattatttcttgtcccaggaggcaaggtacaccaaaagttgatacaatatagagtttaataagcgaaagtgtaaataattaatttattacatgggcggcgaaggcccagcacacaggaagacaaacgaaaaacagcggaagactagggcgatgaccacaggcgcttgacggcaggcacgagctagacaccaaagccttcatcttccaggaactcctcttctgggtttgggaaaaattgagcaagactgagtacaaccaccgtactcaacaagacacacccacaagtgcagtataaatgcaagggagtacaagggacttataatatagggggttagggtttgcagtaaacagcattaaaagacacttagttgctcaaagctattttgtaaacacgatcctagagctattcaatattattaatcaaggccgtgaacccacacgaacctgccttaacccaaggcctacgatgattcagaccgaactggcaacccgaccctgggtcccagctcgtcccaagccaacccaggccaaccattccatattttagttgttaagcaggttttaagaattaaaacactaacttgggtacattgctaggcttgcccataaccgagggcgcggctattcgaatagattatactctgatcagaggtgtacatctttacccacaagacacatcttcctcacgtgtaaccacatgccacataccaccacggtatacggacggaggacgtgacatagtttccaacccatcctagccatagacaagagtaccgacccaaccccacctacggccggaacctccgggacaggtaggcaggactgagcccttagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaaatccacaataatccaaccgttccatagtgtccaggtgatgagaatattcccaaagtctagagttgtaaaaccacctaatgttgcctaattaaccagcgaagcatctacctaaatttatactagtggtaccatgaatagagtatccactagttgggggttttgtttattctagggtggacaaggtaataataacaataacaataataagatcataacaaaggtaaataggcatggctaaataaaacagtgataacgcgggaatttaaataaagcgataatgcaataatttaaatcaaaataattttataaactggaattcaatatgttcaaggatgatgtgacttgccttgctcgctttcccaaacgtcggcttcaacctccacgaagagcggatcttccgaagctgcagcgtctacacgactaacggaaaggaaaaaggcttttactctaataaactccatataacaagaaggaacaaagcacaaaaatgggttcttgacttcttaaggaaaaattagagacttgaacggtccaattccgagttcaaatggccaagttatggccatttgaagtttatatgctctttaaatgaatatttgcgaatttctttatttaaattttaatttaaaaattggtttactgcgtcagccgagggggaggggcgcgcggaccgggtccacgggagtggggcccacgcggcagcctcacggtccacggtggaccgggtgcacccgggctcacaccggctggcgccgtgggccccacgcgtcagccgcacccgagggcgcgggcggctgacggccgggccccacgcggcagccgctcgacgcgcccgaaggtggccacatcggcgtagccggcgggaggcggcgcgcccgcgcccctatggtcgccggcggcggccataggcacggcggagcggcggccgagagaggggagggaaagggggaaacgaggcggcggtccacggctcaccctaggtcgacggcgacgacgaaaaaggctgccgaagcggaggaaggcggcagcgcggctcgggtcgacggggtcggcggcgctccggcggtcggcgagctcgacgagggggtggacggggatggcggcggtgcggcgaagccggagaaggcgacgccggggcgggaaacggtcccggcgagcggggagagccggccgaaggtcgtcggcgatggaggagagagagggcgacggcgcgagctcgattccggcgaggagacggtgcggcgaggggcggaaacgggcgcgggaggtgcggggagggtttaaatagggttggaagggggagagggcggccgggagaggaaggaaaccggccgggaggtccggctgccatcaatggcgccggcgagatttgcaggagcaaatccgcccgtttgaatgcgagagagagaggggaaaatggggggaaagggagaggggatcacggggaatatttccccccactttattgcacgcggggacggcgggaggcgacgggattcgcggcggcggcggcgtttggcgcgggcgaggcaatgggagcggcgggagggaggagatgacaggtgggccccacccgtcagcgagggtggcgggcgggcccgcccgtcagcggcgcgcgcgcggggaggggccgaatgggccgcggggaagaggagagagggggagggaaatgggccggattcggcccaagagagggaaggggatttttagggtttttcttttttataaaacctttttaactttgtttatttcttaacaattattatttgtgctctaaaaattccactaaaatttatttacacattttaggcttttaggaaatatacaaaaatcctctaagccttatttggtcttttactttgcacattttaatttttggacgctttcacacggattttaattattctaggcataatttaaaggatatattttagggtcgttttgggacgtaacaagggtatggtcctgtttcaaaggaattttggcaagtagatgaattcattggatgtccattatccatatgcccaaaagcatctatgactaactggtgcatattagtttttgttttttcttgcaactgtgcctctctgttagcagagatgaatgctgcagtttcaccatgacagccccaaattgtatattcttttagcattccatcacaaactaaatgatcatacacttcattccgtttccgtaaccaccttagagcacatttgacacatgggcatcggattttctctccagaacttttcccattgtatgcaaaatcaagaaaaccatctacaccagtcaaatagtcatcacttggtctaggggaaagtagtaacttcttaatagtggctaaatcgacccattccctgtgtttaaaaaaatatagtacttattcaaatagggcaagcgtggtagaaaaaccaacaagtgcatccaaacacagatgaagaaccagtgttcttgttgactatcgaaatgcaagaatacatggggagggaaaccatacctggtggattggtgcttggatcctttagcccttgtctccataacaggaccagacaagctgcagggcagcaggcttgtctagaagctcaatccaacgggcttcagggaaatggtttacccaaagaaactaaggattcagagttggcgcctagcaaatgagatatgaatgaataaaaaatttaaagcataaaaaatcctttgtaaagtaattaagcaatgctattttcttctccattgcaatttgcaaatataccagtaaatcatatacaaatctcctcacaacctcatttgtcactatacaataaagaacagaatagagctcactcactggatgcaagcaagcctcatgccgcaagaagcaatgtggcaggcaatgagtcaagttggggcaacgagcaagctggtagcagctcttccttggctcctgcctactggtttgtccggccggcacacctgcacgcctgcacggccacgcgctgcgcgcccacgcttgcaggctgctgctgcgcagcccacttcccttggccgcctcgctccggtggtcacctgcgcagaggaccgacgaagaagagctaaactgccgttgatcttctgggttgggttgtggtgtccaccgaactaagataagacaagatttggggattttccttatacctagcaagcatatggtgtactggtaggtgggtggtgtgagaacagaggtgcttcagtgcttgtagcttttcagagatgcagtaatcgaggaggtaggagagttaagactgtttctttgttatctgtcctcagtcaaaaggacttggactgttggagggaaattttctctcccgtgagaactttttctttctctttcttgcccatacaagattaaataaaatttggaatacaaaataaaataaaatcgaaaattataaataaaaacaatataagggtttaagtaggaataaaatttaaaaactactgaaattcgaaattaaaaataagcaaatttgaaagaagagtcaatataaaaacccaatacgagattaattaaaatttaaaataaaaaataaatccaaaattagaaaataaaaaagaaagttcaagtagaaatacaattttgaaacaactgaaatttaaaataaaaataatgaatattaaaagagaccatataaaacacaatacaagattaattaaaatagatccgag

SEQ ID NO: 16638 - DNA, 1551 bp, Oryza sativa
ggactgataccaatccgtttttccacatgaccttttttttaaccgtcggtgattttttttacggtcggccttttttcttttacccagcattttttgcaaatttttttatccggtaccaatcgtacttctttttttcctctgtttttcttttgcgatttttatggcgtgttttctttttccgtgtgccctttttaagttatggattttgaggagtagagattaaaaccgaaacaataaattgaaaccgactcaaacacggatgacttaaagtatcggcaaaaacatatttaatttttataaaagtagagatatatctctctcggttaacatattttctatcgtagacctagataagtttaggtactaatattaggggcatgttctattattgtggttgggaacttgagattcttagctgagaattaattggagttacgtaccggtgctcaactacatctacgttatattgttctgcatacttcatgttgcagcaatgagcaaatgcatgtgttcgtgcgtaagcactcagctaagctacatggggcgtctcctagatttgtaacgagtcccttcttcatcgcttggctggcaatgtgttcatcgttagttaaccaacaattaatatagtttgtggcttggtaggcttcgagaatttgtgcaagttattttcatcaatggatatacactatgatgaaaggtaattttgtgaggaaaagatcatagactgttctataagtgaatagtctaaggttaatcctacatgaaagaatcacctatgacccaatcgaattatagcaccgtgttaacatgcttggatatatgctaggaagtagaaagcgtggtgaatggcaaaataaatcattagtgtaaatgcaagatgatctgatcgagatccagtttccaccttggagcgccatatataagcctatggtcctctttattaaggttatgtttattggggtagacttttaactgagtttatttcttatatatttgagagagaatctattctatatcactgagtttatcatagctcaacaatttaccactgatttttttctttttctagattacgtcattgggtttggcttatttttcaataaaacctaaaatacccttatggagatataaggttaacagttgatttatatcattagaagtttaaaaaaagaagaaaacttttatgtagcctccttacacaatataaaagtttgaatttttttcatttctattttttaaatataacttatttgttatatgccatataaaatattttttgtgttgttgtttttaatgtaaattatctttcaaatgaaacataagatattttttgctattatattttgtgtaagctatttctctctgatataccacacaaaaatattttttctaaaagaaataccaaaaaaaaattgaacttatgtacatacttctctgttgtgtaaggatgccatataaaaaaattcatattttttttaacttctaacaagataaattaattgttaaccatgtatgtctctaagggtaattttggtattttttttaaaaaaa

SEQ ID NO: 16639 - DNA, 2288 bp, Oryza sativa
aatatgtgacctgtaaaatttttcctctcctctcctctctctccgaactagtgcaaaggagagatgtgcaacttttttatttttattttattttctgatatttttttcacacttagaaactcacaggaatcaaccatgtaaaaaataaactcaaacggacgaaatatgtggcatgtggaattttccaaagttctaccgaaaaacttctctcctcgaaaacacaatcttgcaagcggaatttggaggttttaatatcgccgaacccggcaaagcgagggagaattggatgtaacattttctatagatgtccgtacatatattatttgcctgattccgagttcgtatgagaaagttacgcctattttaatagatgacatattttgtccgtttcggtagagttttggaaaattctacaagtcacatattttgtccgtttgagtttattttttatacgattggttcctatgttctcctaagtgtgaaaaacatatcaaaaaaatgaaataaaaataaaaaaaattacatctctatgtactgtttaacttatatatgtcatttcatgtggttatattttgaattagattaagtaatttcatatagtggtagagtgtattatgtttaacatgctgatcaaagggttttactaaaggaattatggtctaattttagtgaaggtgcaaagtagactaagtggtatgctagctattttcagacttagctaagtggtagttcgagtttaaattttttttgtggttggttgtatcgtgatcctaagtgtgaaaaaacatccgaaaaaataaaataaaaaagacaccgttgcaactccatacagagaaacaggaatggaggcggcggcgccagcatggctggcgccctcctcctgccacgtcagttcgcatgcgccacggtggcaggaggacggcgccagagatggcgccgccccattcgatgacagtgccagccactctggcgccaaaaaggaccatttttgagataaattttttcaggggtctatttgcgaaataagttttttaaaaggaccaaaatgtgaaaaatccagttggatggcatacgtgtgacaaaaaacgcacatgctagctattttttttagctaactaaccatgcctctaaaggtttgttacctatctgactctctcctcacgcttgtgcgatgtttataaacctggctctatgagatggttgtttgtttttggccagtatatatatatatatatatatatatatatatatatattggttgtttcttaaaagagaaaaaaatgccatttaatccacacagttggatcaatttaatttgtctttaacattttcatgtagaaagcaattttatgtaatttatagtaaattcgatacggtggttgttagggccgaattcaccaccaatgaccccagacgcccgtctaagcttatggttgttgtgaaatggaatttaaatgttatttagggattggaaattatattttcatagcaaacgttcaatttgagagtggcccggactctaaaactattgtagatccgattgaggggtgcaaattggacgagagcacaatagttcagagtgattttagacattacacttattaaaacccatgatccaccaactaaacgcgttttgagtttcaaaggtgtacgtcctactttgttttgctactgaaatctttctccattagctaaaatgatattatttccatcggtatagcagggacattattaattaagtccatttcaagaaaggccaggatcaaagcaaagtctaagagttcaagaaattaattcacatagcaccctgggagaagaagatagtgaaatggcttgcgcaggccaacgaggtcacaatgatctccatgggtatcaaaacaatgtgcacagcccatgagacaagagtgcagaatgtgctataaggctgtaagagacaatacgcggtacgtttgtttgccattttcttgactattcctacgttcgatccggacctctcgggttatgtgccacactggcaggatgttctgcacgtactccatacgtgaagatcttcaggcgaggcatccgacttcccgatgccgcccaaacctatgaaataactgagcatagatcgagctggacttctccttgcatgcagttttggagtgtagttcttggtaattcagtaatactctgttgagtacttgagttgctcagctcatctcccttgtgcacacgcataaaatacactggtggagaaaccatctttcgtcggtcggccgatttccccaatagtcccggatgcaata

SEQ ID NO: 16640 - DNA, 1455 bp, Oryza sativa
agatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattaaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagagatttagttcatttgctaaacaaggttttataaaatagttgagaaggaaaactctagtgaaagttaatcttaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggttttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtatgctgcatccaggactattcatttccacttgtttgagtcggggttcatgccaagctataattgttggacatcccacggagagcaaggtgttgaaatagaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgactgtatcctatatcgcggtgaggagtatgagaacctagaagcatgccctgtttgcaaagcactacgatacaagattagacgggacgatccaggagaatttgacgggcagctaacaaagaagagaattcctgctaaggtgatgtggtatttccctataataccacggctaaggcgt

SEQ ID NO: 16641 - DNA, 1180 bp, Oryza sativa
gaaagaccggttgctcggcaggaactactcgcggttgcgagcgtcgacgaaggcgcgaagcacgcgagcggagaggaaggcgagccgtcgcggacgaacagagagctgtcgcgcgaagcgcttcccaaaaaccttattgccgccttctcccggtgcagtacgtcgaaggcagaggttccggagacctgctctcccgatcgccggtgcacgccggcgagcgggatggagtagtctacgagtgacggcgcagtacagagtaggaggcaaaccctagattgatttcgcgtgtgttgcgtgaagacggcggctcggtttatatagagatagatcgcctgatcagggcgcccgcgtaaaccgaaccggataagtcgcgcgtaacctatccggactccatgccgttttcacgtaccggatttttcggaatgtttccaaaacaaaacaaatccgaatttcccgcagcaaaacaaaactgcaaaagactccatgccgttttcatgtaccggatttttcggaatgtttccaaaacaaaacaaatccgaatttcccgcagcaaaacaaaactgcaaaaggaggctgcatctgcgcaagggtgaggagccaattttgtagaccattcgacgcgtacgtcgtgcacgcgcgccgcctgccctgccaggcgaggcgaggcgagcgcgcgcgcgtgtttcccctcttctcttcaccacacatgcttcaagtggctaggagagcatcctcccttttaaggaggtccccctctcctagaataagcaatgtggtactaaactccacatgcataccatcccatgaggtgggcttttgtgattttccaaagaattaatcttcaaatgggccttagcccatctattaattccaacaatcccctaccaaatctcaaaatcccactgagatttgcctttttcaatgtactgtttatataccaacggctcgatagagaccgattaaggttgaacatctatctagaactccaagctacacttactcacaacttggacaatggactacggcttggattgcaagtcttgtgcaagcaagtttcactcagagtcttatctggtattagaccgtctgtagactacccctcgggtggagcgtataagttatactcctaggtctttagtaagcttcctagaagattcacccaaaatctccatagactgcg

SEQ ID NO: 16642 - DNA, 17787 bp, Oryza sativa
  unsure (1)..(17787): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattgctaggatttgtgcggaataaaaacgagcctaccaaaaaccagcaagttcaatcagaagaacctttggatctgcaaaataagtgctcctcggaacatagtgaatcttgcactagttccgatgaagacggttcatggcatgagattttgaaggtgggacctgaggaaaggaaggctgctcggaaggaaaacaagaagaaagtaaaagcagaaaagagagaagctcgcaaagataagatcccaaaggctgagaagaagaagaggaagaaaatggcaaaagccaagtgcaagcggtagtcaatctgtgtgtcgcaccaacaatggtcaatatcatcaaagctaaattagctataaaaatctactaaagttatcatatacttttcagtagattacaaatgtgagatggcctttatgaatgtaatgcaattggaagatgatttttaaattgagtataatcccttgcagcatggaactcttgtgtactgtttttggacgtcctcagttctgtgctcactgaaatttgtctttagctatgcctttacgcttaccacgccagacgagctgtttcctgtattctggtttcagtaataagagccggctattttgctctctagcatcagcaacaaaggttgtttatgcatcactgattttttttttgggggtaaggatcaattctgaatcaggcaaatcaggtattgagcatcttgacattctgtagcccatgttgagtagttcatactagtaccttgtatttgaataacgtcagaacttggagtaagaagatgcattcgcaactttgcatgcatatataaactgtgcaattgatgcaatatgagatagtataactctatataaggctatgtttagttcgtgtgtcaaatttcttttttaagtatacggacacacatttgaagtattaaacgtagactaataacaaaataaattatagatttcgtctataaaccgcgagacggatttattaagcttaattaatccgtcattaggaaatgcttactgtagcatcatattgtcaaatcatggcgtaattaggctcaaaagattcgtctcgcgatttacatgcaaagtgtacaattgatttttttatccacatttaatgctccatgcatatatccaaacatttgatgcaatggaaaagttggaagtttgaataaaaaattttgaatctaaacacggcctaagtcgtgatgttatgtcttaatttatccttcgtaggttgtagatcttagtactagtatgcatgaatgcatcatcatctgatgaaaatgactccagatgttaatttcaccggagtaaaagatgcatgagcgtgttgactcggttgggcttgttggtttggccagctaatttgctagtactagtaagaaaaataaaataaagaatggcagggagagagagcaatggcgccatcactattaatactggaaattttcatgatttcttgagctcctatacgattttttttctttgaagcttctttgccctcatgtaccaatggttaagttaaattatatatagaaaaagaattccttatgttcagtagtatactatcattacacgtattatgctgctatgtcatctctggaaactgatgctccggtgtttttttgggaagtttctcaacgatcgatggcagtataaggataatgacaattatctaaaaaaaataaggataatgacacagaaagaggtaatcccagcctgcttctgcttggattttttttgggttcaatgttctaatcagatcatgccacactggtcatttatgtgtacctctttcaaaaacttgttacatgacatagaacaagaagactaccggttgccaaaatgcttctatgagaaattatcaaaattattataaatttgaaatttaaataaacttttaaagtattccaggccgtttgttccgacaactaattactaccggcttcagacaggctactactggtttttctaaacaaacagaggaactcaagaaaattgaatgtggcaggccattctatttaggaaaaattacaaaaaccactccaaatgtcacctttaagattaccccctataaaatgtttgttgcaaataccccctctaatttacctctttctgagtgtttgccgctgttcctccccaattagcaattgctgctgttcttttttttttgcctgttttttgcttgtgttatatgacttagcacattccttgatggatatacacatttttttttctcaaggatacagtgtcataccgagctcatctttaaatctgttaaagaaacaagccactgctgaaccctataagacaagcataacagttcatctttcaacaacctcgatgtctaagagcgaaaacttatgacccgtccaaggaaatgctaaacatcatgagcgattgagccgagatttcacaatcatgttaccatgcctggccgatatgagtggtgaccacgtctccatagtcgtgttatcatgtggggtttgcggcaatgaaaatgggcaagtaatagcaattgggggaatctcaaaccaagatgaagtaggaggggggagggatatttgcaataaatcgtcaaatatggaggaatatttccggcgtccaccgccgcccctctctcccatcggcgtcctccctggcatcctccgcctcgcgccgtggccagtcgggggtgccaaatccggcgccgtagtgggcggatctggccccccgcggcgccggcggtggcgggcaaggcgcgcggtggccgggtcgcgtcgccgtcgttcccgagtgcaacgaccaccaccacgacgtcgtcctcgtgctcctcggcggcgagcatgggcgcgccaagccttctccgcccgtcgccggctggcggccgacggctgccacgacgcgcggtggccggatccggttgttgccgtcgcggatccgtcgtcttcgtcgcctctctcttctctctctctccctctaaggcgtggaaccgtggtaggcgcggcgcgacgagaccgagaggagagcgagagtgaggcgagtgtgcaaagagaaatttggggggacgatgccgtgcccacgagctccacacacactcaacgcgacgcctggctgcgtctccccacgaaaagctggcgaggaccagagagagccgcgtcccccagcagagggacgcgttccatcgcagggggacgggacggcgccgatggaaaagcgaacggccatcgctaggggcacgacctaggactacccattgctaatacctaatcggcatccccttattgtttaattacatgcctcggtgaaatcatgtttgaacaactttatgtataagtccactagttagtgccccgacaaaacaattaccactccacaaagccggatgctcagtttttctttaaaagaaaaagaaatattgttcttctgtcttcactcgaataaatttgatcaagaagcattgccatccatgtggcattccattattgattcattctcaaattaccaagaaacatatcaataataactaagataagatcaaaacacacctaacaaatacaaatcgctctcaactcatcaattatgtagaaaaagtctaaatcacttttaataattgactaatctttgatcatgtagctagctagtgctttgctactccgagtccatgtgctcgacgacgaagctgcggatgaggcggacgagctcgtcggcgcgctccgaccacggatccacctcgaagaagccgtgctgctcgccggcgaactcgacgaacgccaccttctttccccactcctccctcatccgccgcgcgtagtgctcgttccggtccctgaggatgtcgtgctccgccgccacgacgagcgacggcgccatcgccaccggcttcagccccggcgcctacggaccggcggggttcagcaccgggtagtccctcgtcgcgccgcccggcaggatgaggcgcgcgtacctgtcgctcatctcggcggtgaggaacgcgccggggcggcactccagctcggcgcgcgtccgcgtttcccccgccatggccggcatgaggagaacgtgcccgcgcagccggacctgcgggccgagcccgggcttcccgaaccgcaccgccatgtggtgggtgatgttcccgcccgccgagtcgccggcgacgaacacccgggagaagtcggcggcgtcggcgagccacgggtcgcgcgcggcgctgtcgcgcacccacgccatggccgtggcgccgtcctcctgcgcggcggggaggcggtgcttccggggcgagccggtagtcgaacgacagcacgacggcggggagctccgcggcgaggcggaggcaccaggcgtggaagttgggccaccggccggagccgatgcagaagccgccgccgtggaagtaggcgacgacggggacgcgcgcgtcgttggcggcaccgaggtggcgcggccggtacagccgcgcgttcaggtcgtgttcggcgtcgtacgtcacgtccttccactcgacggcggcgtcggcgtcgtcgggcaggtcgacgtggaacgccggctcggcgctgcgccgcaccgtgccgtcgctcatcagctgcaccgcgccgcggcagtcctccaccacgtacggctccgccgccggcgccattgcttgtgtcgtgtcgtgcagatgtttgcgttaatgcgtagaaggtagctgatgcgtcggtgcggtgtgagagcgagacgtggagcccattatatagggaacttggaagagaacgagatgccttctagaatagggaagcttttactcttctagtccaaaagcagagacgtgagaaaaatggcaaataagtttagaagattcttcttcttttccacggaccacggcttataatccaatggcaaacataaacgttgcaacttgcaaaaatagaaaagtagtcttaggataaagcttttacatttctattcttattaccggtttaaaggtttagagaccaaattatattaaaaaaaacaatgaaaaaacacacgtgaaatgagcgtagctcaattgtttaggttatttgtggtggaactagcccatccaaaatcaacccttagacttgacactggtactcccatttactgctaattatttagtggtagacgacatacccttgaaagcgagacgtttatggtgacttcatcaatctcaacaactactcgtaatgacgtaggtagagtgtgcatatgtgtttatagaggtgagtctgcatgctttatgagtatttacatttgtagggtgttctcaagaaaaacacataaattaattctaaattataaattggatgcggcttataaatcatagctgaaacaaacagaaacgtgatggcaactatatattatgcgaatttataattgaattaaactagagttgtaagcatggattatcatggtattttcactttgttcagaatattctgaatatgtcaacactgttattgtccttctggacggtcagctgataattaacttgactgacgaatggacgtagacccagggccctggcttttgttgggctcgtgcagggtgtggccgtggccgtactgcccgtgggagacgcattcgatgacgtcgcgtggttctgctgcgcttgcggtaagcaaaggcgttttcttgtcttctagaagcactcatatttttccacgtggtaggtctgggtagggatgaaaacgctaggaaacggtcggaaaaaccctctaccatttccatttttattttgttttttcgaaaatggaatcggaacggtatactcggaaacggtaacgatatcggtaatgtcggtatatcggaaacggaaccatcggaacgggaatctactgttatcggtcggaagtcgaaaattcatgtcggaaacagcgaaccgtggtatcatcccacatttaactatgtatgaagatgaccttataatttcacccttgcatgatcacgctgccacacaacaccgttatatgatgattaataagttgacaataaggtcgacaaacaatataaacaaagttcaacgatacttcaacatcaatgtggctatagcatacaataggatgatgatgcagtcacacccacatgatgacttccacttgcacttccagatgcagcagattgagatttaaaaaaagaggaagtgattaacgattaacacaaggctcaagctatacatcttaaaaaaacatgctcaaggattaagctgtacatctgcaaaaatcacgctcgcacatcaacagaaaatcgtgctaaaaaacattaaggctcaggcattcatctgtacatgtaaaaaaatcatgctcaagcattcaagctatacgcctatacctagtggacctggcaaacgcaacggtggcgaactcaatgctcatttctctgttgttgccgtcggatagatccagaagctaggatgcggcgttttcctccggcaggtgccatcttgcttctccggcaagggacgcggcgaggcgcgaggatgcgacggctaggactagcaagcggcggtgtggcggcatggacatgtggttgtggcggcggcggcgtggcgaaaagctgtgcgatagcgcgagagtcataagacagggagaggatgagaaggagaagcgacacgccggctgacgccctagggtttttctttccgacctaaatgcctaatgggctgctcctgctagcaaggcccagccggcttccttcttcggaattttgtcggaaatttgacggaaattaccgataaaaaaacggttaccgacaaaacggtcggaaaacaccctatatcatttccgctaccattttcggaagagattaccgtttccatttccgataccgacaattaccaataccgactgaaacggtcggtgcaaactagaaacggtagccggaattttcggaaatttccgtaccgttttcacccctaggtctgggcctttgccctttggggttaaaatcagtgagaatctaaaaaaataattatccagtgtcccgtgcatacttattaaaacatgtactagtatcatattcttatactcttattattatgaattactccctccgtattttaattttaatgtatgacgccgttgactttttaattaacatttgaccattcgttttattcaaatctcttgtgcaaatatgaaaatatttatgtcatgcttaaagaacatttgatgatgaatcaagtcaaaataaaataaatgataactatataaattttttgaataaaatgaatgatcaaacactagataaaaagtcaatgacgtcatacattaaaatatggaggtagtaatattgaagttctagattttattaggtgtcgtaggccccaaaaaaaaacataatgtagaatcgcccctagttgaaataagacaaaaataagaaaaatgggataagcccagcggccctaatgggtcattagaactgagttcttttgagagagtttccaactaaccactctcgtgaaggaaagaagtgcccttgtaatgtacaatgcgtggcctcagttctatgctcaaacatccacatagccttggaatccactatgaagggaaggagtgcccttgtagggtgttagcactacctgcagagggcccggtagcttgggaagaaaagatagaggttagcgagagagtagtgggggtgctacgacgcagtataagcggagggtggatgaccttaagccagggtgatgctggcagccggacaacaagaaatggcgatgctccaggaagcatatggcaaatccaagtactacgagaagcacctcacgtgcactgcttgtttgccctctccatcttgatgtcagcacccaacgcgccaagctacggcggggggggccatcaccatcccccgtctcctcgatgctgcctctgttcacgtactccctccgtcccacaggctataatataagcgatttttagttttttttcttgcaacgtttgaccactcatcttatttaattttttttgcaaatataaaaaacgaaaaagttgtgcttaaagtactgtagataatagagtaagtcacaaataaaataattaataatttcagaattttttgaataagacgagtggtcaaacgttgcaagcaaaaactcaaaatcccttatattatgcgacggagggagtactagttagctccacgcctgtcgtgagaaaagaagaaggcctggtttagttctcaactttttcttcaaacttctaacttttccatcacatcaaaactttcctacacatataaacttcaaacttttccgtcacatcgttccaatttcaatcaaacttccaattttgatgtgaactaaacacacccgaaataaggttagcgaaacgcctttgctagcgatcaggaaaagccatcccaagttcatcctttagccattgtagccctgtcaccatgtagctccattcggcacggcccgcacctgggcacgactagttgtgttgtgccatgcccgcccatgggctgtacctacggctcaggcacgtcccaataaaactcgggttgtgccatgtcggtccaaagcaacctatcgtgcttgtccttggaataagtatattttgcctccctcatctctttgagtcacgcgttatatagctgaaataagtcttttttctctccctcatttccttcggttgtgccttatatggctacaataagtctattttgcctccctcatctatttgggtgggccaccttcgggctatggcctacgggagcgctggtcgtgtcgtgccgggctggcacgtcctgtcgagaaggaggtctaggcatggcccaacggtcgggtcgggccgtgcctaggccgggccaaaacttcgtgccatggaccaggctgttgggctgcgggccttttggccaactttaattggcccactccgcctcgatctaaaccgcattacataaggaagacaacctcgaatctgagcttccctaaagataggtgttgaatacagaatacgacattcctatggagacgccatcgaattcgggctttcatagcgacgacaccatctctatgttaaggaggaaagagatgaatatttgtttttcagagtaaagagatgcagtttgtagcatttatttaggttgccgagtgggtcaacgggtattatgagatatattttcctataacgtggtccttattgtaaagtttggacagaagtacaaattaaaatgtagtgtaggggcttaatcacgatcaaaggactgaaatgcaaaagagttaatttgtgggcccgttggggttatcacgcgtcctgtttaatattaaatcaggaaatatgttttagttgactttattgaattagagttaataatcaagtacctatagccactaaagtgatttattttattacccattagggtagaggagtcaacggttctatggaaaaaatgaagtcacatcacatgacaagtactccctccatttaaaaaaaaaggcaatccatgaattttcgtgccaacgtttgaatgtccgttttatatgaaatttttttataggtagtattttcattgttgttagatgataaaacatgattaatattttatgcgtaacttatctttttaattttttcataattctttcaaataagacggacggtcaaacgttggacacggaaatcagggtttgtcttttttttttgagacggagggagtagctgagcatggttgtgacttgtgaggtgctcaccaaggcatgcagttcaacctgtcatccatgttatggagtatatatattcgtctatggcatggagtatatgtgttttgtagattgcaacttagaaatggtgtaagaggtaaccatgagaacatatgtgaatcaggaagaaattggcccccaccgaaagctagtcgaacagagaaacctactgtcaaaaggatattgtcaacatcagttaccgattaacttattttaaaagtatgttaatagctctggttggatggtcaactttccccatctcctctcctcccaactttcccctttgctacagtagctccttcttcttctccggcccctcttgccccccaaattccggtggttcaccgccggtgagggttggaggaggggtccggccacctctcctattagtacagtgtagctaggttgtagtttctttgtcaggtttttcctgttcctgtggctatgtctcatttggttacgttcaagcgaagagccctggttgctggtggtgatgattgccggagttggagctgcgacttgaaggacagaatcttcttcttatgctggtgctgaactcgttggtctgcgccgtgtgcagacggcggttgccttggatctctggatggcgctgcttcgtacagcggcggtggcggccctggatctctgggtgccggtgctctgtgtggtggcaacggtcttgaaatttctggcgatgttgctccgagcgacaaccttggcagcccaagtgttgctgctctgtgtggtagtcttcaaactccaggtgctgttgcttcttgtgatagccttggagctcttcgtactactgctccgtgcgctggtgataccttgagctgctgcttttctgcaacggtgaaaacattgtgtgggtgtggcatcttatttctccaatctgaaggttacttcttcgttgggagcttgctccttttcatttgttgtggtccgcttcagttctacaatcctgcagcaatcctcggccttctacaaagacagaagttttatcgcaaccatctgatttctcatgtcatgtggactacctgttctcctgaatcttgcttccttttgcttcaaaacagcagtatccatgcagggtctatcattcgggttgagcaatctctgctcctcatatctaatgaaagactctatggaaccaatctgctgagtccggtgatacctacaccaaaatctacggctcgacaacaaacctctgatctgtgccgtttccgtggtgacagctgtagtagccttccagtctgtcaagcggtgtgcatgtcaatggaggccaaaggattcaatcgtcgtggctttgccgcagaactctgtcgatctaattccctactgttgttttgtttcatcagaaagtttgcttccttagagtggttactctctaccttgttagagatggtttcttggcttaagttgtatccttgtgcgatgtactggggtatatcccctaaattctgtcttgttgaataaagttgttcatgttatcttcaaaaaaaaagtatgttaatataatgtataatcattcaaaatgttataaaagagcatgcacgctaaaggaagaaaataatattccctaaaattcactcggaccaagtttaggtcaaatgagtggatcactggtctgcaaactaagcagaataatgcatatatctatagatgcagaaaaaaaaaagaaagcgaggatatagatgtaattttttttgtcaggatgatcaaagttgaagggggtgtgtattgtaatcgatgtaaaccttactaacctgttgatgaactcaaatacaggtgttgcaaaaaaaaaatcgaaaaattttaatgtctagtttgccgtcaaaattttaccacggttaccacaatctcttatttggcctttccatcaacatattagcactactaagctggagtagtattcttttagagagcattgccaagcttttggcatcaattcagtaattgtatgatcacattacgatcactgtatgccacgatcataaactgtaatgttcggataaaaagagaattctctgggacttaaaaattccactaaagatcaaggtctttatgtaatttctttacaagaaagtaattctaacgaaagataacctagctaaaagaaaatgggggagacaaacattgttctttctgctatgcacaagagacaatccaacatcttttctttgtgtcatgtcgctcagtttgtttggagatatgtgttttttgcttttaatatcccccaccccgtaacgccaaaaacattttcggtaattggcttagaagggtatctaggtccattaagaagatgattctaattgaagttagtgctgtatgttggtcaatttggcgttgtcgcaatgataaagtttttaatggtaaacaactatctaaccctatgcaggttatcttcatgtctttctactggctccacttttagtctacaatgctaccacaggagtagcaggatactatgcacaatgttgctacactcttggaatcggtagctaagggtctcttattccactatgggtggcgtaattccataagaattgctagctaaaatattttatgtggtttaacgctagtcaataataaaggggagttggggatttgtcccatcactttatttctcattttgatttacttttatcttacatttttattactattaaatttatagttgtgtgtcttatgacagaagccgaagatgtaatccatttctattatctaaaaaaaattacgatcactgttctctttggtgtgattcgtttcgtttgggtaataaacgaaacaggaagatttgtctaggattaatcacaagtaacgtgaaaagcctatatagtactgtgttggagagggaagcttgccaattttttcattttctttcgagctcatttcactctaatttctatttgactccctcatcctaaatgttcgcactgaataaggacataccacagggaagaaaaaaaaatgtactcaatctgtcccaagtcagattcgtagtcttagaaaatatcttatttggtctaaatttttatatttttgaatggaaacactatattccttttgttcctcagaaaataataataaatgcacgctgactttattacctctgcttacggtcactgtcacacttccttcgcagccatataaactgcgaccactatttcacaacaatgacataaatttgtcgacctttgttgcttgccattgtgcccaatttgtaaccacaaaaaaaaaaaacacaaatgtagtacgaagtaattaagcttgtctcaattattgttgcaaggacacagtgcctgccaccatgtcgcatctgtggaataagcctacgaacacgtggcgcacgaggcaaaccacctcgccgtcgccggcgttcgctcgatcacgatcacttacgcggcggcgccggcgatgaaccgcctgatgacctcgacgagctcgccggtggccgccgacattggcttcacgccgaagaacgcgtgctcctcgccggcgaacaccaccagctccacgtccttccccatcgccttcatccgctccgcgtactcgacgttcttgtccctgaggaggtcgccgtcggcggcgaccaccagcacgcggccgacgtccaccgcctccaggctccggctcgccggcccgaacgggttgacgagcgggtggtccttgtcggcgccggcgggcagcgcgagccggcagtagcggtcgcacatgtcgcgcgtcaggaacgcggtggccggcgccgccagctccgacggcgtcggcctctccgagatgaacgccggcatgaggaggacgtacccggcgaccctcaccgggtccagccccgccgcgccgaaccgcacggcgaggtggtgcgcgaagttgccgccggcggattcccccgagacgaacaccttgcgcgcgtcggccgcgtcggcgagccacgggtcggagaggagctggtcgcggagccagatgagcgccgccgccgcgtcctcgtgcgcggcgggcaggcggtgctccggcgcgaggcggtagtcgaaggagagcaccacggcggggagctcggcggcgaggcggaggcagccggcgtgaaagttgggccaggtgcaggagccgatgcagaagccgccgccatggaagtacaccaccaccggcagcttctcctccgctccccccgtcgccgccggcctgtacatgcggacgccgagtccgtgggcggcgtcgtacacgacgtccttccactcgacgcggccgtcgtcgatgtccaagcgtacgtagaacggcggcggcggcgcggcggcgcggacaaccgtgccgtcgctgagcagctgcagcgcgccgcggcagtcctcgacgacgtgcggcggcggcgagttcgggtcagacaacgacgccattgccggctgcgcgcgcgagcgtttgcttggctgcgaacgaagctcaatatgcttatctaactagctgagcgcatccacgatccgattgatgaggctaaaagctaaaaaccaaaacgtttcgttgtagccttcggtcgcggagccaccgcccggcgaccaaagtagaaccgcatctgtaccgttttcgtaaaactaatataacaataatatttttaccgatggttactgtttttaaaatttacttttttttaatttctattagcgtggcattgaagtttacattaaatagatgaattcataaatatgaaaattttctggccatttccatttgttttcgaaaaaataataaaataataatatcgtttcagaccattttcgaccgttttcatccctataccaaagtagcagtggtccggtcaggggttcaatctttcgttttcagtatttgtatcaagtgggctgatatgacggtattttcaaaattttgaacaaaatttagtctaatttaaataaatattactaaaattcatgaaaaaattaaaaaatttggccgaaataataccgtattgagggggttgatataagtaaaattttgaaatcttattccaaaatttgatataatatagaattgaacacaaaatttttatagtaaatacttgtagttagatttgcccggacaatgaaaattttctagctccgccattggttgtcttgtagttgtcgtaggacggcatgcactttgaaaaaaaaatgttatttcactttcgtcggaaaaaaatgtgattacttttattttttatttaaaaaatcggtggaggtaattcgagcatatcattgaaaaaaaaattatttcactttcttctcaaaaaatggattacttttatttttaatttaataaatccggggagataattcgagaatattactgtgtcaaaaaaaagatgagtttgaagatgatgacatgccaccgaagtttaattaaatttttgggcgagaaaatgtttaaatgggcttaacttattctgggctgtcggtgcggccgatgtaagggaagggaggaccacgggccacggaccatcaacaacccatttgctgattgctgggccagtatacgtctcaatacgaaaaggacttgtatttatgtcgagttgtcgactgatctatctttcaccaaaaaaaaaaactcggattttccaacagtgtatatcatatcaccagtataaatcaacaagaaaataaataaatgaaaagaacaattgtatccaatatatatcgtcgcttgtctctgcacgatttcatttatattttcaaatgcataactgttagcaagtggagttgcaaacttgtagagagcaaaaaaaaaaaaagagagaaaaaactcggattttccaaccgtgtatatcatatcacgagtataaatcaacaagaaaataaataaatgaaaagaacaattgtgtccaatatatatcgtcgcttgtctctgcacgatttcatttatattttcaaatgcataactgttagcaagtagagttgcaaacttgtagagaacacagatcaaaatacagctcccatggagagtcgaaccaaaaacctaaggtgttagggaggctattgtaaccattaagctacaaaccatttcggctttaatattttttttaacccaaacagcgcttaaaagtgaaaagtagttggtagatcctaacatctaaaatgaggattataccataacatttattagcgatattaaaaactaattaaggatcaaaatttgtgtacacgtgtttttaacgacttaaaaccaatattttaaaaaataaactacgataagaaaacatcaaaatcaactataaaaacaatttataaaattgaaatattggctacggatgacaagatgaagacgaaaggatcaagctgcaaatctcccgcgctagaacactggagtagtacacaagtcatccgagttccatatcttggtttacttcggacgatcacctagccggcgtgcacgaagcgcctgacgacgcggacgagctcgccggaggcctcgctcatggggtcgagcacgaagaagccatggccctgcccttcgaacttgacgagctcgacgcgcttccccatggcctgcagcctcgccgcgtagtcggcgacgcggtcgcggagcacgtccagctcggggtccacgatgagcaccggcgggaacgcgacgccgtcgagcggcgggctctccggcccgaacgggttcgccgccgggtggtccctcgtcgcccccgccggcagcgccagccgccacatctggtcgaacagcgtgatgcccatcgccgacggcgacgcgtcgccctccggcggcggcggcggcgcctcggatggcatcctctcctcgccgccgaagtatggccagagcatcacgcacccggcgagcctcgccgcgtcgagcgcgatgtcgccggagccgcagccgacggtgaggtggtgcgcgatgttcccgccgcacgagtcgccgcagacgaacaccctctcgaagtcggccgacgcggcgagccacgggtcggcggcggcggcggcctgcccgcggagccacgagaggacggccacggcgtcctcgtacgcggcggggaggcggtgctcggggccgagccggtagtcggcggagagcacgacggccgggagctcgccggcgaggcggagcgcaccggcgtggaagttgggcagctcgaagctggcgatgcagaagccgccgccgtggaagtagacgagcaccggaagcttcccctcctcgccgccgtggttcgccggcgcgtacatgcggaggcggagcccgcggccggcgtcgtagacgacgtctttccactggacgggcaggtcgatcgggacgtcgcgcatgagcgagatgctggagtagtcgccggaacgcgtcaccgtgccgtcgctgagtagctgcacgatgccgaggcagtcctcgacgacgtgcggcggcgccggcgaggaagacgacgacgacatggtggtgcccactgcccacttagcttagttgtctcagcacaactgtacgggtgacgtctataaatagtactaaagctaagcgcagttgagacgtgcggtatcaatagaactagatatccgggcccacgagtcagtgacccattgtctcgatatccgggcccaagtggcagtgatccatttgtccattgactttgggggcagatatctagccacgtggcaagtatagttgactatcgtgtgtgcatggttgtgccacgtcagcttcttcacgtgccaaattgccctgctttgctgctgaagttgaacattaggatgagaagataaggctgaactattcagtgttttgaccaagccagcatgcactagtagtaacaatcaaagtaaagggaaaatggctggatacaatgagttcctccattcatcaagtgaacaacataatagagttc

SEQ ID NO: 16643 - DNA, 207 bp, Oryza sativa
atataggtgggcctcagctttctccttctttcgacgctcctttcctcacgatccttttctaatctaatctgaaagtggcagaagaattagactaaactaaaatgaagaattgaataactaaaaaaccttaggtagcaacttactcgaaggtgctctgctatgtccttctcatccacgttacaaattattttgtccttgtcactttcg

SEQ ID NO: 16644 - DNA, 27686 bp, Oryza sativa
attgattggctagcttgacaatattgattcaaaccatggctatgtcctattggcttcaaatcatatatagttaatttaatagctaattcgtacaatagttatctataaacatgtactacataattaatgtttggtcccacctatcatacacacatgtatcttaaagtttatactgcagctggctataaatctgtagcctgttgccccgctacttttatatcttcttttttatctatttaaaatatgtatatagacggctatagtctcttattcagtctgttctaatgcagacaaattgataggcttcggataatgtatcaggagaaaaaaaaaacagtagcacagtaggtcgacctgcatataaagccgaaatttacagtttcacgtgtgcaggtatacagtttgacagtttgtgcatgtagctgttattgtacgaaggtacgatgtactgttactgtacacatcatcatgctaatcacttgtgattttcttggaccagatcaaatgaggaggagagacattgtattcggctatagtacctaacagatatgagttgtcagtttttggtcttgtgtgataatgatccaacaatcagattatcagagagagagagaggagagtgtgtgttaagagtatacaatggtgtctaataacaggctctcttcgttatcatgcaagtaaatttggtgacgtggaagaaagagatggaatgaatgagaaacatcgttgctacgcatgataacagcttagagtcgactcttagcatttattaacgaaaagtttgttgcatgagggtgtagaaaaggaaagaagtataataaaaaaagatatttagtacattaatggtttagaaatcttattgtctttactatcattgtagaaggataatctctagtgatattaattaatataaagagctcatattagactctacctttgtacatgcaatttgcttctatttagagttactgcattcttatttatcatgagcatattagaatatagtaactcccaatctattaaacaatgtgttatttacataaactttctttataaaagtctctttaaaaattcaaataaatctattatttcaaaagtaatactcaagataatcacttgtcttattttacgtgcagttgataagctcagccctaacctttatattgaatcaatcctaaagtatgactaaactactaaaactctaaattaagctgcaactgtaaatacattcatcaaaatagtaaacataaattagattatatatgataaatatgtccctcaggactataaacattcgggcactggtagatatgcacacatcacatgcccagataaggtagatctagcagcaggccggattattatggtttcatatatggatacacatcttctccaaagaatttgtaatctagctcccatgatgatcttgtatcttgtcttgttgatcttttttcttagcaacatgacatgaaggtgcatggtcccattggatatggcatggattgcaaagattcaactcactgcagagccacttgcaaagattcgcccttactgcaacactcttggcattaaccaatttaattccttccaagtgagttgcatggaaatgtcaaagtatgttgcactcagcaccacaaattacaggagtaaacaaggtcaatatgtacatatgagccctacttattcaaggacctactccttttatctcaaaatataaagaactttgattgggtgtgacatattttagtactactaatctagataaaaagcatatctagatttacattattatgatgtattctatccaatcaaaatttattatattttaggacagatggagtacatgtaaatgaccctgatacaggagcagtgctgtagaggatttgagttcttaacatgtgtaactgtgccttacatggttgaggtcatcactcttacctgtaattaatttcagggaataactgcgaatatttaaatatatgctttttttttctaaatgccagtcgctaaatggcttcgatccttttgcccccatcttgtcgaagtctatggactagataaggactactaaaagttccactgttcacatcattaaaaatgtggggagatcagaagcatatttcatttaattacactttcttacaagaaagaaatgttattttactggggaaagttaaaacttttagtccggtaggtgttctatcaaatccaaaaaggaagaagcttcagtggagcacaggccttttgagtagctttctttcatgtgccttaacttgtttgcttttctatctcttgtttttatttactacttcttttttcccctccggttatatttttttcttctccctaaggtcacttttgacacctgaacttcatataaattcataaagttccgtagaaatccgaggtccaagagttattcatttgctgcaatttaattttctttttcaaatgttcttgttggcttagcgaggtaggtttaatgggcgaacattcacatgcctaggccacatgccagcctaccaagagacacatgtctataaattttaagaatacaaaactttctggtatagaaagtttctagatagaaactttgattctaaataggaataaaagaataatactaaataggacaaggaatataaagtataaaccattgatatataagggaatgccccggatcggtcgctcggggagggagaagtatcgggcgctcccttccccccccccccacgacgcgcgctgcctgcctctgggccccaccacgtctctgccctcacctgccacttatctccaccatatactccattgcaacaaattacccacatattttggaaaccctctattaagggaatttggtttattttttgttccaccaaaaatgtttcatctagtgcaatcaaatgtttcactatgtatagatctaatgttatagtgaacagaaatactctattgcaacaaatcacctacatattttaaaaaccctctattaagggaattcggtttatcttttgttccacaaaaaatgtttcacctattgtactcacaatgtttcactatatatagatctaatgttgtagtgaactgaaacattctttcgctatttgctgaaatattgtttttatataaggtgaaacaacaccctatttaaacgagtgaaacattttcgatctacttagtgaaacaattccgatatacctagtggaacatcgtgcaacatttaaaaataaattcaataataagctaattttttttcgtcgaaatatatccatgtgtggtcttgttttgaagatttaattgcaacgaatttaatggtgcaatcgaatcatgatttagataagtaatttaagagaaaaatcaatttaaaatggttttacacgtatacgtggcgctgacgtcatgctgacatcaacgcccgattttaacccctcccatcgggcgtccaagctggagtcatttccatatataaaattaccagaaatcagaaagagaaatacaatataaaaaaacaaaatgcatgccgtttgcttggtgaaagagagagcacgcgcatttgcccattagcctttgccctttgggtttaatgtggtgatgctgctaatttcaacaaagccgaaaagttttgtaaaatgtgtttggtttgttatccttatccttatcagatggtaacatcaatagagttcacaacatctttggttctactgccttacataatacccttacaatctggcaccctagtattttacattctacgtacagtactgtacttaaaaacccaaacatccaaatttacccaaaattttttttggcaaagatataaatcaccgatattttacaggactggctaaaagcaaagatactgcatgcaaatcacacttggacatccggttcattttactccgctgatgtctcatgacaacacacatcacatcacatcattgacacgtgacaaacacccgtctctcctgcacatgtcgccctcgaccaaaaggagagtgaaaaaaaaacatggactgcacgaatctcgatgcactaccctacttcggtggcggcgctgccacgtcgacgaagcgcgccacggcggcgatcagctcgccggcggcgtcggagccggggccgagcgtgaagaacccgtggtgctcgccggcgaactcggcgagctccaccggcttgcccatggcggacagccgctcggcgtagtcgacggcgcggtcgcgcagcatgtcgaggccgccggcgacgacgaggaccggggggagctcgacgccgtccatggcggggctgtccgggccgaacgggttcgccatcgggtggtccctcgtggcgcccggcggcagcgacagccgccagaaccggtcgaacaggtccaggttgaggaacacctccgccgggcaccccgcctccgacggcgtccggctgacgccgccgaagaacggcattagcaggacgtagcctcggatcgcgaccgggtcgtcgggcgccgccgccgccgccgagccggcgcgcacggcgaggtggtgcgctatggtgccgccggccgagtccccggtgacgaacacgcggccgaagtcgggggcctcggcgagccaccatccgtcgccgtcgccgtcgccgtcgacggcgcgttcccggagccagtggaggaagcccgccgcgtcgtcgaccccggcggggaggcggtgctcgggggcgagccggtacccggcggagagcacgacggcgccggcgtccgcggcgaggcggaggcagaaggagtggacgttggcccacgtgcacgagccgaggcagaacccgccgccgtggaagtagacgagcaccggtagcttcccgccaccgccggcgccgacgccgccgctcgccggcgacggcttgtacatgcggacatggaggttcttgggcttgtcgtagacggcctccttccattccacggaggggtgctcgtcggggaaggtggaagggcagaacaccggccccggcgaccggaggatggtgccgtcgctgaggacgcggaggaagccgacgaggtcctcgacgacgttggagcacggcgcggcggcgccggcggcggacacgacggccggcatggttggcatgtttgtgtccacaagctgttgcgacactcttgagctaagcaagaatggagtagtaatcacctaaaatcacactgcatagccacctcgcttatatagccacacaatgtacctgctcctaattggattaagttaatttacatctcttttcattagggatgtatttagataaaattggtttagattttgtttttaggctgcgttcgttttaggtgtttggcttagccgaacaattaagaaagctttgattttttttataaataaaagtataccgtttaacagtttaaaaatcatgtttacaataaataaaaaagtagctccctgtaagcaagattagaacgggaccttaatttttgtaacattaaaagtcacccggtttactttaattgcaccgaaagatcgtttcgttactgtatattgtattttcgcagtgcacggtcaagttcgacgccggtggtcgacaacgtaacacccgttgctcagatcaacagcggtatcaacatcaacagtagagtcaaaaattttgcagcttgctgaacagggagttgcaatctgttgcaatctacacacgtgcacgtaaaaaaataaataattgcaatctggacgccttgttgccgctgtacaaacagagatgatccagcctgatggataggtgatatgcgatgtgcatctaggggtgaaaaaatgtttcttggtaggttagaaattttatatttattatcaatttaactattcagtgacgacttcaatatgacattgatagaaattacaaaaattaaattttatatatgtagctagaatcgtaaactgtaagaaatgatatcgcttctacagaaagataaattgcatccaattgtactcgtgaaattaaaatcgttgctcacgtatgccaatgccttcaaatgcctttcatccaaacaaataaaaccttccagctttgttatgtttttcccataagtgtccaaattaaaaggtagtagtggttagtacttgatagtcaagggtgacttatgcaagttaaatcttaaccaacccatcaaagttaaagtggtttgagtgataaaaggtggaatattcttaattacacttcagggtgatgctgtcacccaaaacttcaaaaaatggtgaactttcatataccggagagtctatcaagcatgatgcataggtgtgttttatagcagccgtggtgaaaactcccaaaccttaaaacaatggtgcatttcttatatttaaagcactgtcaagtatctagagaaagcctctgcgaaaacttcatcttcattattaaaaaaaaagaagcacaaggccaattaatattctgagttacgtgtgcatcagccaatttaccaaaaatactgctatacatacgataaaatttcttatggtcagagcgtatgatacttattctcttgtgtgtgcggcaaatatggggctcgggatgtttcaacccaatcgacaatcatggaaggtagtgtcgtactcccaccaggatgataatacttgtcgttttagacaagagtgaggtcaaactttagaatctttaattatgaatcattttaaagtattcatctttcaaatacagtgactatatatatatagtcactgtatttgaaagatgaatattttaaaatgattcataatcattttatgtatatatatatataagtactttaataaaatcatatatttgttaacacttttatacatattataatgataaataatggtcaaagttagtttttgaagaccgtgctcgtgtcaaaagtgataagtattatcaacccggagagagtaataaaattgtatcagtctcatcatagcaatttccatttacctcaaagattaggatgatgaggaaaagaccaatacttcacttaattcttaaacataatatacaaacattagatagtttgattggtcatagtcacatcagatggtggtacaagtcaaggtgtccttctaggttgtccaaatgaaggtttgtaatgtatatttattcaaccaaaagatgttttttcaaagatatagtaggccaaaatcggtgtgaattttgatctatatattgttttagagtttgagccattaaaaaatatgtaaccaagcttgttataatagatgttttcataatattacacatataattatttcagaatttatgcagggtaattgagcaaccaaagttgtgccctttttacttaattagaaaagatatataaagacattcttttgtaaccgaaagagtaattgctcaataaccagcacaagaaactagcactgtacctgaatcattggagcacactaagagggtgtttagatacatggtaaagttttagtgtgtcacatcggatattatatagggtgtcgcattggatgttcgggcactaacaaaaaaaaactaattacataatccttcagtaaaccgtaagatgaatttattaagcctaattaatctgtcattagcaaatgtttattatagcaccacattgtcaaatcatatgaagcaattaggctcaaaagattcgtctcgcaaattagttataatatgtgcaagtagttatttttttactatatttaatatttcatgtaggtgttcagacgtttaatgtgatatggtgtaaatttttgtgtgggatctaaatagggcctaactgaaccatcctctcaaaatgtgtactcaaatatatcgatgaaagtgactattatttgctaggattttgtggtgatgagtccttttttagttgtttttgtcagcataattgattaattaattgagtatcgaattgatcaatcagaggctatggcccccatcaccttttgcttattttggtttaacaatgtccaacttgtgtcatggccttatgagttggctgaatttggcgaattgcatcatgtccatgagatcacaacgcattatgtatgcaaacatatatgtacaaaacctctttagtttgatagcaacgttgagttgcagacacattggagttgagtcagtccatggcagctggagtgttactagtggcgcgcacacacacactgacattggtgaatttagtggccaccattagtggactgatcatgtaagtaactaagcacttttaatcgatagttgtatagcattatatcacttcatctttagcttgatgtaattaaatatagtggagtctgtggtaatttgtgatgtggtagcaggttaactgaactcttgacctcagctcgataactttttaactttttttttttgcttattgtcattactcacagtcactggatttatccatccaacatggacatgcatgctatctccaatcataatgtcaatttataggccattgttgcctcttttttagtctttatattactagacttcagagcaagcttgtgaaccgtaatattaacaaagttaagttgaagtgctatatactcccttaaaaatttgagcgtattgaaaccaaaggattattaaacaatcctttgacttcttttacattatagtgacatctccattaaaaacaagaaatggtggtgcgtttatatgatgagaaaaacaattcaaagcatggcaccgtgctactgcatgctatagtaggtcagcacattaaacgactacaaattgagttgaaatatcacaaaattttagttcagttgtaaacatcaaagacaaattaggagatacttttagagatgatacccctgcaactgtttcaagcaagcgacaactgtcagcagctctgatgaatgtggcacaggcgactgaatgttcagttccaacctgatcttgaaaaattcagaaagaagccaaatgttctactgaaaaaaagataacattgcaaagtttggtcagagtagaaattccgtcacagaaaaaagatggtcgtcagagtaatctcggataggcagaggcatctctttcttaattaataattaatgacaaaagagccaaatctttcatgaaaatccgggcgacagctgacaaaattatatctatctgaaggagaagccttggaaaattgaatggattaagacttcgaattattaaagattgcatcaaacacaactactggaagatcaattcatgcatgatggcacactgaaaaagattactttcatacttaaaaaaaatcttgaattatgggactagctaattaactaagaagaacagttcagagcgaccgttcttccacacgtctgcatcatctaatatcaaaggctggactggtcctgttgctcttattacagctgacagtgatggaaggtagaagaaacgtcatgaacttatccaagagatagatagatagaaatggtgatggatcaagagatgatcacaaaaccgaaaaaaaaaaggcgaagaaatatgaatcctagcttggagatggatcagggaccatcaggtagaatatatctgctgtgatgtccaaatccagatatcagaacgaaaaagattgtcaggttccgttcttttctctaacaagagttggatgaagataaagattttcgtggcacgcttttcaaacagctaaacggtacgtttcgtgtgaaaactttctatatgaaagttgctctaaaatatcatattaatatattttttaagtttgtaataattaaaactcaatcaatcatacgttaataccacctcgttttgtataaaaaaaaacttaatcttcatcttcaggagaaaagaaaaccaaataagataaggtttcttctcgtacgatttaaatttcactgagattttgacagccagaagccccattggtcagaaaaagatttgaagccatgtgtgacaataacacaatctttttgggtgaagggagaacaaaaatctgaaaaagagaacagtgagttggaaatttggagagtatgacaccatgtcacaccctcttaaccactctagagtcttcatcgataaacacaagcaatggtagggcaaaaaggagatcacaatgatggaaaagaaaaacctggattcagaatcttgtaagcctcaaacatcatatttgaatactcagggacgattacatattcctcgcagaaaaaaaagggacgattacatattagaaatagactactattacaagaaaatttactgcataacacttaaaatggacacctaaaaacccggtaatttgatgaagtacatcatcgtcattattttattatttatgcgccatataaagagaaacaattagaaaggacaagtttatccctcggaccaacaacttctaacctaactgggtttaacttggaccagacccaagccactttccctccctagatcccctatttagaaccctagaaattggagatgcccacggcaagcagcgacagaagcagcgatgagaggtgtgaagcaaagtatgtctgaacccgctacttgctaaggtttttgagagagagggtgagcatgttaggagagagcagatcaatacccatagctcgtcgccgccgtcgtggatgccattgccactatctccaatttctatggttttgtagattggattaggaggggggtggcttagttggtatcgctagggttttggagaggggggattgtcatcggcatagaatgtagctcgggtctggttgggattcatgacgctggcccaaaaaccatttccgttcaagtgtactatagcaaattttgtcctatacaagggactttcttactactctctttcttcagaaagcaaagattagttttatcagaggactaaccaaatctgaaatcacaatttgaggtggatacggaaccaaccattgagccttggccttggttcgatgctcatgatcaggccgataagtgtgggccaacgtgccgggccaacatatcagcccatcgtagcccactctgatgttctttaccgtttcggacttaacactactaacattttttccattacatggcaaacacacacacatctctatctcttctcttctctactattaaaagtttaaagtgtttttgcttgaaaattttgtacgtcgtccgatttgtttctgttgtcgtatcggtttagttcggcacgattcagtcgccgttcgctcgctcggactgacaatgaagattgaatctagctatgtaaagaaaatgattattttcttgctttatgtgtgcaaatttaattgggctacagaaagctggccgaactgacatatatgggttgtatacttgaggggaaggaataagtctattctacctatctcctgttttgtctatgatcaaatggcatatctcaacccaaaaccaggtataatgcttctctcaacttaaaaaatcggtgcaaattagctcagctccattaatggtttagacaatggtctatgctaagtcagtaaaaaaacttttaaaaataatagtgggacttatatctcattccttctctatctgacacatatgtgtttgcatcataatttggcatttagttagtatatttgggcaggccaaattatttagaataggttgctggaattatcatgtggtctgcttgagagtacttcgaagttcgaagtatatatgtgcaggaacttatcatgcattgctcggctgatctgtgtaagatgctggggagcggcagccgtttagttggcttgggctggtcacatgcatgcagcagtagcataggagagtgagatttggcgactgagatcaatgtttgcatggtgattttactggcagctggctgcattagtttgcgaggcggttgttttgcagggtacacaaatgcaaatggagttgtgcacaggagggtgatcaagccggtgctggaatttgtgcagatggatgcgtggcggcgtggctcgtgttacactggaggtgctcggtttgatccacgcggggccgtgccgcaggtgacaggcgttggaggactaccgaggcgagtaaatttgcctacgataagaccgtcagcgaacgagatcaaatgcagttgctactaggactgcacattaactgctgtacacaatctgaaccatctatgtctgaatctaacggccaaaaaagattcggcacagtaaaatcagaatagtaaatcgctacagtatttgctacagtatttatccaccgatagatctgcctcaattagagccgtgccaagacgtccatacttggtgtgaaatgatatccaataaaaaagatgtctctaagaaagacttgtgtaccctaattcttcttctggttgtttgtgagatctaaaaggagagaaatcagcgtgtctcagaacataaggagactgtagaccctaaaccgttggccaaaataaaggaataagcaagaacttgggttctggctaaagaaaaaaaaacttagagagtttctttcttcacacgtatagttatgtatagcatttttttttctatttccctattggggtcgtacttttctctcgctatatttaatgaaatagcaccatcttatactgattcgattaaagaaagtttcgctaactttcagagggacatagatccttaatagatagcgttaccaaataaagcagaataagttctctaatttttagagggacatgaatctttaacagataggagtcactctcgtagactcatgtcagggacacccatcagttagaggagcctctcgcaaatcaagctgcaatatacgcaaatggctggcaatggatcatatacccccttctgaactttgaacatttgataaatgaattttctagcattttgaaatccgaatcgatttattattgccgacaaggcacacacgagagaggagcacgcggcggctgatcagccgtcgaggcgggcgccgccgccgccgtcggtgtcaacgaagagcttgacggcgtgcatgaggtcgccggaggcggcggaccaggggtcgatggtgaagaagccatgctgctgcccctcgaactccagcgcctccacgggctttcccatcgccgccagcctcgccgcgtagtccagcgcgcggtcgcggaggaggtcgcgcccgccgaccaccaccagcgtcggcgcgaactccgccgcggcgaggtcggggctcgccggcccgaacgggttggagaacgggtggtccgccgtggcgccgcccgccggcagggagagccgccagtagcggtcgttgaggtcgcggttgaggaacgcgtcgtcggggcacgccgcctccgacggcgtccgctccacgccgccgaagaacggcatgagctggacgtagccggcgacgcgcgcgggcgccagctcggcgcgcccggaggcggagccgaaccgtacggcgaggtggtgcgcgatggtgccgccggccgagtcgccggagacgaacacccgcccgaagtcggccgcctcggcgacccacgtgtcgccgccggggcgcgcctgcgaggcgagccagaggagcgcgttctcggcgtcctcgaacgccgcggggaggcggtgctcgggagcgaggcggtagtcgggcgcgacgacgacggcgcccagctcggccgccaaccggaggcagtagttctggcagttgggccaggtgcgcgacccgatgcagaacccgccgccgtggtagtagaagaacaccggcagccgcccgtcgccgcgctcccgcggtcggtacaggcggacgccgagcccgcgcgccgcgtcgaacaccgcgtctttccactccacgctcccgtcgtcccgcaccggcgtcgcgaacccgggcgcggcctgcgctccacggcgccgtaactgtacacgaacagcacaccgggggactcgttgaccaccacgcgctccgccgccatggcgatggatggatggatcgaagcggaaggagatcgacagtcaggtgcaggtggaggtgaaagcgtcacgtgtggtgatataggcgcgtggagtggtgaaggtggttccggtatgagatgagacgagacgagacgagacgagaaaggcgtggtgccgtctcggccggcacaagggtacaaaaaccgttccaggagttctttcgttgcatgtacggtcggtctgtctggcacctgttgttgatagtcaaatttggcatatatgataataaaagtttatatggtatgattcggctgttaatcaagcaaatagcggtaggagaaaattagttagtattgacctggatagagagctaattatatttgtcattaattaaattagatgaagcaatttagccgaagctaaccaatattgaagatatatattagggattatctggtagcagtgaaggttaaaagggcgaggtatgatgcgaagtaggcacagaagatctcggtgcacactatattcagaatgcagcaggcaagaaaagcttccaacagaaatccgctggattgcctaccgtcattagataattgtgtttcctaccttcaatcggttaaaataatgacgcttaatttactcccagtaaacgtggaacatgccaaagaccaggcgccctacatatggttaaggccgattggagagattcccctctccaacccaatcaataaattcattatagttcttttttacgttcttcttttttgctttttcttcttagaagtagatcaattcaattttctttgccgattagcttgaaaatcggtcgctcattgccgcgaaagcgtaatggttatcttgttatcaaaatttgttcttgacgaaccgcgtgttggcgattttcgacgccaacatctgttttttttctaacgaattaccgacgcttagagtgtaccaatttcattaaacatagtagaagtaaaaggtgtgtataagtatgaaaaaaactgtataagaaaaaccaaagctaaagatgaattctgggagtcgtttcccttctgctagggtattggttttgacctccttcatgatttttcaccactatgtctggcagactggcacatgtgatgcttaccaaatcggcgttctgcactgcatggctgtgtgcctgtgtgtaattcatgatttaccgcttgtcatttgggggttggggctgacccataaaattaccagagctagacaaatttactgatgtggaaagaaggaagtgaggagagagaaatatgtaataagtggcccgtaaaactgacagctaaacaaatttactggtgtggggaggagagcgagaagacagaaacatgaaaggagagtgattttactacgggtaggggaaagagaggaaggataatataagaaaaacaatttagttaattaccaatgtttacagtttttttttttgcgtctcagctgatatatggaatggtctctatatgacatgcatatgatattaatgagttctaaatatctctaactgaatggttcaaataatattatagcatcaacaggtgatttctacaaaactttcaaatgaaaacggtatgctgctaaagcagtcaataaagatcccctaccattcgattccatttccagacaattcgaaaacaaaacaaaaggtgggtataaaaggaaaacgatagccggacagaaaaatccataacattttttaccctactccaagtaactcacgcaacactcactggtctagtatatcatagacacatgagtgacaaatcatattatcagctctaacgtggcaaatcttcaattcaccaaacatctactactacgttgtttagctccaaatatttgaaatagcttagaattttctatcaccaagcctatcatagaatcactcatatttcatatagcaactggaacgaagttttgctcatttattcccggtatatgaatggctcagagtaacagttctagcgttcacgtttatttttgcattcaactcgtgtataacagtcctgagtcttcgccgttcaatgcgcattcagtggtaacgccacgacttgccttgctggactgggagttgagtggaagtcactgaaccagccagtgagtcagccagcaacttgggaacgtctgtatcatcaaatgcagacttgaggtggaatcagtttccctggattcatgatattgttgggatccaacgcagcctttattcttttcatcgtccttagcgactcgatgcccagctctttctctaggtactgccaaaatgcatagaaaaaataaaagtcagtaatgggggtgatgacagccatgagcaagacaataggaggtcctatcaggaaattcaaaaataaagtacatcttgataacccgtagggtaacaaatttacaataggcagcaagggaaattgaagttttgaaggtacgttctgggccagatactcatgaacttttaatctgttcaaccatcatgaatgtactggtatagcctcttgcaattttcctatcttaagagaatggttagtgattggcacttggcggttgtgccatcactttgagaatcgtatcagcaaagatggctcttgtatctgctagcagaagtgcagaacataataaaagaaaacaggtgatagacacttgccttcattttccctgtacctacaccatgctctcctgtacaggtacctgttcatcatcagagtcaatattaatcttttcaggcagcttttacatgctggcttggtcagtttttcattgtaccttccatagagagagcagtatgaaccatgaaatggtttagcctctccgcttcacgtcgttggtcttcttgactagggtcaaataggattattgtgtggaagtttccatcaccagcatgagcgataaccaaactaggaacgtacaaaaatcagaggtaaggaattcatgattaaaaaaagatggcatgatgtcttattggagccattgcgagataataacatgcttgatgctactttatgcatacttcaaatattagataatggagcacatgactatgccttgtattagatataaatgagaacataattttacacagtggctttgcataataagagagaacgtgtaccaagtcaatggtgatgcatcaagcttttcctttgagacagatatgcattctgcaagtctagacaaaggaacacaaacatcctgcataaataaacatatatgtggcattagatgacttgatagagtcagtccactgaaaattgaaagcttgtaagggtatgatgattgtgacgacctttggacgatctatataagcatatgagataaaaaaaaatcagaagggggaggggggatccattttatgccattgagttgtccaatctatagacgcacatgatacgggagccacatgtcatcctcacagtgagtagcatattatggatttatcctataaatatggtgctcacaagatttaaatagaccagcttgctaatggagaagtcctatcttgattcaaagaaagagttgagatacaagaccaatcatatttacatagccgtaagcatgtttggttgccaattgtcctcctgaatgcagcacttattttgagatcataattgttctcacatttatgaagaggatgataactacgaaggaagatgctgagattcacaactacataatcaaacatcaggtagcatgatgtgtaacatcaaagtacaccgactatgcttgatcaatatatttttttgttcaaaaaaatatatgttgacaagttataagtaaacagaccgttatcatagcctcatgatcaggtttcatggcaaaaccggcccaaagtgcttccttcctaatctgcacatataagaataaaatgctatcataaatatgtttcagcaaaaggagaaacacatacttcagtactgccactgccactgttacccagatataggtggatgcaaattgatagtttgataccatattcaggcatgtgtaagattatgcagaataaagactactttatttactaggaagtctacaatattcagatgagtactaggaaatctacacaagttcagatgaaaaaattggctgaccttccataactcctctttagcatccagctcttctacaaaaacaaaatcagatccatggtgttctgtggcaatcttttgaaccaatagtgtttgttcaagagcataggcttctgggtattcacgatggaaatatattagcaaataaaaaaatagattgtggtattcaagctgaaaaaaatagttgcatcttaagaagttttttaatgagaaggaactttgagtttcgagtggaactgctcaaaagtggataacaaaacccaggtattatattactcgaaatgtgctggttttgtccctaagacaggaagatcacaagcccagacttgtatgtcactctttgaaaccaaacttgactacataccgactgctatttaatacgtactattcaaaaagttatcttgacagaaacagtgtgcacagtaaatttagttttattcgagagttctttactcactaccgttgatcatcaaccaaattcataaacactaattgacggtaaaagtataaaactgtggagttgcatttgtcaattatagtgtcaacatatctagagaaaactaagatattctatgcctattggttcctgttccatcttttatttattatttgaacacttaactctagaggactcagtactgccaaacatagatgcacaatacagtataaagtagacttttttgtcaaagttcagtgtgaagtgttaactattcaaataaaaattaggttacctgtccctatgaattcgaacatcaaggttggtacttcaggtaagtttttaccatttgccatgttaattgcccttatctgaacctcatccaacaattccactcttgagacctggtcaagcagaaaacatacaagtagtcataacctacaacctttttaaattgcttactgaaacacctgcagaagttctatgaaagcatttcaatatttatagttcatagaaccaaatttccctagttagttaacctaacacttgcctatggagacaagcggatttgctcaatctgaaacagaggtgtaacaatctcatatattttttgatgtaagaaggtagagctaccttatagccatttcattgatcgaaatgatggattacaaagtggaggtgtgacaatttcatatatgagcttcatcagcagaaaaaagacaaacctgtaactaactaaaatcagaagaaaaaaagacaaacctgtataccagaaagcattgttgcaatagcaacatcagcagcatccttaattgtttgaaaattgcacattgcaacctgaaatagcagagcacctaggagtgtcttcaccagtaaaataaggaacaaaatagacaggtagtacaaaatagttcgtacagcaaaatgaacatagaaatccagtgtgtgtgtgtgtgcgtagatctttcaacagtattaggtttagaaatttagggagtagatcacaccgataggcttcagaccatgttatttttccagttcagagcacacagcaggtgcttagaagagaagcttttatttgttcagactcacaaatgttccccatttcccaatatgcaagataatagctatgtgccatagcatgattataaaggatttctccaaaaagaaagatctatgagcaaatgaaagtaattggtgtactacataaagccataatagtgtatatgctaacacaacaactgcacacaccaatatgcagagagttgacggcattcaagtccagtacacactgtaagcaaaacattgtttggacagtgtctagatgaaatagaagacctaccacggaatgagatggaagcttttgaagacgtacagtcacttctgtaattacccctaaagttccttcacttccaatgatcaaacgagcaagatcgtatctgacattcaacagaagagaacaaaaaacccatcattgatgccaagaatacatgtaaatcccacatgtatttaacacattaatgggcataggaaccagtgaaataatgattcactcccaagatacataaaaagaaacttattcgggaggggatcttgcatacccagctgcactctttcgggctcgagaacccgtcttgacaacatcaccattaggtagaacagcctgcagtactgagaaaattttactatttgtatgtgaaagtcaattgaaaatagctcactcaaggatagccaaaagaacctggaggttaatcacattgtcccgcattgttccgtacctacaaactaataagcaaatcatcaaagccatttaacagtaaatcataaagataaccataaaagaatgcaccatcacgtggattacagttgtacattatttttcgatggggtggaccgtttcactataaaagctcgaaagtaccctgagaaatataaggagaattacctcacagctagtgaaccagaacagcgagtagcacacattcctccaatagtggccccaggccctgcaaatcagataagaatacttgagctaaaccaccgatctagcacaaaattatgcttcatatcatgttaccaaatgcccaaaaggatgggtgaagttggacgaatatgctgcatgtcatgttatcacaggcacaaagatgtacatatcacccaaatgtctagacgatgcaagaaagttaaacaaaattatcagaaactaaatttagttagcagcaaccaaatgacatccagtacaaattcatactgttttatgtcaaagttagtggacagattatgtttcacgtaaacaataaacaatggacttgcctgggtcaagagggaaaaagaggccatatggtttcaggtactcattcagctcaatccatccaactcctggttcaacaactacatccatatcctcaacatgcagggatttgattttctgtgaacgatttaaagcaaactacaaattagaagaaagtgaaattaacagagaaacagctttgtatcgtctcatctatcctgcatcaagagctcactgctagtaacagttttgtctgtttggcatatggaagtagtatcaaacaatcaaaccatggtaaaaagaaattgatggaacatatactgaagcaccttttaaggattagaaacaagggtaattaattcagaaagatttaatttccacgaaattattagtgcctacaactatatggtctctagttacatttatcaatgtttaccttcatcaaagacatgttaatgcaaacaccaccatgaggtgccaacgtgtgaccctcaattgatgtagccccaccatatggtacaattggcacctgtctcgaagaaaaaggcatcatcattcagttctatagtggaaccctcatacaagtaattagccatcatgaaaacattgggagacatccacactgtctgctccttttatagactattgctggagacagcaaatgaaggtaaagaattcctttactgagaatatggcattctcaaggtgaaaattgatttccaattttctaaacagattttaaatggcacgtgtaacaaagtacaagagtcagacgagaaaaacgagaagccagaaagattcgttacatcacacgtgattagcagcagtaccaaggtcatgtaaactaaaacaaccaataaaattagtctgaaatctgaaatataaaaatctagctcagcatagtgtgatagaaagtggattttcacaattcacacaatcaaatgtagtaaagtctagcagacggataactgatgcggctctttctaaagaaaaatgcaaaagattcgcaccgtgtttgcattaatgagacataccttgtacttgttacaagccatcacaatcttctgtacctcatcctgggacctgcaaaatttgatttgggccggcattacaatctctgagagaaggacaaggtcaacacataaccccacaagacgaactttggtatcaatcagtatctatcactattcagtaatcagtactactgttagatcaggttatacctcgggaagacgacgacatcgggcacattgactgccttgtggaagctgttctgcggcgtgccatggtagtgcctctcctcgtagtccaccgtcaggttctcctgcgaggacggacacttagcagtcagctcagctcagctcacctcaacggcgaaagcatcctcactgaaaaggccacgagctcatcaccccgaggaaggaagcgagctcgtcgatgaactcgttgggcacgcgcttccgctccccgcgcaccaccagctcggtgctctccttgcccccgaccctgcagaacaaaagcaacgcgtcaatacgcaaccgcgggatcgactgagcgatcggtgtgggggcgggcgggcgggcgggcgagcaccggtggtcgatgccggagtcgcagagggcgacggtcgttcctccggcggcggcggcggcggcgaggaaggagaggaaggcggggaggcgggcgtgggaggaggaggaggagggtggggtttgggagtgggagtggtggtggtacgggtcggaaggcgggaggcggagggaggagagggggaggagcgggcggcgggagcgggagaggcggaggagcgcggcggcggcggtggccatggcggcggaggaagtgggggcgagagcgaggcgagagttcgcgagtgatgatgagaggtatgtatgggggcgcgcgtgggtgggtgggcacgtgatccatctgcgtggccgtggacgtcgtcttgtggtggagggtggcacggcatcgttggaccacgtgccctccttcaaaacaagcactagaaattagtagtatgacttttgaataaaaggcgtttgtagtccaacggttaggataattgccttccaagcaatagacccgggttcgactcccggcaaacgcatttttgtaattttttttcattttttgtcaaacacacacatatcttttcttttcttttttttcattttttgtcaaacacacaaaacacacatatatcttttcttttctttttctcttaaaggtatctctgacttcagcaataaccactactccctccatcaaaaaaaaaaaacccaattctgaatttgaacctgaacacattgggtttttttgggacggagggagtatctcttagccctattcgtttttctcttatattttaacatgcattgtatgtctatggctagtttaacaccacataacatttcaaatatgaatatttctaatacatacatttcaattgaatccaaattcacaatttcaaacacaacaattcaaatacaaatttaaaattttcaaacagtacagaggtgaaaacaacattagctctcaaccttctttctttgcttataccaccgccttcacaaaataactcaattttttcatccatcccatataggggatgcctacctcgcgcagacgcgcaagaagggtaggtcgagcgcacttttttcttttgttgtattcctagcctagttcgactccgtaacttttcggctcatacacgcgtggcaggctggcaaccgcacagcctagtgccgtagagctaatgttagcgctaacaaggagtaacaattagaattaagtagtcctttataatgaaataataaataaacaattgagttaaattttcaaaaatttaggtacatttgttttaagattcagattgaaatttttgaaatttcaacttgaaatttcaaaaattcaaattaaaagttttaatttttgggttgaaagtttttgaattttaagttgaaggtttttgaattttggttgaaagttttcgaattatgacttggaagtttccaatattcaaattgaaaatttcaaattttaagttgaaagttttcaaatttgacttgaatttttttcaaatttcgagttgaaagttttacatttttaatgaattttaattttttttaggaagttttatatttaatttgaaagttaagaaaattttgtatagattttcaatttttttattaaagaaaaaagaaaaatctcccgccaataaaaaaggaaaggttatcttaatttagtaactactacttaattaaactaatcatgatctatcctatcaataaagctagccgaatggcattccccccaaaaaaatcatgatcttttcaaatcccgttgtaaacgcatgcacgtggcagcttgttggctcatcggacggaataggaatcgcctatagctggtggtccagaaatgcgtatgcggccgtgggcctaaaacacgcgccgcggcggcgcgcgtgagaattagcttttccgtcccatatataccaataaacaaactaaaggactagaataccctccactatatcaaatccaaaggcaatagtccttcagtttatctagtaccaatgtaattgtctcttattttatctaagtcacaatgcatttgttcctactttcactgcaaatttgaacgatatgataaaacccccagacaatatctacagaaaatttttcactgcaaatttgaacgatatgataaaaccccagacaatatctacagaaaattgaagtgtacagaagagccaatatctacatacatgttcaactgttcaagctgcacaactggcattaacttcaagaacttgtagagaataaacaactcgaaagagaaaacaaacttttcaattcttcatgtttactggaaggagggtgcaaacatgtcacagatagccattgttattctgctcaattctgatatctgggagttcaatatttcaggaaaatacaattgttcatcaatcaacaacttccaaattgaatcaaacaatatttgggacggcagattgggagcgctaccttgtgaagtgatttacccggagttgggggatccaattttaggcacctgtttagagaaattgttggagcctaatttttacttggaggctcaaaatatttgcattgggagctatattgggtatatgggtatgctcttagtttggatttgttttttaaaaagatatgcagttgcacggagatttgaaataacataacattctggacaacaaagatagttactcctccaatgataaaccgcaattttttctacacaattaatttacacatgaaaaaatctcaataaactggaaattatgtgtattcttccaccgcaagcttccttcaaggtccatttcaacgtcaaagtgaaacaaactcaaaacgaaccatttcgcctcaatggagctttaatcccagatgtcaagatcacctaattaacaagccggaacgtttggtcttatcaaactcaatccaaaatggagataccagccggtaagctggtacattttcgacatccttacgtgacacatctgaaacatgaacgacgttacggtggtctgccttgcagagatatttcatggcaactttagatccatccacaaagttgaacgcctcaagaattgccattctcgaaggatcacaggctgctataggcctcggatctatgttcatggcttggagcacgacagagttcctgagaatatgatgtgccaactccagctggtctttctgaccgtaaaatcctgcgatattgacctccttgagatggtagtgggggcatggaggaagagttcttagtttaccatgagctttgcgataccggaggtgatcacgacaattcatccacatctataaatacagaccaaaaaaaatagaccttgtaagagcagcatgttataaattaaacacacgagcatgatatatgattatatgatggtcaggccaatatcaggatcaaattagatgcattgccaattgctcaataatcagtatatgtaaaggtaattcataattcaatggagctgttcatttcagcatccttaatgacaactaatgaaaagcatttataagttcactgacaatttgtcggcaaaatacataatttaagacttgaaacttacatgaaattcaagcttttccatcaagggagcagcctccaagatgcaggcaaaatctagaatgtcagcatcccatttccttgggccagaaaatgccaattccaatctcagatgttttagataaataaatttgattggtttgtctggcaaagtaatcctctgaaacatgcacacaaataacaatgaacaaaaatagtgtaacttgagttaacctgtaagatggaagtctacaagtaaattgggaatataaagaagtgatgtgtctgcaacctcaagttcacgacattgcaaagtcagcatctcgagacgtggaagagtgctgggaagttcggtgaaaatatactgaagagaatcagaaatgtccaatgactttatgcgtaaatttgtaagcacataaattccaggaggtgctaaaggtatcaatggaccaatgtactcgagtgttgtcaggccagagtttaactctatctctttgagacatgggcattcatagacatacaaatgcttaagctgggttgaaagatgagtagtccgtaagcttgtaatcaatttacagcaatatattccaagaaactccaaacagttgcaattggacaacaaaagttgtagatcttcatcagtaatgcccacatctagtagcttaagccttttaaggttctgaaaacccttaaaatctgcaggtggcttcagagaaatggaaccaagtttcaaagactgcaaattttccatgttagcagcatcaaaaatctgaaatgcaaagttatatggctcatctatgggccagtggaaagatctgaaatcaagaacaagttgctttgtcttcgatttgatggcgaagttcacccatccattgatgtgatacgcattttcattttctaaaagtcctataacttcgattttctcaacgcctccaccgttgtgctgctgcaagattgcgtccaccctcctgataaactcttcagcatttagcttcctgccttcaggtcttatgtctctttcgatgtagcgccttgacattattgatcgataactaaggtttaggtttgtgtggctgcaccaagtgcggttccattggctagataatatgctcgttctagcagcttctcttaacggtaattttgacacgatagtgcagagaatatcctgcagtaaatacaaatagattaaatatacagattagcgaatagagatacggagaggttcttctactaaaggcattttgcatcatctttttgccgggtcggctgaaagattaggccgaacaaatacaacatcatcttgtgaggaccaagatactaaatatctttttgccgggtcgactgaaagattaggccgaacagcgaacaaatacaacatcatcttgtgaggaggaccaagatgctaaattcgagatcgatatttcatacctcgggtaggttgctcaactgaagtctccatttcttcctcttcatcatttgtccatgcaggtcttcttttgaggctatcctctttctcttttccattttagctacagtaaaggaacagaataatcacataacatggatacaagcatagctgcataagagcagtatttttttttctccttgtcatgccacttctataattagcttatcattattttttttaaatgaagcgcgccatgactttaacctttttttttttttggctgcgtggggtttggagcaacttaaaagttaaaaccgaagctcatttccagtaggacaccaagcaaaatagtcatatcgaatcggttgtaacttgtatcccttttaccaaggccctgtttagatcccctagcaaaatttttcaccctatcacatcgaatgtttggacacatacatggagtattaaatataaacgaaaaaataactaatttacacaaattgcgtgtaaattgcgagaagaatcttttaagcct

SEQ ID NO: 16645 - DNA, 3303 bp, Oryza sativa
  unsure (1)..(3303): unsure at all n locations
atttgataatgtggtgctacagtaaacatttgctaatgacagattaattaggcttaataaatttgtcccgtagtttatagcgaatctttaatttgcttagttattagtctacatttaatacgcgaaatgtgtgtccgtatatccgatatgacacgtaaaaacttttcacccgtggatctaaacagggcttaagtttatataggacaatgtgtgtatagcgtctgattgcgaatgaggactcagaagatttgatgtagctagcgcacatagttcagacttcagagggtcctagctgtgaatcaaattacagagcacttacttctctagattccaatcaagccaaatcttgatctcattatctaatttaattaattaaccgcaggtatctcctgtctaatagtagaacctattcaacttaggactcaagaatcatggtacaagcaaatgcgaaaggtttaccttgggtctcttgggaagaaggcgggaggtcccctccccccgccgtcgtcgacgagggagcctgtgcgccttcgccggggacggcgtagttgcaccgtgctaacgtgctcgccggagtggtcgcggtgccacagggggggggggggggggcgttttaacgggctctcgttgacacacggagtacctaaatcctaatatgatacgaaaaatcagaaattagcctagaacctgctttatctgaatttcagcacgttgcataaggtaaggaaaagccaaaacttttccaaaaaagaagcaccaaataatctaactctaatctaatactccctccgttccttaaatatttgacgccgttgactttttaaaatatatttgaccgttcgtcttattcaaaaaatttaagtaattattaattattttcctatcatttgattcgttgttaaatttacttttatgtatacatatagttttacatatttcacaaaagtttttgaataagacgaacgggcaaacatgtttaaaaaaatcaacggcgtcaaatatttagagatggagggagtataatctggagtatctatctattactccctccaattcatattataagtcgtttaactttttttttctaatcaaatttctttaaatttgatcaaatttatataaaaatatagtagtattttcaatgcaattcaaacatattatgaaactatatttaaatttagtgtttcatattttagatattgttaacttttttatataaacttgatcaaacttagcaaagctttactagataaaatgtcaaacaatttatagtatgaaacggaggtagtatatgttatcgccaccgatgtggtcatcctccgtagagctgcagcttcgcctcctccaaaaggccatgttctcaagtgtttgatgaaattaaggccctgtttgtgggagtttgtcccagctgcagcttttcccaaaagctgcttctgctagaaactgccccaaacagtccacaacttttgttcttaaaaatgaactaagaagccaaagctggagaagctgggttttaaagcttttcagattctcagaagctggctatcaaacagctgcttctcagaatctaaagcttcctcaaacaggccctaagtctagggatgcccacaaattnttgacanatttttatgagctttggctgcttgtgttaccttttgttttttactcctcaggttcacgtccgatagttctcttttggagtttttccccttacttgccagtgacacttgacagtcactagctacatggattatgctaatcacacaatgttcgagttcttggttgcaaccagctagacaagaaggacgggtccntctgtattttcttcattgaagagttntaangatcactgcaggtcccatttttacctgatgatatgtgaggatgaaaagaattcctgtctagaatagtggtggttggagtgttggacatgttaactagtgtcacttaattaaattcgagaaaattttgaattaagagaaaacaatagagaggataacataacaataatctggtgaaatttgaatgctacagctagaccaacattggtggcgatttcttttttttttgttacaaatgaattcaaacaggcacctgctccacctttatgaaattatgataaactctgcaaatgccttggttattcttcctgtgtgggttttctcctgtccaatgttgtgtgcaaatactcctactgtatcacaaggaatttcacaaagtttacctgctgtattattttaaagttgggaaaggcccgggatctttctagctagcaatgcaagctgcgagctagctggtccgggttcaagactcaccccctccttaatttaaaatcaatatagtccttcctatattggtctttttttttcaatcacattggaaattgtgaatctatacaaatacgtgtaccgtgactccgtgagatgagttgaatccgaaggactatgaactacccaaactcagatatctactactgtaacagtctgctcattacgagctcagatgtacttgactactcctaattaaacctttacctcaaagtcgaaccactgtttcatcagtatatcatcctgtagtccgaagcgtaattaaccagccccaagatctgtcttgttctgctcagcgttagcctcgagctcatcgagttgatctttcagcttctgcccccatctcctcttgcggctgcttctttatcttgagcgcatccaggttgagctgccagaaggctcgatcgttgtgctttctcatcatcagccttctgcgccttggtcagcttgtcagatttcatgggaagacctccgagatgatacggtgcgattggcatgtcgccctgcgattcaaacatggaatggaatagcattttgtggaatcaaacaccaagcacaacaaccacactggggctcctcgatcgaacagtcgaactcgaaaaacttgtatacataggctaaatgaatacagcgtaaaaaacgtggttaacaagctgacggtaagaaaaattaaccaggatcctggatgcgagcgcagttgtcgcacggtgtgccgccgcgccaactcatctaataccacttatagaggctcactcttagagatggggcaatggaaattcaccgacgggaaatacatcgtccctatgttgaaattataagcacgtaatgatttaagttattccataaataaatcatgacattatatatgtaaactagattgaacgcatcattagatctacacatgtaaactaagcagtaaatatgaacagatcaaatatgcgcaaaatgtcgaacacgtaccgaggtgcggaaagac

SEQ ID NO: 16646 - DNA, 30383 bp, Oryza sativa
agcaaaacaaaactgcaaaaggaggctgcatctgcgcaagggtgaggagccaattttgtagaccattcgacgcgtacgtcgtgcacgcgcgccgcctgccctgccaggcgaggcgaggcgagcgcgcgcgcgtgtttcccctcttctcttcaccacacatgcttcaaatggctaggagagcatcctcccttttaaggaggtccccctctcctagaataagcaatgtggtactaaactccacatgcataccatcccatgaggtgggcttttgtgattttccaaagaattaatcttcaaatgggccttagcccatctattaattccaacaatcccctaccaaatctcaaaatcccactgagatttgccttttccaatgtactgtttatataccaacggctcgatagagaccgattaaggttgaacatctatctagaactccaagctacacttactcacaacttgaacaatggactacggcttggattgcaagtcttgtgcaagcaagtttcactcagagtcttatctggtattagaccgtctgtagactacccctcgggtggagcgtataagttatactcctaggtctttagtaagcttcctagaagattcacccaaaatctccatagactgcgaccaacggtcaagcttacaaaggtgagttctttcaagaatgctctgcaggacagcgtcttcgctaattaaagccaacagaactcattaaggcatagccaacctgccttgcagctcacgagagtacatgcatcttcacttagggagggtatagattggtactctcctctagtttactaatggtttgttcttcacaggttctaattcacgggatctccgatcacatagactgagttaccaccatagtataactcacacgggtctcaaacccatctccttcgatgcattatctatcacatttcgtgataatcccttcgtgaagggatctgccaggtttctagctatttggatgtaatccaacgttataactccggagtttctcaatttcctgacagacttcaatcgtcttttcacatgtctaaacgatttcatattatccttagaactattcactttgacaattaccgtttgattgtcacagttcataaggatagccgacaccggttttcaacaataggcagatccattaatagatcatgcagccattctgcctcaacagtagcagtatccagtgccgtcaattttgcttccatggttgacctcgtcaaaatggtttatttgcaagacctccacaaaacagcaccaccacccagtgtgaagacatatccactagtggctttgatctcatccacatcagagatctagttagaatcactataaccctccagtaccgcaggatacccagtatagtgaagccccaatttcatagtacctttcagatagcgcattactcgctcaagcgcacgccagtgatcatctcccggattagaggtaaatcggctcaacttgctcacagcaaaggagatatcaggcttagttgcattagccaggtacatcagcgagccaatgatttgggagtattctagttgattcctagcaattcttttgttcttgcgaagcaacaagttaggatcataaggtgttggagaaggcttactatcaatgtagccaaagcgattcaagatcttctccacataatgggactgcaagagtgtaatctcattttcacctctaattagcttaatgtttaagataacatcagctactcccaaatccttcatatcaaaattttgagacaataatgatttaacctcatttatcacctcaaggtttgtcccaaatatcagtatgtcatcaacatccaagtacagaataactccctcacccccaccatggcgatagtacacacatttatttgcctcattgactgcaaagcctgcagatgtcaatgttttgtcaaatttctcatgccactgcttaggagcttgtttaagaccatacaaagacttcaacaatttgcacactttgccttcttgaccttcaactacaaacccatcaggttgatccatatagatctcctcatccagctctccattaagaaaagttgtcttaacgtacatttgatgaacgagaagaccatatgaggctgctagggaaagtagcacacaaattgtggtcaatctagcaacaggtgagtaagtgtcaaagaaatcttcgccttctttctgagtatagcccttagcaacaagccaagccttatacttttcaatagtaccgtcaggcctaagcttcttcttgaacacccacttgcaccccacaggtttacacccatagggtcgctctgtcacctcccaagtcccgttagcgataatggaatccatttcactacggacagcctctttccagtagtctgcatcaggagatgcatatgcttctaaaattgacttaggagtgtcatccacgaggtacacagtgaaatcatcaccaaaggacttagccgtcctttgtctcttactccttaaaggagcttcactgacatcctcctcagagacatgttcatgtgtatgtttagtttgttccggtggtgtgattgaactggaaattatttcagagggttggctcgaaccactatgtgtatccttcattgggaaaaagctctcaaagaaggtagcatcatgagactccataattgtaccaacatgcatgtcaggtacctaggatttaactattaaaaatctataggcaatgctatgatgagcatatcccagaaatacacagtccacagttttaggtccaagtttgcgcttcttcgttattggtacattgactttcgccaagcacccccatgtgcgcaaataagaaagtgatggttttctctcaatccatatctcatatggggttttgtccttatttctgttaggaactctgtttaacacatgattcgagataaacaatgcctccccccaccatgccgtaggtagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacaatcagacctaagcctttttatctttctgtcaagttgattttcaacttctgccttataaattttaaaatagtctagaacctcgtctttcgttttcaacaagtacacatatctagtagcatcatcaatcaacgtcatgaaatatcgttttccacccttcgtcaacaccccattcatttcacaaagatctgaatgtaggagttctagtggtgccaagtttctctccttggcagccttgtgaggcttgcgaggttgcttcgattgcacacaactatggcacttagaacctttgacaatggaaaacttaggaattaaacacatgctggaaagccgagacatcaagccaaaattaatatgacataaacgtgagtgccaatcattagcctcatcatccacactgccacaaatatggttcacagacttattgcagaaatcagaaagggaaaagcggaacatgcctccgcactcataacctttaccaataaaatatccatgtttagacacgactaatttattagactcaaaaaccaacttaaatccgtctctagtcagacgggagccactaataagattcctgtcgatagaagggacatgctgcacgttcttcagctgcacgatctttcccgaagtaaacttcagatctaccgtgccaacaccatgagcagaagcatgtgacccattccccattaggacggtggaaccccgtgcgacctgataagaagaaaacaatgagatgtcgcacaaacatgtacattggttccagtatcaacccaccaattagtagactgattaactgaaaaaacagtaggtaaattaccatacccgcttccatctccagtgttgccaatggtcacattagcagacttagaagtctgccctgcaggtgccttcatccccttgcgccgtggaaacttcctagccagataaccaggttgcccacacacaaagcaagtcctctcatcctggttaggattgttgttgttcttcttctgcttcttgaagttggtggtctgttgagttttgtatttctccttgctcttgttctgggccttgtgcacaacattggcactggactgcccaccatcgcccttagacgcggcgtctttttcccgagctttctcctcaacatcaagagacgctatcaacccctcaacggagtattcatgtctcttgtgtttgagtgccgtaccgaaacttctccacgatggaggtagtttcgcaataatgcacccggccacaaatttgtcaggtaagacacacttaaggagttcgagtttcttagccatggtttgtatctcatgagcctgttcgactacagaacggttgtcagccatcttgtagtcatgaaactgctctatgatatacagatcattgctagcatcagtagcaccaaatttagtatttagtgcatcccacaactccttaacgtcgatcatatgcatatacacctcgaccagacgatcgccaagaacgctaagaatgcatctcacaaagagagtagtggcttcctcgaattgcttctgctgatcagcagtaagaattcctttaggtttgccagtactcacccagaagcatttcatagccgtcagccatagagtgaccttaatctgccatctcttaaagtgcacaccggtgaatttatccggcctcagtgcatcggcaaaaccagccatagtaaaatcacaacgcctataataaggtttttggattgttgaaattataagcacataatgatttaatttattccataaataaatcatgacattgcagatgtaaactagattgaacgcatcattagatctacacatgtaaactaagcagtaaaatatgaacagatcaaatatgcgcaaaatgtcgaacacgtaccgaggtggcggaaagaccggttgctcggcaggaactactcgcggttgcgagcgtcgacgaaggcgcgaagcacgcgagcggagaggaaggcgagccgtcgcggacgaacagggagcagtcgcgcgaagcgcttcccaaaaaccttattgccgccttctcccaatgcagtacgtcgaaggcagaggttccagagacctgctctcccgatcgccggtgcacgccggcgagcgggatggagtagtctacgagcgacggcgcagtacagagtaggaggcaaaccctagattgatttcgcgtgtgttgcgtgaagacggcggcttggtttatatagagatagatcgcctgatcagggcgcccgcgtaaaccgaaccggataagtcacgcgtaacctatccggactccatgccgttttcacgtaccggattttttggaatgtttccaaaacaaaacaaatccgaatttcccgtagcaaaacaaaactgcaaaaggagtctgcatctgcgcaagggtgaggagccaattttgcggaccattcgacacgtacgtcgtgcacgcacgccgcccgccctgctaggcgagacgagcgcgtgtgtgtttcccctcttctctccaccacacatgcttcaaatggctaggagggcatcctcccttttaaggaggtcccctctcctagaataagtaatgtggtactaaactccacatgcatgccatcccatgaggtgggcttttgtgattttctaaagaattaatcttcgaatgggccttagcccatctattaattccaacaccctatccccgtccccgcgagatacggcaggggaattttggttcccatccctatcctcacacggggaattaatccctgcagggtcttcatcctcgcttaaaacaatatatacaatattaaagcatatatacaatgtatccagacggagatatgtctcttcccatttagttccgtatggagaaccaattctaacaattcctatttcctaaaaggtgaatttcccatgatgagacggggaacggagccgttgcaatctctactcactctaaagaggtagagtgttttaaaatctgttaagagagtacaggggactgctgacaaaacaaaccaccgcaaccttatttagtattaggctcatagcatttggagcccctcattgctcctcgagattggaaccagcactttggtcgttgcttgaacttgctgggcattctgtgcattttgaactttggcagggccgccttggtaccacgtacgaatatatagtgcacaatgaaaaaagtcccgcaaaatacccggtattaattatgttaaggagcaatctaaaatctgccaaatcgctgttgaacagaaaacaaaatcagtaatgtttctacaaattcaatttacatatagccacatcttaatattatctgaccaatttgtgtagtttaagaaggcaaaacaatgacaattttatttcaacagtttgtctagtgaaatgttccaggttcaagagggtaaatttatatacagggtctaaaaaaacacaaacacaactgattctttttatgttccaagtagacaattcacaattagttggtttagggcctatttagatcgcatggtaaaatttttcaccctgtcacattaaatgtttggatacatgcattgagtattaaatatagtaaaaaaactaattacatagattgcgtgtaaattgcgagatgattattttaagtctaattgctccatgatctgacaatatggtgctatagtaataatttgctaatgacaaattaattagggttaataaatgtgtctcgcagtttacagatagaatctgtaatttattttgttattagtctacgtttaatacttcaaatgtgtatccgtatattcgatgtgacacgccaaaacttttcacccctgacctaaacacaaccttattattatctctgctgcaagtgaatatgataatatagattcatttcgtgttcaggtcaaacttgattcagcaagtttctacattttacattttgcagttctctacattttaaatgtggtgcacctttctacattttgccgtttctcagtgatggatgatgcgacatgatccgatgtagatacaaaggagagaaaatagtgctgctacttactcacggacaattggggtgagtcggtccttgacagttgtactgtataaagcggttgtgttggcatctctagcacaacccaggggcttgatcaagtgattggtgtgatcaacagagggcagcccagtggttgggcagtttattttaagcttggggtgagcacttggaaaggtgttgaagttcctcgatgcctgcattaggtgggataaaaaatcaggacggtcaattgaggcaagtatattctttgcaagtatatgaaatattatactattatataattttttggcgttatttagcactccatccattctaaaatataagaacataaaatcagataagatatttctgtccagatttatagtactggaaaatgtatcatctgatactaaattcttatgttttcggacggaggaagtagtaacaaaaatgtaatggtactgtcatcttgccacattacgaattagcgtcataaactctttataactaactacttatatattcaatttcattgtctaataaaaaaacaatactcaattgaatggacggatgggcgtgtggtgcacgaacctcagcggttctagggaagaggcttcttgttgatttagaagacagatgggaggccaatttaggaaacacgaaacggccggccatgtcgacgacgtacggctatcgatctaatcttcaaaaccagacgcacggacagattggattgaggccctccctgccgcgccgcctgctcatataaaagagggggccaaacacgggagacactggaaaacctattccgttccaagattggaacaactcggaatacatgtccgattccgaatgataatcattaggaaaacaaaaataaataaatccaggatagtagagaatatcagagaccatctagcccatactaataatcttgttaaaaaatatgtaataagtccccgaaaataaaaaaggcattgtcattagcaactactaattacgaacatcggtgaagccagctctaaggctggttaggtattgcctaggctctacatctccattgtgtattggcgtgagaaatatcaggagtcttctggctagcttcacaaggtggtgagctagacgatctgggttcgaaaccttaccccttctaattatttgatattaggtcattccctaatattcacgtcttttcatcgtgtattggcgtaaatactcatcaaatatcgtcaatgatcgagaaatgctctttaattaatcagcatgttttggcaacatcaatcataagaaggaaacatatcctatacatataagcttcccgtgcacacaaactaacaaatgtcacaaaatattctaaaaaaaattgaacatttactcctaatagtattacacatatatgtaaagtctcatattcaaatttattatatttagcagtaaaaaacatgaaaaatctaacagttttgagggtaaaaatctattatgattttgtctttttttttacggctaaaagataaaatttcatatgtaggtgtatgtcttttttttttttgtcttttttcacagtttgggctttgctcgaagcgagctacggataatcggttcgtttggtttttaagctgagccaagcccgagctctttgtccacccctacccgtgcgcgagttcggttcctagcgcgtatgcgcgaaataggagtagcattcctgcgtggggttcgtcaccctcccgcgttatccatcctcttccaaacccaaaccccacgagctcccctcctcccctggactggatagcaatctagggttttatcccgagcccgcgcgccgctccaatggcgctcgcgggcgcctcctcgtcggcctgcctccgccgcctcaacccgctcctcttctccgcccaccgccgccccgcgtggaccccgcgccgcgccgcccgcaggttctgcgcaggtaccggccgtcttctgcttctactgccctttgtttggtccgtttggttggtgttgattcggtgaaggggttggttccgttgcagctgcagttgcctcggagagagatgtgttcacctccccggaggtcgccaagtcgttcgacttcaccaatgaggagcggatttataagtggtaagctagcatttctaccagttatccactatttccccattttcatgaggtaatggaactatggctgagatgattttcccagtaattaatttgtcaatcttaaacgtgtgttaccttacattggacactcaccagtaagttaatttgtgatactcatgatacagcgagcagtttagtgccatttttccttgcagttttagactgttcgggtgattttatggtattttttgatatagcttcaaccattagattggcaattgtatctggatgagcaaaattctccttacactcccatgtagttgtgccctgtagtatttgagaagtaagcttctcacaatgcttctacttaatgcctttaagctaaacaatttcaatttccagaactaaaagtgagttccagtaacagaaaagggtatgctataacaagctttctcgcaattgattttctattatccatgttagacttgatcacttactagtgagttagtgacctgcctttgagcattgcctaatgtcaatgcaaggtttagcattacgaccgtatcaagattgaccgattaatactcttattacttgactcaaatattgtgtttttagtagattaatactcttattacttgactcagctattgtgtcgtcagttttttactgaaatagcattctaaatgcaaagtacaactctaggatctaggttgaagatagtctgtataaaggtatcatgatttggtccagttccatttttctaaagtgtgtgtgtgtgtgtgtatatatgctgttgcattagattacattgatatgattgtttacctgctctagttgacacataaaaatgtaaaaactgatgaattgcatttaacatatttaagtcaacaggtctagttttattttgctacttgctttgtttgcctgtttcacttcaagttcatgaagaaatgcacttcggtattttctggtccctacaataaattttccttataacatatatgttgtatctttgtaggtgggagtctcaaggattctttaagcctaactttgatcgtggaggagatccatttgtcatcccaatgccaccaccgaatgttaccggatcgctgcatatgggccatgctatgtttgtcacccttgaggtaggtatgatgattgaaaatttaagatttttttcctcttgttgaataactatagattgattatttctttactagcagatcataattgagtacatttcatgatttatacgttcactttgttgaatcatgacatatgagtttcatcttttttacccatttgaagtgatttgcatgttaacatgagcataagctgctatggatgtacttaccaaggtgaatctgtttcttaaagacaagaacatcatttttttaatcacactagcaatttagttctcttgcactggacccatgaaactgtgccatggatggtaaactgaatagtacttgcaattgctatattaagcagaagtgttggacagcatctgataatatccagaggttctgtgaactgacatgtttcagttaaactagcttattttgtggtctgaattcgtagatagttattggtgacagcactatgttgataatgagttatttttgtccccccccccccccattttttaggcactgtaatctttttactactaaattgtccctttttgtgtaagtactcaggatataatggtaaggtatttccgtatgaaaggaaggcctgcactttggttgcctggtactgaccatgcagggattgccactcaggtttgtagatcttactgcacatctgatatgaaatgataaattctattttgtgttcagcatgactttgtgaagtgatgggctgatttttatttactttttttttgcatttacattttagttggttgtggaaaagatgttagctgctgaaggaatcaaaagaacagatctgacccgagaggagttcactaaaagagtttgggagtggaaagaaaagtcagccctttttctgaagctagatcaatttttcttcattgtttctttatgcacctgtaattgctatatttgtttttctaatatgaagtgatcattgctaatagttacttggatttactattaaccatatatacccttgctcctacctccatttttttacgtgtttgccatgaaggctcatgtgcattacagtttattaactatcttctggtatcattatcgtgttgggtggtacctgtcataataatttgatcatctagatgaccagccttttgttattattctgaattgccagttaaactatcatgaacttgggatggaataataaatattctagttgataaaaaaaatcatgattcaagaaggttacatattttataaattctagcaatcactccaaatgatgtttcctttccaggtacgggagcactatcactaatcagattaagcgattgggtgcatcttgtgattggagtcgtgagcgtttcactcttgatgaacaattaagtcgtaagtgtagcctttattttccattgcaaatgatgcaatttgcatttgttagtatatgtatcattatagtgatggtagtcggtcgatcaacccctcaacctcaagcttatcatcagcgcttggtggtttgtacaactgatgtctcactagtttttttctttctacttacaggtgcagttattgaagcatttgttaggcttcatgaaaaagggcttatatatcaaggtaattaatataatcatttactcgctctattacaaaggaagcaaatgtgcataatcttgtgctgatattatgtgtgatagttttcagtttttaatcttttccctatgttttttctgtcagtgtaacctaattttcttggttgtagtttcaaattgactatgttaacatatttagtgttgatagatttagtactaactgattttttttttaaaaaaattcagtgtcaatagtttgaacagtagtgagaggtacaagaagttggggcatgtggtaataactttattttctatgtaatgtattatcactttatcagttacagcacaagtttcagaagtttcccagggtcctatttggaacaaactttaaacttttagccccaaactatatcaagtgcatccgtttattttgctgataggataggtctgtggtgtaatgtacatcataaatttttgaatcagaattataggatttgttggctctgagcttttttgttgcttactggagactaagttctcttatgactggaatttacaagcagagaggagcggcagcaagatttactaaaattatgtcccaagcaatttgttacttccatcgctagtatcaagatgccttttgccgtacgtttttaatatgttctggtacacacttgggtgtgttcatgtccatgatgcccgtgcttgttatggcattttctattgtgatagttgcgtcgttgaacagaaatttaggattttttcttcattcaattcttgtgtttttcctgaatttgagagtctagttttgccttatgtgaccttgatggtaaatattggttaatttattgtattttcgttcacaggatcttacttggtcaactggtctccaaacctacagactgcagtatctgatttagtatgttacaatattacctctcattttttaagaaatagctgcacacttctatctggcagatatataatctaagcaaaaaataaaaaataaaacttgagaataattacatacagaagctgcaaacttcaattacttcttcatggatagttgcatgagccaactccagatttgatcctgaaatggtttatctaaccaggaagtggaatactctgaagaacctggtaatttgtacttcatcaagtaccgggtgggaggtggatcaaggtacttcttgacttatctttaatcttggggctatattgtttatcattattcattttttaatcgatggtgatgttatcattgtccatttttgtaatgtttaaatgtgaatgagtttggatgatgcgcgctataaaagtttatgtttggcattctattacaaggaatctaacagcatggtcaacactgtatgttgatgaaaattacttatatgtatttaaaacttaagcctctggtgcagggatgattttatgactattgcaacaacacggcctgagactctctttggcgatgttgcaattgctgtaaacccacaggtatcagaaaaagaaagcattccctgtgtcctgttacaacttacttcccccatcccaaaatatagcaacttctagcattcaaaagttgtcctaaaatcaaaatgtagcaacttctccacctactccctcctctcaaccaaccacaaccatcctccatttaatatcgccacctagtattcttaatctctgcacaaaacctaaaaaagccttatattttgggacgaagggactgcatcaaattgttctatttctcgaactgatttatttgaacaaccaatcttattttctttgttaaatgcaatgcaggatgaacgttatgcaaaatatgtgggcaaattggctattgttcccttgacatttgggagacatgttcctattattgctgaccgggtaggaattaatattacctgtaatatttgtatgattctaataaccaagaaagtatgttgcaacacggatcaaagtaaagcaattcaacagtaccgtattcactagatgttggcgttctcttatctttattgtgttgtcccaatggcacatctacatgcaaatgtgatgccatcgcttgtcagttcaagtcagaactcaggaaagctgttgtttctgttgaggcaaacttcactgttggcactgtttttggggctaaaatgccaacgttttgcttgctgagctgacgaaagcttttgcttgacgaatagccatacatacaaaagatgtgcattctttgtataagggcttcacacttgtatgccctcgtttgtggtttgatcttaaacatactttgtatgacttcatgtgtatctcccctggctcaagaatctcacttaatgataggcatgcattaggttgcaaacccggtttataaagaaaggtgttcttttatataatcgatagacttcgattatcccttttaacaatatatcggttttatgatctacagtatgttgatccagaatttggaacaggggtgctgaagattagccctggacatgatcataacgattatcatattgcacgaaaacttgggttgccaattctcaatgttatgaacaaagatggtacactaaatgatgttgctggattatacaggtattaattttcgttcaaacttcaatttaagtaacctgttcacttatttccctttgaatttgtttagacttgcaattttcaatgtttggtttctctgttctattccatgttgcatcataactactatctagggactgtagtttgtgctgcttataaacccatgtatcctctttgcaacacgaccagtatttatcttctattataacatggaaatttgagtatagtaaaattgctgttggaaaatttaagagattctgtggcttttagccttcacaatcagtggaaacagaaaacagtcaattcgacctcaattatttcatatcgaagagaatgtacaatatttgttcgattatacttgctccgcaggcaacacagctgcagagccctctgtatttgacatgttcttgaccttgactttgctatctttattcagtggcatggatcgttttgaggcacgggagaagttgtggtctgaccttgttgagactaacttggcagtaaagaaggaaccctatacacttcgagttcctagatctcaacggggtggtgaagtgtgatcttttctcctgtacctgctcatacatgtaggctaacgatgcttaccataaagattaatgaacttaacttttgtgtgtcactaggtaatagagccattgattagtaaacagtggtttgtcactatggatccattagctgaaaaggcccttcatgctgttgaaaaagggcaactaactattcttccagagagatttgaaaaggtaatacattaatcattagcttttctatgcaccaatcttctgctcactagtaagcacacataaaacatgtctaaagtttttattggaactgctaagcaggaatctgtctctgtattcccactttctcagtaaaactatgcatatgccaaataaagagttaatatctctggttatatcttactcctgtaaaaatgatttctttgaactgactttgctgctctccaataatttatttgtgctgctgctgcagatatataatcattggttgacaaacataaaggattggtgtattagtaggcaactgtggtggggtcatcggatccctgtttggtacatcgttggaaagaaatgtgaggaagactatattgttgctagaagtgcagaggaggcacttgcaaaggctcaggaaaaatatggaaaatcagttgaaatatatcaagatcctgatgttcttgacacttggttctcaaggtttgtcttccatctgtaaagctgtatgctcgtaatgacttagcatacatgtattttcctctccttgtccgcttcctgaagtttttttttgttttgctttgttcataacatgggcctaaaatagcttttacaacttgcattgtagagcagaaatgtgtttattaagatgtctgaataggttttagccatctccttgtattatttttcatgtacaacagtaagatgaatagttaatggagctcctatactgcagtattctttttcccttacagtttctgattggcatctgggatatctgtatgaaccttatttccatgtgctgtaccatgtagaagtataaacactttcagacacaaatcgctacaggtattaagaaaactgcatatagttttttgttgttttgacttgttgcagttgtcctgcagtgctctgtggcctttcagtacacttggttggccagacctatccagtgaggattttaagcacttttatcctgcaactgttcttgagactgggtatgttatcttcagcaacaactttatttaccttctgatctttcagtccagcgataatactgttgcgctgctctttatgttgattatttatttttccatttacctccattatattatagctttctctctctttttttttttggcagccatgacattttgttcttctgggttgcacgaatggtcatgatgggaattgagtttacaggaactgtgccattttcttatgtttatcttcatggtctcatccgggactctgaggtgagagaggagcaccttaatcactagttcctgttctgtacttttgagggagagtcgattaaacaaacttttcttgtagttgtaaaatgacatgattgaacttctaaagggcatcaaccattaaaggctcataacttggaaattttgttttcttttgagccgggattgaaccctctcagatcaaacattgcacctgattggggtctcatgctttatgtgctaattgactgtatgatgctctagtgcagctagtcacatactgcacattacctcaaatttgaagtcactgcctccttttatctgatataaaagtggtatcaccagttaaactgttaaatgagcccattgtgaaatctgttttgtacccttagtcatcgtgttcatctgagttgtttctgttgccatattagctctctgtttccatggactaattagcaagttaattttcagggacgaaaaatgtctaagacactggggaatgtcattgaccctctagataccatcaaagagtacgggacagatgcattgagatttacactttccatgggtaccgcaggccaggtttgcttatacagtcgcttttgtatttatcaagattgtttgattttgtgctgttaataccctttttgcttcaggaccttaatctctctacagaaagattgacatcaaacaaggctttcaccaacaaactctggaatgcaggcaaatttttgttgcagaatttgcctgatagaagtgatgccactgcatgggatgtcttgttagcaaataaggtatctgattgaatttcgaattgcacttgatgcattgacataatttagttctttttagaactgttgctaacaccttgcatctattgcccagtttgatacagaagcgtcacttcagaaactaccactgccagaatcctgggtggtgagtcagagtacattactatctcgaattatttgattaatgttcagtttgttaatgaagagaatacactacgatccaggtgacaggattacacgaactcatcgatagggtcagcacaagctacgacaaatttttctttggcgatgcagctagagaaatctacgatttcttttggggggactttgctgattggtaagattttttttattacctaagaatatgaggccaggccttttcattaagagcacattaatatttctgcctcaattaatctggagactatcagccctattgacaatgtaaggagacacagggggcctgagtaaccaagtgtacaacttatcatatttggtagacctgcccaccatgcagaacaaagaatttcctatttgagcccttttttatgtttcctttaatttacatagtcctgtttgtctaaattctgattgcagcccttcccattgatgggaagaaatatgctagttgtatgggattaaaagaactaaaatccttttatgtgcttaacttttgtctggttttcttaatctgagcttatatccaaatggtaaagaactgtcaagagctttagtggaaagctgaggtctttcttaacaatggagattccatgagcaatttttctaaaagaaaatgaaactaaaacatatcacaatgttagacgccatgagccccagctagatcccaaaactcccaaaactgtccctcttccttggcaagcagaaaagcacctgccaggtttgagggtagcaccataaaggacacaacaattaggatgcttccagggagtccaaacaccaagaatgttaaggacttaaggccttgctgcaccaggccattaagtgcatcgctagctcagctccactcgtcaaggactgattccccagcgatggcgacagggcagggaggccaacctgctgcaggagactcaaccaaaatcgtctaacagaaactcatgtagtgagcaggtgatggatagtctcaacgtcctgatcacaatgaagacaacaaggagggtgcggcagcctcacctagtgaagtgatctgcagtccagcaccaattgtgcacaaccaaagaaagtagtgtcacatttacctggggcccatgatttccaagtatgctcccatggctgaaatcggacagcaccctccaaaagaaaaataaaggacaacaccttggaggcttggaagaaattgtcatgtgcagatttggccaactattaccccaaagctgatagccgccaacggtgaatgtcttccacacccggctgcaacacagacctcagataaaagatcctataatcagagatctgggtattctcaagggcgccaacagaggttgcaccttgtatatccaggatccatctgtattcctttaggtcctcaagaaccgtgcgcctgttggttgtttttgtaggaaccagagcaaacagtttaggggcaaggtcagcgatccgctgcccatgtagcctcctatctttccagaacaaggtgtgcgcaccattgctgacctcaatctcaactgctatggaaaagaaagcatggacatcatcatgcatttgaattggtaatgccgactatggcctatcaggctcctgtttttgcagccacagccagcatatcctgagggcccaaccatgatgcatcatgcattgtttttagtatatttttgtgtgtcatccagtcaaccaaattagttctcttgcaggtatattgaagccagcaagacacgtctttaccactctggtgatgattcagcttcttctatggcacaaagtgttctgttgtatgtgtttgaaaacatactgaagctattgcaccccttcatgccctttgtcactgaagagttatggcaggtagtgaaacctaaccgtaaattattattccctgcaatgtagtatatcacttttaccttcaccattaatagcatatcattatcgttcttatttcaggcattgccatacagaaaacaagcaattattgttgcccactggcctgcgactgatctccctaagaattctctctcgatcaagagatttcagaatttgcaatcgttggtaaatctttgacttgagctgctcatactttaagtggtgacattgcctgtggtgaccattttgttccattgtaaatgtgataacagataagaggtatcagaaatgttcgagcagagtattctgttgagccagccaagcgaatatcttcatcagttgttgctgccgcagatgtcctagattacatatcggtgagcattttcttacattacgggtttttctttgtggcatttcatcgtatatatattgtatgaccttttttatctattaatctgagaatcaacttaatgcacatgcatgtttattaccaagaacggtaagtattattattctttttatcttgttgcaatactcgagttaaagcttttcattgctagaaaacaaagcatatgcatagttattagatgtgcaagtttcactattggaacatagaggtgcatgtgtgatactgtcttgccttttcagctctaacttccctgcgtcttgacattatgaaaaccctttatttgttttgtgaaaaaaccctttatttgttcagcatcatgatctgtactttgatgcctgcagaaggagaagcaggtcctggctttactttcaaagcttgacatgcagagtatacattttagcgagttgccgccaggtgtgtgcctataacttgtcaacataatcttccttgatgcacttggccaatataaatcatctacttctgttgctggcaggtgatgcaaatcagtcggtccacattgttgctgatgagggtctggaggcctatctacccctggctgacatggtggatgtttctgaggaagttaagcggctgtcaaagcgcctctctaagatgcagtcggaatatgattctttgctggcccgtctcaattcaggaagtgtacgcatatatttcatcttcatgacaactatattatccctttgaaaccaatttctgtatccttttaaccatgcatttctttcgtgctgtagtttgtagagaaggccccagaagaaattgttcgtggagttcgtgagaaagcatcagaagcagaagagaagatctccctcaccaagaatcggctcgctttcctgcagtcaacagtatcaagttagattcagcagtcaccattgacggtgtcaacctgccatctaaataacaattttgattagtcctgatttggacgagagatgccacttccggatataaattggcgtgtcagagtagtgagtgccattccattttcgcgtgtgcaggacattgcaactggtgcacgcatcttaccgataagttctactatataacactcatttatacgtctactaggtatgcctgtacgcctgtgcgttgtaacgggacaatagttgtacatacataaacaatacataaacaatgaatggaataaacagttgcacacatctgtattagtgaaatgtgaatctcaaaacttaacagggatgaaccacgtaatcaagaaaacatgaaccgttagattagaaaacatctgtattagtgaaatgtgaatctcaaaatttaacagggatgaaccacgtaatcaagaaaacatgaaccgttagattagaacacatgagccgttagattagagaagataaaacaaagagatacaagagccattagattaaaataaggtggaaaaaaattatactccggtcaatggagggaatggagagaagtgttgggatacacgtaggctacgatagcataaatcaaaattttctatcgcgtaaatcaggaaccatgcaagtattagatcataaatcgttaccactcgacgcactgcgcaacggaagaaggcgttaagaagtcgaaggaattctcacgaagtagcgcgcgtcgatgtagaggaagtagtcgatcgcactagctcgaccttctcctcctcgtgcgttctcctcgtcgtattcccacgccgatcagcaccgcaaaccagcggcgcctctaccggtatccacacgtacagggacggaacaccaggcgcagatgtgctagcacccccgcgcggctagggttttgctcggggaggggagtgacggctagggtttctcacgtgatgcaatccctccgccggtcacacccctcacgaatatataggatccatcattcgggcctccaaggcctgtaggactcctattcggatccctatccaaattaagctcatattggatctccatccaatccccttattccggcacattaagcgtgcgatcctgtaggttcatgtacactcggatgtaacccaaaaactccttttcagtccacgcgtcaacagctgcccctagcaaaacgtattgacccaccgggcatacataaagatcatatcggctgaacctctagtgtatacttgtatgaatccctttgcctcacgatatcgattaagctcaaggctgatatgtgccatcttctaatagctcaatcattcactcgaacctgttgatagattatataacttgtgattgactcctcaatcacctttggcatagccatgcacttccataatctacaacatcaaggggcccagcgatatctctccataggagggacaaatctcatcttgattattcatatcccactacatatttcatagcatactcaaaaactacttttataactacccaattacggagtagcgtttagcaatccctaagtaagctactacatatgttgggaaccatgataatctcaggtctaaggattcaacaccaatactaaatgagatcaccgataacacaacacatatggctcttgcagtgtctcatgttgggtctatccaacaacatgttcaccaacatgtgtccacattattaatttgatatctctatatcatgatccatgagacatgatcatcaattaatacatgtgctgatcatctaaacatatttgttccacatatgatatttgatcagggatcctttagaaatagcaacacataacataaagagtctcatgaaagaatcacatattcattaaccaataatgagttatctatttcaaggaacaaaatcggataaatatgtaaacatagtatgtgatacaatcatctctatgattgcctctagggcatatcactaacagtctcccacttgcactagattcaatcatgaacgtatcttatacccattgccctagtgtatgcctcatgcttaggctgagggagtggcctaagcatacataaacaatgcatggaataaacagttgcacacatctgtattagtgaaatgtgaatctcaaaacttaacagggatgaaccacgtaatcaagaaaacatgaaccgttagattagaaaacatgaatgttagattagataagataaaacaaggagattcaagagccatcagattaaaataaggtggaaaaaaattatactccggtcaatggagggaatggagagaagtccctcaaagcatcgacagcgcatgtcttgagggaaaagaagctaggaaaagcatcgacaccgcaggtcctggagggaaaagaagctaggaaaaaaaagaagatggaagtcgtagcactcgtaggtactgcaatcctaccagcgcaatttaatacagattaacaaatttaatacaggtgtcttcacaattactactagctcagctaatcggctatcctatatacctatacaaatcatccctactactaggaattctctgcatcctcatgcttccacgtcaccccgttttctcctagccattggatctcgatcaagcgcttctcccggttgatctgttggcaatccatcggatcaaatatcaatggttcagatgtgcagtccctctgttttcttttgctggccaacaagcccaactttacacaccatcaagcccaatccacactccttggcccaatttccaccgcatcttcccacactccatccacaccaccattcccgttcccctcctgcgtccgagcggtcgcttctccccgcgccgccagaaactgcgaccgcggcaccggcgcctcaccttccagatcctgcgtagcgtcgtggttccccgccagctcttggactgctcgcctccaaacggaaaccaccgttcacatcgagcaaactttatggctgtcatcaagatagttgttgtctcctcaacttcaagaaactatcttcttccacatcttgctcggtcgagtcctcacacgctgcccgattcacttcctactgcatcgaaaaccatagttccgttcattttccctgcctttaaagtttcagccacctcctcaccttcaagaaacctcaggggtatatattcctctaccaaaggtatgcttcttcctctttttcttgaaccataaccatatatgttcattcaatttattggcctacatttctcctttgagtcacactcgattgatttgttcatgttatatatcagattatcaacggattaaggacatacgagtattgatttggtttcagctcttcttcagatttccactgtcccaatatttatttggattcgtctcttcttcagatttgtactgtccctattcaataggattgaaatttatttggatttgtcacttcatatttctactgtccctattcaacacgactgacatttatttggatttgtctcttcttcagatttatactgtccctattcaacaacattgaaatttatttagtatgtacaatttgttaaaggtgccaattcatgatcatggtattatatgacgactctaaagatcatatatatgcatataccggttttatgtattgctgcaccttaatttgttttatttctgaatactacggttgcagatcattgctattagtagattatatactgtcgttgtagtagcagctctgggctaccgctgaggtcagtcgccatggccatccaaagcagcagttgcagcatatatttcctccgatatgaatcctctattaagaaaaatatcaacaatacaatcggtaatgtttaattttctcatcttcattcatggtcatgttttccaaatattatattatgcccacccgacgttacttgctttgcaatttcttccataagaacaaatgaacaatatcatattttctgcagactatcagggactgagttcagcaatgaacttaatttaggtaaatattggtccttggaagttttcattttttttagatgaagggcaacgccctctgcatcctatggtggatgcaccttgcatctgtccatgctaaccttctttgctatatgatgttcttacttaacatctttcccttctttcttagtagaatataaaggatgttctttgtaatagtacacaatttaacattttgtcaaacaataagggattcagcatgtatgtttctatcgacacaatctctctgccctaatgattagtatcatcaagaaagaaaaataagagagtttctgatgctttgtttagatatggtagctatacttttttcaaatatagaaaatgtttaattttttggctttcaatttactttatggtataggatggtaagggattgagcaatgttgatccaatactttatggattttttacattaatcataaaacatagattacctcacatgtagaccattttaattgaagataggtcaataataatcaaaattattttctcttacattgctataactatttgagatatttgtatctcaaacttcacctttgttgggcattccgtttatatttcgtccaacaatatactaaatattgtttgctgaaataaaataaaataatcattttccatggctatctattgcatttgccttgcatctccacatatagtcttatgttcctacctacgaatcccgcagcaacgcgcggggtattttctagttacatatacacgagagtgggttaaatcaaaaccacgatgaaattacatcacacatcagttgatcagtagagtcttctgccaggtattataggaaaaaaatcatctgttttaaaatatagcaacctaggatatatcccatcattcgtagattgctatatatttcatgacagaggtagtatacgaaggaacaaattgaacatatagtatgaagaaaggagacctgcatgcttcctcttactctcttaatattcttttaatatttctctcaaaatattcttttaaaaatgacaatattcttttaaaaacttgaatttgaaagacaataggaaaagaggtatatattatatggaaaaatttatcttactcttaatattcttttaaaaatgatactacctccatttcaggttataagactttctagcatagcccacattcatatagatgttaatgaatctagtcacacatatatatctaagattcattaccatatatatatgaatgtgggcaatgctagaaagtcttataatatgaaatggaggaagtatgatctatttgtaaatttatgttattttgattttcaaaagaatatgaaaagaattatagttaaagagggaaaatgcctaaaagatgttgatgaaagttaaagagtaacagatatcgcacaaatggggactacctcttgcaaagatgtcgtaggtctccaacactaggctagcaatggtatgctgttttgaaaggcccgcgttagttcagttggtttggtgctgagctcccatgacttgagcagtaggcgctatctcggataggatctccgctccaatgttaatagcactaaggtgttatagctcagcacataacacctaagtgattacaagattagcactaaaaaaatatatgtttttataataagtttttagcacagtctaatcttcaaatgtgttttataaagggcaaattttcacatcatacggggtagtctctcttgcaggtggtaggtaggtttgaatcccaccctcttcatcttttatggtagtgcaatacattttaaagtaaattgcacaaaactacaagcattttgaccaaattattatcacaaaactacatatttaacacttaatttataataacactacatatttaatattgaagttatcacaaaactattataaatccctagcatcattgatatgttggaactataaaaatgtagttttttttactaccttggttctaaacctgtagatttatgataattttattaataaatatgtagtttcatgacaacccatattaaatgtgtagttttgtgataattttaattaaattgtagttttacgatagtttgatcataatatctgtagttttataaaagggcaaattttgctaaagggtatcacgactttatgggtttggctgtaggacaccgcacaaactcacttttaggggaaaacactctctaaacctggttagcacaaactcactcacttttgggggaaaaacactctctaaacatggttatttgctgctggacaccgcgcacattaaaatattaatttctggttgaatattagagataaggtgaaaggtcaaaagtaccccttgccccacttgtcatattcttcctctcactcctaatttcccttcttctaatctcacgaccgaccgtggagctccgtggtgaaggcagtgctccaccgcgtcgtgggcgcgctctggcgtggcggcattcggtggagacggcgctcgacggcatctgcgagtagcagctaatcatgaaaagttgttgttcataatactcgtgagacttgctgtgtaatccattattggaaaagaaatactcgtgagactgataagctacatcgagaccttgaagcacaataaatttcaaaagagcatttttaagaacaatactccaacatcatctaagaagggaacactatagcataaactggaaacaagtattgatagcgcagattaggaaatacatttgcttgtataaatgataatacatgtcaattcatagtattaagaaaataccagtgcagtaaccaagctacccgatatgtcaccgaattattaacacacattttgacaaaaacaactttatgaaaacattttctaggaataacaggtgcaaatagttatagcagcaaaattcaaagtattccactcaatcatcaacacattccttatatagcctttagaccttgttcctcattttgttttagctggcaggttggtataataaatatctgcatgccaaactcatttgactttagctgctagattggtacaataaatatctgcatgccaaaaaataactttagacatataacaaaatatttaaagaaaaaaaagaggatagtgaagactgaagggtacacgtgactcatccctatcttgtcttattgaacatggaacaaaaaagggggtgaattacttcatttcgtaaatcaactagtagatctcgaagaatatttatataggaccgatataaaaaaatctatgatcatcctacgacagtacatccgcatatatggacttatccagtagaacttgtagctcattttctgttataggttcttcataagataaccgctgatgatatcgctgagtaactatgaatcaagagtcaatgttacaattaggcaagcattgacttaagaaatctagtcagtacattttcgtttgtgaatatgacataactaatagtgcaagattttagctgcagcgaaaaccaaatactgaataacactgagcagaaactagaaacaagtactggtagcgtagattaggaaatacattttgcttgttatgaaacaagtactggtagcgcagattaggaaatacattttgcttgttatgaaatgataatacaactcaattcatagtattaagaaaatatcagtgcaataaccaagctacctaatatgtcaccgaattattaacacacattgacaaaaacaacttcatgaaaacaatttctagtaacaacaggtgcaaatagttatcgtagcaagatccagagcattccactcaatcatcaacaccttccttatatagcctccagacctttcctcatttgcctttagctggaagtttggtacaataaatatctgcatgcaaaaaatctttagacacataacaaaatattaaaagaaaaacaagaggttagtgaatactgaagagtaataactgtgatggtgttacccattcctatctggtcttcttaaacatggaccaaatagctagtagatcttaagaatattcatattgttctctaggaccgatataagaaattggtgatcctcctgcgagacatcagcttatatggacttatacagtagaacttgcagctcattttctgttatccgttgcagctcattttctgttatccggtactttataggataaccgctgatgatatcgttgaggaactatgaattaagagtaaatgttacaattaggcaagcattgattatgaaatgttacaaaagtaatttacatactaggggaattctatattttgaatcgtcgacatttagattaggaccttcacttttgatcttatatatcaagctcttagtgttgccaatcacttgctgaatgttctcagagaattgctcaagctcatgtaacctacatagttttttttttactaaatcaccgggagagcttccccacccgaatttgtcatttcattgaaatggaagagtagaattcatagttttttttactaaatcaccgggagagcttccccacccgaatttgtcatttcattgaaatggaagagtagaattgctcaagctcatgtaacctacatagttttttcttttactaaatcaccgggggagcttccccacctgaatttgtcatttcattgaaatagaagagtgcaaggttcattacattgaattgagagattggggggggtgatttctttctaaatatgaatttgtcatttcattgaaatagaagagtgcaaggttcattacattgaattaagagattataggggggagattttttttttactaaatcaccgggggagcttccccacctaaatttgtcatttcattgaaataaaagagtgcaaggttcattacattgaattgagagattggagggggggagatttctttccaaatatgaatttgtcatttcattgaaatagaagagtgcaaggttcattacattgaattgagagattatagggggggagattttttttttactaaatcatcgggggagcttccccacctaaatttgtcatttcattgaaatagaatagtgcaaggttcattacattgaattgagagattggagggggggagatttctttccaaatatgaatttgtcatttcattgaaatagaagagtgcaaggttcattacattgaattgagatattatagggggggagatttctttccaaatagaagagtgcagggttcattacattgaattgagagattgtagggggggagatttctttctaaatggttgcatacaggaactccatgcctgtaatgacccgcctctaccaagctctcccaggccgggcccgcttacatcggtcatagactgccctcacagaccaacacatgtcttttctacacactttgtcctctctcgggaagaatttcccgatcggccacccatcctgaaattgctcggggccaagcacgcttaaccttagagttctttcgagatcggcttgcggaaaagaagttgcagcttgttgatatgagtattctattaatcctattaagccctgggctggatgtcacaataccccgtcttcaattgatgaaacagatgcacatcctaaattgtcggttgcactcctattttatcctagaaactttttgcaaacgggcataaaaaacaaaggtggctggccgtttttgttccttcattggagatgtcgcaggtgctagtgggaacaatgtttttcttctgtaaatttttctttgtggataggcggtgcttgacaaggagccacacaaacaacttcactttcagtggggctctgcatttccagatagtatctcatagtggagagacaactccaggaggtagctgatgcattgatgata

SEQ ID NO: 16647 - DNA, 7298 bp, Oryza sativa
acggaaaggacttgaaggacattgacccgtcgttgaaaggctgggcctttggcttctcccagccaatgcagggggctggggtatacgcgcgggtcgcagggtaagccgtgcgaggtggagccgaaacagaagccgccgccgacgacccggacgtgttgtccatcacaagtgagccggagatagagagaccttgaacgctgccggcgtggcggcggacttgttgggcaacggtccatcgaaaggcatgtccttccgcgtttccgatgaggaggacgcagtgtaagcccaaggaatgtggcaccgacgccgacgaggacccgttgcccgtcagcccaccagtggggaggtcgtacgctgacgaggaggacggtgagaccgacgggtaggcggaggagcgcggcacccacgaagaagctgatgcagacgaggaccggttgcccacatttcttggtcctcctcgggggcgttcatatgccgatggaggagcccgacgaggaggagtgcaggtgcgacatctcgattgcggcgacaagggcacgttgagtgaccggaggagcactggactctgaaggcgcgcgtggggagttggatgcttggagcgtatgtgcgtgtgttggggggatgactgagaagacgatggggaggaggcgcgaagtgaaaaaagaggggagacgagtcgggggctcgggccctttttagcgtgtgctattgcattccttgttgcgatccagtccgcttcggtgttagggtttcgagtcctatgcatccattggtgcgggtgcagacgccgcagcctttgcaccaccgccacgcatctagcgacctcatcttgtttatgcttatcaaccaaaatttaacttttcaataaagttgattttgagatttttttaatcatagtttatttttcagcctttgcttgtaggttgttaaagacatgtatataaaagtttcatttacaaatatgtcatttcgctttttcctcaaattagtcaaacgatggggctgtaaataatctcaaccggtcaatatgccagaagcaccacatcctaatagttgatccgcccatcgttctctcaattggctgaagatctggcaattcaggcggtgtttgagatgaaagattaagttgtcgcttgtaaaacggaaaacctattagcacatgattaatttaagttttaattattgcaaacttgacaaatagatacatttgatattttgaaacagcttatatataggaagttttcgcacggaacgcaccatttagtagtttgaaaagtgtgctaacgaaaacctagataaaatttgaatcttaatgaggaaagtaattatgtttataccttgtcttgctcatgacaacctttttctgtacgcgagtacgtcgtgatattggtggacaggaatcaagctgaacacaacctgccgagtgtgtaattggatgagaaccacgtacatttatatactttatatgcaagaaggtgatccatggatcttcatcaaacccaggtagagttagagcaatgtatgtcatgtaggggagacggtaaggaaaatttggggtattgatttcaaattaccgacaaaaatctttgtttagtttggagatggtggtcggctcgtaacaaggccaattcccgaatgagagtggagagtacaaagccgaagttacttatcattatgtgcaagagtttgacaaggtttagttgccggttggattccttcgacgcttgatacatatagctgaatgcgggtggatcattccacatgactactagaagaggaggacggggtttcatggcgtgtgaccacaagcgccaatttttgaaagccggtgttggtaacgtccttagagcatctatcgttctacacgccaatgctttgacaacgcctattatgattggaacaagctgcagagtgggtatgcctcgtggggtgcttgaaacatattccctcctgtatcaaatatattgatgtttgtgggttgtgccctttggatgcaaattattgacgttttggtatttgattgtcactttggactgctatatccttgcatgcatgcaaggcttgtcttcagtagctcatcaactatagcaaggctcccaacttcccaagcaatgacacattaactccagctttgaaactaaaggctatagccacacaggtcgtatgggagtttttgataaaagagctacacagaagtttttaataagggtaaaacaagaaataggcaacctaattgatcacttcttggtaagtgagatctgtccaaaacatcaataaaatcgaaaccggagagagtatgttgctaatatggaatgaactctcacatatgcagagaatccagagatggatggaagtccaaagcgatgcctttgccaatacaaatgctaaaattcaaattttagcaacgaatgataaggcaacaagcatacagtggttaaaaacatattatttggcaatgcaaaacaattgacagaagatatataccctaagttacgttcagcgagatttgttgtaatggtcaactaaaatttggatcacctaatatctaatttatctggataaaaaaagtgtagtagacgcatacacatggtgatgggatttattcggacatgatttgatcaattcttttcaaaaactgaacattacaccggtcgggtcccgtctcttggtcggtcgttcccgttcacgcgcgcaccaccggaccacccagacaggcaactgacggaggcataatatcctagccgtccaatcatcccgaaccgctgcattctggccgtccatccggacaccgtccttgtccctgcaaagcttcttccgctcaagaccaactttccacgacccaaaaacctcctcccccccttatcattctctctcttctattttctgcacctccccacctcctcgcgatcttcacccccacaccccacccccaaccccgcgacccactcccaggtgggccccacatcgccgccggcgaccgcgactcatctcctcggctcccgcgccgccgcgtccgcgcggccatgacgacctctcccccgccaccgccgcccgccgaggtaatcgcgcgtggggttgcccctgcccttcgccccctcatcctccctccgccttcgcgcttcccgctggctcgtgtgtgtcccctcgccgccgccgcatcggacggcgatgcgggtggcgtggtgaacgcggcccgacgggtggtcggctgctgtaggtcttcgggttggtttctttgtccgggttgtgatgtggaatgtggggatgggcgtgtccgcatacggaattctagggtttgtggttttgctggctttgcctcgggcttggtagtgtggatctgaggcgagtctcccatgtttattttttgcgcagcagcagcagcaacaggaggaagaggaggtgctcgtgccgcgccaggagttgcccaacggaacgcagccaatggaaggttcgattcggtcatttcgcctcacgattcctgtacatgcttttgtctttctgcgtataaggattattatttggttagtattttacgttctcagaatttgtactgatgtcaaactactgatctatgttctccgcggatgcacaattccaacatgtacgtttgtgcacatacatgatatatttcttttgctatgtcaatctggttttatatgagctttagggtttgctaattttgtttgtttttaatgcaaacatgacgacctcaaaagcttgctctcattttgtgtggtgggttgcattttactgtatctgtatgcagctgttggtatgtgtaggttgagtaaaataatgttcagtaatgccctttgtttgccatatctgctgattacacttaatggatctcatgttgctctgaattgtcatgccagttgtgccttctgagccagccgccactgtggaaaaccagcagattgaagatccaccaatctctagatttacttggaccattgagaacctatcaagagtgagcacaaagaaactctactctgaaatttttgttgttgggggctacaagtggtgagtgcctactgcttcttttgtctgagtttgcgtgctatgttgatttctgcccatcgaaggggttactgtcgggtgattgatggaaagtcattttgtttgcaggcggattttgattttcccaaggggaaataatgttgaatatctgtctatgtatttggatgtggctgattcagcagtcctgccttatgggtggactagatatgcgcagttcagcctctctgtggtcaatcaaatgcacaacaagtttacaataagaaaaggtgcattcatcatctatgcctttttctttatttagtcaattgggttgcgaaaagtattttaatctgaaattctttcagaaacacaacatcaattctctgctcgagaaagtgattggggttttacttcctttatgcctttgggtgatctctacaaccccagtagaggctatcttgtaaatgatacttgtatagtggaggccgaagttgctgtatgtaaggtggttgattattggagctatgactctaaaaaggaaactggttatgttggtctgaaaaatcaaggtgctacttgctatatgaattctcttcttcagactctgtaccatattccatatttcagaaaggtacaaaatgtagttttactggttatataattttgtacttaatatatttgtatggtgctaacagtagatagtgcttgtcaggctgtttatcatatgcccacaactgagaatgacatgccttcgggaagcattccattagctctgcaaagtctcttttataagctgcagtataatgacagcagtgtctctacaaaggaactcacaaaatcttttgggtgggacatgcacgattcattcatgcaacatgatgtgcaagaactaaatagagttctttctgagaagttggaagataagatgaaggtttgacatctgtaaggtctttccttttatgtattcggtgttgtttttcgagtagtgtaactctgactgaattatgcttgtaaattttgattcaagggaactgttgtggagggcacaatacaacaattatttgaagggcatcacatgaattatatcgagtgtatcaatgtggatatgaaatcaactagaaaggaatccttctatggcaagtgattgtgttatcgcatcatggtcattatgtccaaacatgcccctttgacctgattggtgtacactccaatgcagatcttcagcttgatgtcaaaggttgtcaggatgtctatgcttcttttgataagtatgtagaggtggagcgcctggaaggagataacaagtatcacgcagaacaatatggactgcaggttagatttttgggagcttctgatagctaaaccaatttacgctagagctacactgtcattctccctctctcacatatatgcacacagacagccacacatcatgtatgttatagtacaatggtatctgtatgtgtatgtttaggttctaggacagatgttgaaatgaaaagactgttaaccagatgaacatacatttttttatttcatagcaaaattagaatctcggtaaccttgtttgaataagaattaacatggtttcggagcaactcattgtgctcaacttaatagcacaaacatcaaactcgtgattaatttctcaaagcatagcatggaagttgaaatgaacactattctcaatatggattaaagggatcttgggaatttcaaattcaaagaaagaacatgatgggaatctatttagtgtttatacaatctttgggcgcatttggaggcctgtctggatgaacaattcatgttatctggcaacagagaaaaacatggtactgtatgggctttttattcagattttttttcttggtttcaggatgcaaagaaaggtgttcttttcatcgacttccctcctgttttgcaacttcagctaaaacgctttgaatatgatttcatgcgtgatacaatggtaaaggtttgtatcagtgccatctgctaagaagttcccttcatccattattgttttagtggtgaaatgaatgaacagttttgtggtaaaggaagtgcgttcttcttgcttccttttaatgcttatccttttgttcctaattctctatcctgctaagagtgtttatgctccattctgaacttcagataaatgaccgctatgagttcccgattcagttggatcttgatagagatgatggaaagtacctctctccagatgcagataggaatgtgcggaatctttacactcttcacaggtcagttagatattaactattatttcttgtgtacctgtgttccatttcgtgatttaaggtttcaaggttcttcatggctgaactgccaacaattatagagatggacttctggcctcaccattttacctatcctggactttatttaataatgatgcaattctattacaatttttatgtcactgctgtctttaacagttaatttcttgcagtgttctcgtccatagtgggggtgttcatggtgggcattactatgctttcatacggcctactctttctgatcagtggtatgattattttggttatcattggttcttttgtatataaacaacatgatcttatgtatatctgtgtcattggctatgcttttgtacaaaaacaacaatatcttaggtatatctttcatatgattggtttgtaaactttgttagttggtactaactgttatcaaccagttgctgcttacaggcttacagctagtgagattagccatgactattttagtatttttctgtgattgtgctccttactaatcaaactctcatgatttgaagtggccctttgagtacttttgttaatacatttatgtcttcttttgaaataccttttcagttcactgtaaatgttaatttagaccttacactgatgggttcttagctgagttcggtagagcttcttagctctgctaatcagctacccacaaagcgagatgggtaattagtgattaattaagtataaattactataaatttgaaaaatggatttgtttgatttttttcaaaaaaatctttatatacttttctttttcacgaaacacaccgtttagcagttcaggaagcgtgcttacagaaaacgaggtagtagctcacctcataagcccttccgaactcaccctgagtccagattagcaagtaggaacaaatacttgctctataagcatgatgcatgtcagccaccttttcattacatatttgtatgcttcttggatggcttgttgctacttctatgtttattatttgctgaacaaaacgtttccag

SEQ ID NO: 16648 - DNA, 694 bp, Oryza sativa
ttcaaactaaatctcaaggatgttctttcatatgcagctctcaggtcttctgactatacatctgggtttctccccacaataatggacatcataacagcagtcatcaacatgagtcacaaccagaagagctcctcgcacccgcctagacatcgtcccccgctttatcctcaaagcttcaggaaccaggcgcagcaacagtctcaggctcaggtgcagtatcaggctccaagttcactgtcatcatcctcttcggtgggctccaacagcgatgaccaatcctgaagcctcataaaacatccctgtagaagacacgttccagtctccaggaaggactttgtataaaagaaaaaggaaaaaaaaaagaagacaacttgatgtgtaatgtactacatacactgtgtgcatagctgtgagcagagttggtgatagctgattagctgagcagcataagttcctggataaaccaactgtatgtcagtatgtgtagagatgatggatggaaatgaactagatgtcgaactaaataccggagtaatagtaaatttcttcttactggttacttaattacagccttgggtttgtctctgagttcatgcattctctttctgaaaataaaaatgtctgtccatgccatgacctgcatatacatctcaatgactccatagaaccaaactaactcgattcacaggagcat

SEQ ID NO: 16649 - DNA, 1490 bp, Oryza sativa
  unsure (1)..(1490): unsure at all n locations
tacttaatgctgcatcaattgagtttgatctattgagtcgtgcttagaatattgatctccagcctcccacctagttgtcgattagaatagcatcggagtttcagccgatcgtatctgatttaactataattatttcagtttgcttcactgatatgttaaatttgccctttatgccaagatattgctgtatttgaatatattaggcgtttgcttgatattctatgcctgttttaatatcctgacataaggtagtatcggggtatttgccgatacatgctagatctatatgatcggctatgctgtaagcttatatagtcttgttattagtatatatttcggtctaagtgattcattctgtctcggcatggcgacgatctatcccagtcacttgatttaagtatatatcgagataaggagtatatatcgctaacatctacagccgatcaagtaggtttagttttcttccttatttattcacgattgtcgatcgatgcacagatgacatcggctcagatataaatgatatgtcatcggtaccaaaccgatcggctatcatttataggtttaactatggttcttttgtctttatttcttgttgattgtaggatgaaatcaactggcacgctcatacatccgaaggcaagttttggacctgcactggagttaagcagatctcccaggcctcgtgttttttgtcaacacgcttttggcacgcccagtgggacctgattagaagtcaggcgttagttcttcctcatggccgagaaacaagcaccactaccatcaagcccaggctctgttaaaggcaaattaccgaagccgggattgactgacatcattgatgacaatgtcctgccgatcgatcccgagaaatttacgcctgacaacaagcaggagtttgaagcaatgatgcagcaagcacgggatcagtatctgagctcgttcatgcaaacccgcaagggaacgctagttcagaagtacaagttaaaactggttgctgatagccctggaaccggttcttccaaagatagagaagtgaaacaagctccagatggctcagctcagccgaacaacaagggtgctaccgggggttctataggaaatcaaggcgataaccctcaagaagtgcacggagctccaggtgatgctgctcaagggccgcaaggaggaaatcttaatcagaatattgagctagcacaagattttttcaacaactttcaagattgggttgattacgcggtgcatcatgctttgatcaatcaatccggggtcttagtcaatacaatgtcgaacatgaataaaacgataccactaattcagccggtggtacagccgatccaannnnnnnnnnnnnnnnnnnnnnnnnnngcaccatcaacgcagtagcatctccaaccaatctagcagacaccgccaagcaacggcttcagccgatccaacagactccgatacgacagcaggtcgttcagccgattcagcacctggggtcg

SEQ ID NO: 16650 - DNA, 43785 bp, Oryza sativa
  unsure (1)..(43785): unsure at all n locations
agtatggctggtgcctggtgtgatagttagcgcagcattattatctactgatgtgcacaagatcttctactgctaagtattttatttctatgaaattattaacatacactgatgatcacatgaatgaaacaaaattcctactgaaaaaggggtgtaattggaaaaagaaaacgtctcctcaatatgggaaaagaaatctctgcctgtctctctattattgctactagctgtgctctgctgttcatcctatcatgaaggaggagaccagcacgaggaggaggtggagcagcacgccgccgccggccggcagaagggaggaggcggcggcgccggacttcttgacggtgaacgagaacggcgccggcggcgccgtccccggctgcgacccgttgaacatgctgatccccaggccggagcagtccgacccaagcgaacctgccaccggagaagaagaaaaacatcagtcgccggcgacgagctaggcccggcattcatccagccggccggccgcaggataagatttataaaagtttttgaataaggcaaacaatcaaacatgtttaaaaagtaaacggcgttaaatacatgtttaaaaagtaaacggcgttaaatatttagagacgaagagagtactaaatatttgtgcaattagcatttatttcgttgcgaaatgttttattgttaaaattattttaagcatgatttatatcttatacatttacatcatttttttaaaataagatgaacgatgaaacgtgagtcaaaaatatatatcatctactcccaaaacgaaggaagtattgcaaattaaagctgatgcttacactgccggtagcaagggtaggaggtgtcgttgagaaggttctggaagccgtcgtggcaggcgcagcggtggccgaactccgacgacctctcgcagctgccgccgtcgccgcagtactggaggaggcaagctgcattcattcaggcaacaatcaacgacggcgagaattaattaacgccatgatcagctaaagctaagaacagtttaatttgacgacatgatggtggtgattaatcttgtgggttttgagtgcagtagttgagagattattacggtcgtagatggagaggttcgtcagcgacggcatcgccggcggcggaggaagtggcggtggcggcgacggcgacggcgacgacgacccgttctggcacgagtagttgatggtgcctgcgaggaggaagagtcaacggtcaaactcttctctgggtaatcactgttctgcctacgtggcactacaagtcagtccagcgtgcgtaactacgtacacgtggcaactctttgtgactttcactttgactttggggttaaccgagcagtaaagcaattaacagcttgtactctgcttctggaatttggacttcttgacacgataagattaccgtaggcacgtactataataacgttacaacttactacttcctccgttacacgatgtaagttattctactattagtcacattcatattgatgttaataaatctatatctagatttattaatatcaatataaatatgggcaatactagaatgacttacattgtgaaacggagggagtaactcgtttgttctttcaagaaaaaaggtgaaatttaactcatgtttcatgagcaacttaatccaaacatgtggtggcaaagtccacagatgcagtttggacctttgttgcacgccgtttgaccaataacaacacaagttgaagtgtccattcaatgggtttgactatggcctcgtttacttcccaaaatatttttcccaaaaacatcaaatcgaatctttaaacacatgcatagtgcattaaatataaattaaaaaaaattaattgcaagtttgaaaggaaatcgtgagacgaaccttttaagcctaattagttcataattagccataagtgatacgataactcacatttgctaataacggattaattaggcttaataaattcatctcgtggttttcagacgagttatgaaactagttttttcattcgtgactgcaaccccttccgacatccggtcaaacgttcgatgtgacacacacaaattttattttcgccaactaaacaagccgtatgttagaggaatcttcccacatactcctagtacttagcaagctaacatttttatatttgttttttaaaagccataagttaatcatacacatttaagctaaaagtttaagcatcttattatttcctatttgaagtacacgtagaactacaccattgaacttgaggcttaaagcgcacatcgagatctctaaacttggtttattgtatcatttcgatccaaagcgtcgtttgacagtggtcttacctacgtggcacgccacgtggacgatgacatggtgtttttttttctttctctttttctttttcctcctattcttttatcttcttcctccactagagctacctcgagctcccccgtgtcaaagaggccgaagaagagagaaatgaaagaggaagaagagagaaaaaaaggaataataataataatgtgccatgtcgtcatctacatgtcatgtcaaatggacaagaccacggtcaaatgagactttggaccgggataatataataaatcaagtttagggacctcgatacatgctttgtaagtttgtggatctaaatgaaacctgcttacaagtttaagaaccgcaagtgcaatttactttaaaaaaattaggtacattctattctgtcacttgggacataaaaaggtgctatgtctgaaacatcgatgcctataaaaggagcgttaattgtaaagctaggatagtcgatggtggagaagctaatgacaacgttaagctatgatgagcttttattagctatcagtaggtttttattaatttcagataatggattaattaaaaccacgtgacctctacgtccaaacaaaatgtaacttgacaaaacctagtattatatggacagtttttagtagccgatggccgtggtgtttgcattaaacctaagcgaacacctctgcacaatcgatgttcacgtggttaactattcaaatatgacctaaatcccgaaccaaccgttaccacgaaattcagttaattaaccaaatattttcctggttataatcttcagtggtataacatttttcccctgatataaaacttcgcactatggtgcgggtcgtttcggaaaaaaaataaaagaaactttttttcagcccaataccatcgcacacacaaatcatcaaagagattaattgggaaatcaacaaatataggtaagtaaatcttgagaagagatgaaatgaaattacagttgggtatgacacatgggaggaaggggaactgcaggttgccgaggtggtagcggctccacccggggttgcacctgcacgcgaacccgaacacgtagtcgctcgactcgctgcagctccccatcccgcacctcaccttgctgcacctactcccatctccatctgcaaccaaccatgcaaccaagcagcaattcaaccaccaaaaaattcagacaagaaaaggagagaggaacacccatcgatcatgcactcaattagctagcttgcagtactattcaggcattcagctgctcactttgtgctcctgctccatctggcagcatggcgatcatggcctgcagagaaaccatcacaagaactaatctgactctgctgcacttcatcgtctctaatttcagagagttcagagagagagagagagagagaaggaaggtaagctttgtttgcaggaagataggaggatgtagtggcgacttatatatttttggcgtgatgtcgatcgcaatggcgcttggaactaaattaagactaaaaaagaagactgcacctcaagttataccgtcagatttgacagagaaaaaaaatggtcatcaccctaattaattgggcaacatatgcgtcctctccttgcttgtttcttccagaacatggagacgtaggagcaataatctgtgtgaaatgtatggatgaaactgtcttaggtcaattgatgtccatacttgattaattattaattgctctagttttgcattcactccaggccagtgccggcctggaatttctttcttccgtgtggaaataatgaccgagaaatacagataactgaacttttctttttctggttcattgaatggaccaacatttggtggcttggtgcttgctgaaatataatacctggctgctgttgatgctgttgctggtgcaatgatgtggcgtgtgttctttgcttctcgaaggttgaaaggcttgaagcttagagtcaacctttgtgtagggactttttcatgcacctactaaatcatgtctaaaaaaactttaaatctttttttccgtattatgattgtacgagtatatgataaaacagtattttcagtgttgggcttttcaccgaggcttagcttcgaatttttatttatttttgaaatattttaatttttattttgaaaacaaacccttcaaaacctaattccaaaatctaaactcttttcttcaacaccacctgtgacgtgacagttttattttaccacccaaccaaaacaatgttatcgctactccctccgtctcataatataagatataagggattttgagtttttacttacaacgtttgatcactcgtcttattcaatattttctgaaattattaattattttatttgtgacttactttattatctacagttctttaaacacaacttttcgttttttagatttgcaaaaaaaaaattaaataagacgagtggccaaacgttacaagcaaaaactgaaaatcacttttattgtgggacggagggagtaaaagatttagatcgggaaatagtaaggtttagtagtttttttaaaataaataaattccttagattctctttctcacatgtcggcctcggctgtgtgtagtgtaccgaacagaacatttgggtgtagttattatgttctaaacttgtctaaaatttggctaacaaaattaataaagacttgcatgatgaacaaggaatcttgtcagttgccacaagtgtgactacagaccaagccataaccagatgaccaactacagaccaagcccaggctgcatagtctcaagtacaccaaaaaaatacattcagatgtgtcagttgtccggacccatctttcccttaaagttggaaaaaagaaacaatacctttttttttcaaaaccatatcatttgcaattgcattttatcaccaatcccctacaacaaacttcccaacatatttcagctcccgcagcccatataaacaaaccgggataaaacacacaatatcacagaacctaaaagaagagaaaactgaagaacaaaactttgtcatggtgtctatgtcagttcatgttctgctgaagacaatgaaaaccctttctttttgttcctttctttcggaaactgtgcagaggaagaagatgccaaatcttccagcaagctgatcaagctacaaagagggagtccaccgaagggacctgcgtcctgcagcaggggcagtctggttggatggccagccaggggaggacgcactccgagtggtacttgtgggagcagggtagcctggtgacccgctggtgtcgctcccgcacttcgtcgaggcacacagcgcagagatcggccttggaaagtgtcctcctcatctcgcggcggggggcttttcttgttgatggcgcctccagcatggtcatcgaatgtttgggagtaggcctgggttcagtgggcagctgaatctgctgctcttgctggttgttctgttgtctggaggttgtgctcccatctcgttcgcgaaatcgcctgccccacctgcgtacgtaactgattgttagctcacaggaatatcgatattcagtttttgtcgttttgctactccatatcgaagcaggaagatgtttatgaagagaacacattgatgatggatgagaaaatgccaaatctttcaaaaagaattcaggcaagtagtagaaaaaagggtattgcaaaaaaatccctgaaccctcctctggaaaatggagatgtctggttagtgttcttatttaggtaaaaagtatatgcggaattaaccaaatcaattgagaaccaatgctacccaaatctgataacagctatattattctatatgcattttcaatttcaaacatctgataacaaaagctacccaaatcaattaaccaaaaccaatcacttgtgacaggtttaccattcatgccagtggtaatcccaaaaactagtaacaagatagttactacattttatatgctgaattgattactataatttgtgactatacccataattggttgtttggttaatgaagaccaggtcggatctttcaccggtagttttgtcaattttaagccaagctgcacaagcaagaagccatgatgtactgaaggatgattctatttactgaacaatccagaacccatgcagacgctgtgacgtctaaatcacaaatacgcgggaaaaagggcacacgcctttcgcatgcgtgtgcagccgttggcctaatttctggatagtacccaaaacaatcaaactgaaacagtgatggcgtaaggcatacatcggcaaattccctgtgcatatcattgtgtggcttgatctaacatgtggtagttttcagaaagcagagacatcagatggtgccatccaactagtttggcttatggctatacaaaataagatcacccacatggattaatcataaaagacgtcgttatcagtgggtttgcaggaagcttaaaaaaactaggtgattctcaatagcctcgtatcttgtcttgggaaaaaaaaacaaaggtgttcctatatcttttttttaaggaactaaaagtattctatgtctgaattttgctagtacacatggaattaaaagtattctatgtctgaagtattgtggaatagctgaatgctgaaattaagcaaagcctgatacactgttcatatggaattactcctatgtgataatatatagcttctagttgaatccaagaaactggttgatgaaacaatcagatcttggctcccttcttgccatcgaattcaagaaccgaccgatcctctcccccaattcgagcagaagtaaaatatattagccatgtagaacgcgatctttttttccacgagtccatggctggatctcaacacaaagaaaaggggaacagaaatgaacagggaaaagagggcacggatgagggggattcattcacctcgagagagacgacgagggcgcggccgcggcgccccgcagcttctcctcgagccggatgcgcgccgccaccgcggggctcacctcgccccctgcgcccgcccccgcctccgcgctcgccaccgcctgacggtggtgctgctggtggaagtagttgtagtgcccgtggtggtgctccccaaaccctgcccccgccgccgccccgtcgcggtggtagtgcacccgccgccgcctggccagctccacccccggaagcatctcctcctcgtcgtcgtctcctcgatggggggttggtgggtgggagagagctcgacaaatttctcccggcgatttataccgagggcgcgcgatggcggaggaaattccgcgacggcgacgagaaagacgacgacgacgtgacgtggggtcttggaagctgctaggaagcagcagggttacttggggaccttgaggttggggtggtgaaattaccttttcgcccttggcatgatatatcctccatgattatccatccatgcataggtttgttgctagtagcttatacatgttttttttttaatatcttgaatctatgtttggtgtcttaggtgagatggtgtttgtgttggtatggatgatcgggtgatataaattatatctggtgacgagaacgggttttggattggctggctggttacttgacgtatcagcgcatacaaatagagtagttaacggaaaactgtaggggtacggtaggtgcgtgcaaagttgctttttccgccaatattgaatgtacgtaggacaaaaccgttgcataacaatatagatctaagcggtcgtttgagtgattaaataagtgaacatatttagagtttttttttcttttgaaacgatgacatcatgaaattagaaccgtctgcgtcgagccatatagtagataagtttccctctagttaaaacaggttgtagtagtgtcattacttgcaagtaacaactattgaagaaggtagataaatcagggctagctttcttggttaaagagacaagtttcttatgactgaaaataaatgaaaaaaatatgttgagaagtcttcgcagttcacataatagaattaaccacaagctatcaaatctcactagatacggagatcgtttatgcttctggtgtaataataattgtaccctcatttccattgtgagtgaagaatcgtctttgtattaattagtttaccttaagaaacacttcaaaacatgtcttatattgtatttatatgagtcgataagttatgtatctacgtttctcagagcatatcttaacaccataccttcaaatttttatctaagatgtcaaccaacatctaaagggttattcggattaatgccattttaaaccataccattttttggtgaagttgtcaaatatatgcatctatttagttcctcaccgaactctaataaatacataagaaatcctacgaaagcttggtgataccgttaaattgtcaaaattttggctacaccaaaattatttgttaagatttattttagttataatttgaataggtcctaacaccgggagtaacactataaagagtttaagacattcggtttcaaaaaaaggaaaagaataaagagagattccgatatgcccagctaaagcaacggattccagaaaaccagcttcttttcatctagaagtatcacgagatacttggcaccctgtttccaaaggggcaaaacggtcaagccacatagtgtcacggatgcttcgcagcagcttctccagaaaattccgagagcgcatgaaaaaaaaaagaaaaagaaaaaagaaaggcgaaaccgatatatatgcacattggatggacatcgtcatggccttatcaatcgatgatatcgtgacgttgataataccgagtcagaggttcaggactttgaataataggaacgaaaaaaaaaagaataaaagaaacataagatttgtatagaaatataattgcaaacacaggagaaaaaatatataggaatgaccgtttgattgaaccacaagaaaaacaaaaggatttgaggagagataaagatttttaaataattattttcatgaggttctaacttatgttagtgtgtagccgccgggggtactatttggggacaacttgcatgaagaagcctccaaaacttatatgggaagagacattccataagaaatttataggttttattcctttgattcaaagggttatgtaaaaaaaattctatagaaataaaatcctctaaaatttataggttttattcctttgattcaaagggttatgtaaaaaaaattctatagaaataaaatcctctaaaattcttatgattttccattaaatcaatggggccttctcggttggcataactagttaaagtaaaagtataaaaaaaattcgaatgttgattctaagaaaattttaacgtaatttttttaacattaacttttgagttgttacgaacaaatacataaaagttttacctataaattgtactccctctgtttcaaaatatttgacaccgttgactttttagcacatgtttgaccgttcgtcttattaaaaaaatttgtgaaatatgtaaaattatatgtgtatataaaagtatatttaacaatgaatcaaatgatatgaaaataataaataattacttaaattttttgaataagacgaatggtcaaacacgtactaagaagtcaacggtgtcaaatattttgaagcggagggagtatttattagggaatacaggtagccggtgagactcttcttacttatgtatggtatcggctggttcccgattaatttcggttgttccaatcaagtctattgaccggaatggctgaaattgatgtcacttgatcgatctggtaccattcttctaaccaactaggtgaaaccccgcgcattgctgcggaaatttagtatgatagcaataaaaaaaataacgtgtaaaatagctagataacatcagattaagtaaattaatgtggtttatgataatttaaatttaaatagtatgtagaatggtgatttaaacgtaaaaagtaaggtggtatgactttatgaaagaagaaaagtagtgagatagtttggaccgtagattaatcatctaaaggctaaaaacaattaatgtgatatgacttaattagaggaaaaaatgataaagataatttggaccatagattaattatttaagcactaactgaggatgaaccatataagtatataggatattataaaacataataaagatatacattgaaacattatgtgaattatattggataataatttaacatgtttgtatttgaaaagctcttaaattataaaaactataaagatatagcatgtttgcatgatgtttaaatgtgatgattgttagtggatgatgatgtgtcatcttgttagtggatgatgatgtggtatctttacatgttgagcttaaggagttagtgagggataactttacagtaagataggattccgtcgtcgaatttggtttaatcagttttttagaactatggtttaatcaattccttaactatgtttagctacgaagttatttttgtctatgccatatattgggccggtactgaccggagtgagatcgaaattgacataccggtatacgacttgttgttctacaataagtgatccttctaccgaatatggctttagtcgatttgaattatgtttaagtgtttaactattaagtaacacatatatatgtttttggattaagtgtttctctcattactaccatcgttgtcaaatattattatttcgcatgaaattttgatgaattgatgttaataatagatttatgatgttgtacggccagtatagtgtcattcccgtgaaggcagtcgaaggggttactggtatgtcaagcggcgtgcacgtcagtagtagagccatgtggatgttgtcgttgtggcaatgccgtcgatctcatccattaatgttgtatgatttcatttgcaggattgtttttttagttctaccacccttactttcttctaaagggatggttttgttctgtaagcatgtgtttgttttcgggattaggtgggatgggataaaaccatccctgattttggggttgggatgattccatttacttgtttggtttgtaggataggacaatcctaatttttttgtttggttgaagggatgagcgagagatgggatgggcgccgtttgctatcaccatcagcgagaaagaggagagtgagcagagatgtgtgacgacagccttgtgggagctcagcgggtgggcggatgagtgcgacgatggctagcggcgagaaggagtggcgcaagattgcgagcaggcggacagacagaggaggagcacggatgggcgagcaggggtgcagttggaggagcacgacgatggccaagcaggcggaggagcgcgacggctgtcgcgcgggggaaggagcaagctggcggcaagtaggtagaggacgcggatccgcctccaccgccatccccaccactaaatccgccgttgccaagccccccgcggcgttgagcccctcgcggtcgccgtcatcaagcctcccgcggccgccgtcgccaagcccccgtggccgcagccgcggtcgccgtcgccgagcatgccgcggtcgccgtcgctgagcccgccggtgtctgccaatgctcctgagggcgagtagggcgagcgcgcaggccggccctgagctcgagcaacgcgtcgtcatgccgttcgctcgtcccaactgggacgagttcatccgccagattttccccggacgggtggtcctggatctgagagggaaattcctctccagggaccaaccaatccgaatcacccctcaaccaaacaaccccaaaagtgggttcgtcccatctcatcctatcccatccttgcaaacaaacgcaccctaacatctttggttgtagacattgtatcggggatttcatatcctctgaaccctgtctttcatctatactccctccgtcccataatatagcaacctaggatgggacctcatatccagattcgtagtcctaggataggtctcatcccatcctaggttgctatattatgagacggagggagtaatataatataatataatataatgagttcttaaaaaaaaagacattccactccttagagccaaattcaaatggcctctaaaataaatttgacaagctcaaatggtctctaaaattttagatcactcaatgactcaatatgatatatctaatttgatcataggttgctatattttgagatgaagagaatatttttttttcttcatccatttgcagttgaccctatactcaatctgatatatctatcactctatgtgcctctatcctaaaataaattacttcggtagtaactcttatgcacgaacatggacatatcaactttcatacataaaaataaaaaagaaacaatttattttttaagacagagtgtgtacactaaaaaaaaaagctcacagagattggcattataggtgccggagcagttaaaaccggcacctataatacttttcccttccctacaagttaaaaacacataaaaccgacaccttgagtaattataggtgtcagttttaaagaaaaaccaacaccgtatcagttttttattcaaaatcgccacctagaatttattataatggcggttttgtataaaaaaccggcacctatatggagccgagccggcgagccggccttatccatccgcctgtccttttattagtcgctcggtcgctcctgtctctctctcgctcttgctctctcgcctccctccatcgctctctctctctctgtggcaccggcggcccgatggaggcagcaatggcggtggcccgtcgaggtaggcacggcggtggcccgggggaggcggcagccccatcgaggtaagcgcggcagtggctggcggcggcgcgccctcccctccgctggatccggttggaggggaggtggtggaccttggggacggccgggcggtggtccggtggaggcggtggcggtggccgcgccctcccctccgcgagatccagccggagaggaggcgacggaggcggcacagcggctggcagcggacctcagcggaggcggcagcagcggctggcggcggccgcgccctcccctccgctggatccggatggaagggaggcgatggacgtcggggacggtcgggcggcggtccggcggaggcggtggcgccagtagcgcccgatggatttttgaatgattttgtagttcttttagatgtttctgtgatctgtggatgattttgtttctgaatatgtttcgatctgtgatttgtgagggtttggggatggcgcaatgactacgattgtgagttccggcttgattcgagccggctctttttttttttttgctcgtgcaaacctataggtgccggctctattttggtataggtgccggttgtttttattggtgccaaccaataggtgtcggttggaaaaccggcacctatagtcggttcccaaccggcatctatcatggctcttgtactagtggtataggctaactgcagttaattactcggtggtttcgttatttgtcctaaccatggaccattgggtctccatcgccatgtcactgtctcatatctaattggccatcttatggatttatgatgctgagatatgtgaacattcccgttaactcttgatggatcgatgtgaaaacttcaagggtttgtgccctagattatcttagatataatgggcgagctggtttattcagagtcttcaaaataaatgtttcttggcctattatgccaccacatcaatatgaaatgaatctatgcgtagacaatgcaagtcactacaaaagcacatgaaaattttggacagaagttaaaattgtgctacctctttgtcaaaaataatataacaacttaatgatgattctggacataagatatacgatcaaaactcattatatttttgagatggaggtatagtatgatttattgttaaaccaagaattaattcattaaacacggtgcacagtgcacacagtcacacagataagagtacgtactgatatcgacttgattgtcatttaatttacataccgctgaaaagatcatttacgctgattaaacatgcacttcattgtgtaattaggggtcttattatattaattagagagtagaaattggcgagacctccttaattatggcgatccgtataacagcccatatatatggcacgatcgcaggccgtctgtcagagcccaaaattagtaatgggccgtaattttaaatggcgatatgctaattccctctcttcaataccgtacctacgtacacttcatcactgaagaaattaaggaaataaagaatgcttaccaaaacttaaaacggaaaattaaatgttgacctccgatgtttagatcatggtaacaagcgcgttatcttttcgcttatgtttatgcttattagctaaaatttaaatttttaacattaaatttggagctgattttgatttttttcatcaaagtttatttttcagcctttgcttttaagtcgctaaaaacacgtatatgaatgttttatttacaaattatgtttcgtttgcaaatatgttatttggtttattccttgtgtagtctgcgcatatgtgtgtgttatgtggaggattatggctgtgttcgctgtagcatgttcccaactagaacaatgcgcacggaaaacggaacggttcattagcagcacgtgattaattaagtattagctaattttttttaagaatggatcaatatgattttttaaggaacttttgtacagaaactttttgcaaaaaaacgtatcgtatatcgtttaacagtttgaaaagcgtgcgggcaaaaaacgagggagatgagttggaaaacctaggtaagaacacagcctatatgtgctcgtgctccacgaaacacgaaaacgaaaacatgtccatgtatttccttgtaggattgcaatatgattttagtataaattaaaatactataaggttgttgcaaaactcatagatttcaaaatgattggtatcgtatccaagaaattaagtgtcctctctataattgtttttcgatcaatagttttggggacaaatgtgtggtgcggtaagtcagtagcaccattccttatttactccctccgtcttataatataagagattttgggtggatgtgatatatcctagacaacgaatttggatagaccgggacggagggagtagtatttacaccccctaaatctttaaaaaattaatccaagtatacaaaataaaccaagtatatgtggtcacctatttcacttacacgttaaacttattagataaaaggatttctgttgatttgataaacctatacaaccttcccaccgtctcatttctttattgggtaatttggaaccatgccattataattttgcaaagtttgagatatgccatcggtatctcaatgacatgtaggatccacatgagtcaatgacattgacatgtgggtcaggatggtatatctcaaattttataaaattataatggcatggttccaatttttcctttatttatccaccgtagcttaggctgctttcggcaatagcagattgatgctttctaatctaataaataatgtgtgttttttgcaaaaaggtttttatatagcattttttaaacaatcatattaatccatattttaagttcaatatgattaatacttaattaattatgtgcgctcatggatcacattgttttacctaactggccaattttctccttttatctcctctcaagcatataacacaattaacatttaaagtcaaactagtaaaatacccaaaaccctctcaaccatccgcgaggagacataaatagcacactccaaaccgcaataccttaggaagggaatgtttggtagagattgaactcctaaatttaggttgaagagttgggactagagtggagttgtggagcagcataaacccagcttcacctctctagatcattttgtgagagagctccacccaactcctccctcatttcaggtagagctaaggacctgtttagcacatagctggagctcagctaaacagtttcagctccacctaaaatggaagcggagctgagtggagcactcgcataaaataaactagagagatgtgaaggtggatttagacaactccacaacttcactacagacctaatttctgaagctaaagttagaagttagagctctattaaacagaccctaaaacacagttggactaagaaacgcttgaagaaaggaaaaaaactgcaatatcttatttctcttgtcaccttcaccaattttctttccccgttggtttgccacctcgccaaaaaaaaaaaaaaaaaaaaaaaagccagaaccctctcacgtgtggatccaccgttggattggaatggaaccccctcgcgactccgccagccgttacctcgtcctcgacacgccatccttttcctcccccacgtacaaaaccccccctctccccctcgcgctgccacgtatcgctctccctcctctctctctctctctctctctctctctctctcttcgccgcgcggcggaggcgttcgtcgcgagctgtcggcttccctcctcgcgcccgcggcggctgtggccatggaggtccccatctccggcggcggcggaggggagaggttctgccacgcggcgcaggtggtgggggcggacggggagatggacggggaggcgatggcgcggttcgcggcgggggcggggctcctgggccgtggcctctcctacgccgtcgtctccatcgtcgggccccagggcagcggtgagagaaccttaccccctccctcctcctcctcccacgatcaccagttcaccacccctccatctccatgtagagagcagagtagtctgttagtacttgatgcttgttgtgtggttgatgggatatcgagattggatgacgctagtagcatattctgttgcggaagtgtttttaatttttttttgcaccgattttttactggacatgtttgttttggtgatttggataataatatggtagttgaaattgatgtcgggaacatctctgatgctgatgctttgccttgttactctggctagggaaaagcaccctgctcaaccaactcttcgggacaagcttcacggagatggatgccttgaaagggaggtaaacatttacattgctgctgcccaccgaaatgcatgcgcgctgcttttcttgtttgctcttcgattgcattcaatcggttgtctcacatttggagctaagatgatggattctgttcctgttttgtttgtttggttgttgtcaggagccagactaccaagggaatttggattgccaaggctgtaggcattgagccgtttactgttgtaatggatttggagggcacggacggcagggaaagaggagaggttgagtgttatgtgcttttattataataatgtttatacgaataaaaaaccttccataccatgtttccttttgtaagattctgagtacaactcttccatgccatttctaactgcgtaaaatatttgatgttttatcttgtggttaattagtagcagtagtcctgtgtacctgagtatttaggctgtggaaaacaaaaaggttgcttttctagtacttgctttatccacatgtggcgttgtctcccttaataagttttttgctaggaccttagggccttatttccaaaatagttgccatgtagtgggtgtcattagaactcggcctgcaatgagctgtaaatgctggtattgttgttgtagaacaattacttaatcaccctgtacagctgattcatgggagcatctattagaaatgcaaggaagtcatgcattcatactaattctcaacgcattcctgttcaatacttttagctgtgatttctagcatcaactctgaatatctgccgctgtcatttttacagtaaattgtgacatctcttttgttaaagtgatgctctatatctttcactttcagtctatcaatctctgtgaaccgttcatttgtgaagctacatcgcattcggtcctcatccaaattccatctgttatgcttgcaggatgatacagccttcgagaagcagagtgccctttttgctctggcagtatcagatattgttatgataaatttgtaagtttctatatcgtttgatacttcattattggcgaatataacgttaatgagtcgggagaacttcattttgcttttctcaaccttcttatgtggcttggtgaatatgccttttataggtggtgtcatgatataggacgagaacatgcagctaataggcctctgttgaaaacaatatttgaggtagcatccgtctcagtgacactaatcatgacttttgtctcagttacatattttaatctattcgtttttctctttctatttgaggtattgatgcgtttattcagcccacgcaaaacaacgttgctacttgttattcgcgataaaaccaaggtttggacagtctcagagaaaaccaaataaaatttacaaaatatgttcctcccatttcttgggcagacatccttaactggtatgagttttttttttttattgtctctgcagactccactagagtatctaacccaagctctgaaggaggatatccagaaggtgtttatgtcttatgttttgctcagctgcctttcctcattgccacactaaaggttttaccacttcttctgttcttacagatatggaatgctgttcgcaaaccagaagtttacaaggaagctgcactaagtgaattcttcaatgtcagtgcttaggttttctgaagtggaagttgcatatataaactgaatatatatatatattttgttatataaaggtggaggttactgctctgtcaagttacgaagagaaagaaaatctatttaaggagcaggtaaaatacttattttttatcctgtaccacagaatgttctttctactaattgcataatcacattcaccgcagaatgaaacttacaacttgcaagcgtgtcacttcaatggagacatattgtattgttacttacttctattgctacaggttgggcaactcaggcagagatttattcattcaatcgctccaggtggtctagcagctgatagaagaggtgtgattcctgcttcaggtttttgtcttagtgcactccagatctggaaagtaatacgggaaaacaaggatctcaaccttcccgctcacaaggttttttgtgcctttttggtgcttttgattgtgaacaactaaatacttgcattataatcattaccaattcaccactccatgaacttagttgcaaatcatatattatattttatctgttccatatattctgtagatcatggttgctactgttcggtgtgaagagattgcggatgaaaagctcagaagtttcatatctgataaggtagcgtgttctcattgttgtatctatacattattttatttaattggtaccatgagaattaactattcatctctgcagggctggttggagctagaaacagctgcaaataacttgtctagtaccaggctttggaaagaagcttaatgctattcttgatttttatctatctgagtgagtgatatgactaattatccttacaatgttttcaagtattaaagtgtttctgttcttgcttaacatgtccattgacctgttagttttattttctgctatctatgactaattatcctatctgcagcatgtccattgacaatgtatattttaatggtaatctgaaagaatggatattcctttgttgttcttatttatgtttcttcttccaatggttttggagttttctttttctagtaaatagactatgtttggggtcatggatgccacaaagtaaaaatatagagttcttagattgcacatgtaacaaatgttcatttatttttattcggagttctgacagtcttaacttaacattttcctgcaggtatgacacagaagccatgtactttgatgaggatgtgagaaccgctaaacgccaacagttagaatctgaaatcctaaaagtgagttactcatttctatgttactaattccagttatggcttagagaaagtagtttaaccagatgatggtgtttggttatgaagattacactagtcaatgtaggaaaatgtttgtttttcttaataattcttgcttgttcatgacatttcaaataatggattgctaatatgcacacatacattcgaagaaaggtcctataaatattttaggcactctggataattacagtgataattgcatatatgactattataatataaaaatttggctcttactaattagagaggatgacatctgtcagaaaaatgtaaatcgactgttttatttgtccttatttgatcaactggtctcataaatcttgggttttgcagcacacatatgatgctttcaagaaaatgttagaacacctgcatcatgtggttctgaacaaattcaaaagtgatctagaacaatcattaaggagcggtgagggatttgcagcatcagctcgttattgtgtgcagtcatcaatggcggaatttgatgctggattgagaggtaaacaaaccacggctaagatttattgggactaaaatatttagccatttgtcaaatgtgacatgcatgctgacctctttctgctgtcatttttttgtcctgcaaatccaatgctgcaaaagccaaatctccatagtttggtgctcatttgatagttttattgtcaatgaatgtctaaaccatacgtcgactagtactatgagcctttgcttcttgatcttgttttaagcctcttgtgcttgctcctgccaaccatattgtgtatgtttttcaaataatagtttattcattcagattatactagaaatacggcaatgttcaacataagtaaattcctagtagtttgaagtaatgtgatttgaaactcatcattccttaaatctttggtttacgatacatgacatcaagtccctccattgtcatgcagatgctttggttaagcatgcagagtgggacacgacaaaagttaggagcaaactggagcagcatatagaagctcatgcaacatctgttcggggtacaaaactggctgaactaaaggctaattatgaggttatttttcatactcagtgcacggtttattattgcaatttcagcatgttcctagaattccccatttcatgagttcttacggtggatttttaaaaaaaccatcctcatgcttggaccttttgttgccgcaatgttcagaaaaaactcttggatacacttgctggacctgtacagtcaatcttggaaactggtgaaaaggactcttgggcatgtattagaagactttacaggcatgcgactgaaagtgctattttggcattctcagcttccctctccgagtttgaactagaccagacaactatccgtaagatggtcatggaattaagagaacatgcaagaagtatagtagaagagaaagctagagaagaagctgggaacgttctgatgcgtatgaaagaaaggtagaatctgctactattatttttggaggaaaacttagcaaacatatcttgacttttcagggatcacacttaccatttttggaacatttatcttatctctacctgtttaattggactctaggttttccactgtgttgagccgtgataaggattccatgcctaggacatggaaaggaaatgaagatatacgtgcaatcactagagaagcacgcttagcggtatattctttcctgttgatcaatattgcactcatttatcctgatctatgctgtagaaacatgatctatgtatcaccttcccactgcaggctttaagacttatgtcggtaatggcagctgtacgtttggacgataaaccagataaaatagatcgggctctaacgactgctcttttagatggaggaccgctttcacagaaaaggagtattgaattcacatctgatcctcttgcttcaagcacatgggaggaggtgctgacacttagatttagaaatttatgatttagaagggcaaatgtgatgaataagtcgttaacatttttaagtctgtacaggtgtcagaaaagaatacgctgatcacaccagtgcagtgtaaatccatctggaggcaattcaatgcagagacagagtatgctgttgcacaagcaatttctatgcaggtatatttctgggccatttctgttcaagtgggccatttctgctcaagtgcttatccagtatattgcataacactgatttattttgatcaaatggataggtaaaacataactgaatttgttgttttcttattatgaagagtgaaccatgaaccctggcctgctaatttcagaggcgggtcttcaatgcccttaaaaaaatactaaaagaagtgataagcttttcatgaaatatgttctttttgtccattatgtgaaactccatttatgatatttctatctgattgttggtgctctgtgcttaccaaattttcttccaccaggaagcacacagacgtagcaataattggctgccacctgcatggactgttttgcttctcgcaattttaggttacaacgaatttatattccttctaaggtaatcatctcaatgaagtagctttcttatccttataaacgcataaactgagaaatccgaacttgacggttaacatatgtaaccactaaccagcatcttctctctgtttatgaactcttggacaggaaccctttatatctgctggggctcttcgtcgccttcgtagtatcctatgctgcatggttgcaatatgacatcacagcctattttcgccatggcacggtaatattctacagaacgcgtttcgcataaattacatcccagtgcttttttatcaaagtcgctgttgctagaaaggagtaaaggggctggatcaccttaactggtttcatcaggcagaattctgctcttaatttttattttagataatggataaaaatccggcctctatatccacaagtggatatacagagccaaactgctcttaaatttctatctagtgcatttcagttcaactgaattacacggcatgtattcaaactaaatctcaaggatgttctttcatatgcagctctcaggtcttctgactattacatctgggtttctccccacaataatggacatcataacagcagtcatcaacatgagtcacaaccagaagagctcctcgcacccgcctcgacatcgtcccccgcttcatcctcaaagcttcaggaaccaggcgcagcaacagtctcaggctcaggtgcagtatcaggctccaagttcactgtcatcatcctcttcggtgggctccaacagcgatgacgaatcctgaagcctcataaaacatccctgtagaagacacgttccagtctccaggaaggactttgtataaaggaaaaggaaaaaaaaagaagacaacttgatgtgtaatgtactacatacactgtgtgcatagctgtgagcagagttggtgatagctgattagctgagcagcataagttcctggataaaccaactgtatgtcagtatgtgtagagatgatggatgaaatgaactagatgtcgaactaaataccggagtaatagtaaatttcttcttcgtggttacttaatacaagccttgggtttgtctctgagttcatgcattctctttctgaaaataaaaatgtctgtccatgccatgacctgcatatacatcacaatgactccatagaaccaaactaactcgattcacaggagcatcttcttccaccacacgcaatgccgcatccctacatcattcagtcagttcagtttgataggagaaaacttcactactgttatactgaattactgatgcatgcaaggatctttactggtgtgttaaacggattgatacagtaacagaactggatagagttataaacttgctcgcttgtgcctgcagctatgcaccagcagcacaaattctgctgcagatgctgcagaagtcaacccttccaagcacccctctaattaatatagatacagtgggtaaatatgttcaatgaaatgtctcactttacccaaagttactgtaatttaatttctttgcattaagcagtaagaaactaccgcatcatatggcctgaaactgacactgacaaacctttcaaatgtattgttctgttctatgttaacattaacagaggcatagagctttcccaagataaattgctgacttgagatgccttctagttagcagacgagttaattagtactctaatactactaattatctacctgtacaatttcgttttcctggttacatggacatgtgtgccgttgcagttactgtaaaattgccgtcagtttcagcatgttgcagccttgcaggacaggaaattatcagaatcaacagagatcatgcaacatcttatgtctgctgctagccccaattaataatactgtacagtgatgttgtcacgctagcttgatctggacttctggaatgatcataattcaggattaacaggaacttggcggagaacaaagcaatgcattttctcaagcagagtaaaagtaatttctcacaacattggaaattccagattcattccgtcatctctccagcgctagcttacacatagccctatcatttttatacagcttatctaccattttcttaaaacaaattatttgctttacacggtataaaaaaagtacatattagggtggcatgattccaacaaacccttttttaaaactactttattccaccgcatcacttagaccactcttttttagctatatgttattttcaaaatatgtaataatttacgaaaataattcgctcaataatctaaagggaaactattttaatccctcgagaggatatcccctcgttcaaatttaacttctacatttcgtaatgaaaaaaaaacaaattgaaccgcagctagttaacgtatattcagagtcaaatttgtttttttcgttgcgagatgtgaaagttgaatttttacttgcatgtttatggagtgatatgttacatgttaatacattttctcgaattttttcaattttttttcataaccatttaagtgacatacaaacaacgagagtatatccactcgagggatcaaaatccacttcctaatctaaatcaaacaaataccttactcaaagggctctcactttatttatctcttctttttcgcgaacgccactttatttatctcatacatacacctcttccaagcacaagtgtactgcaacaaccggatacatagacatagtagacactagctagtatatatagcttccaagtctcccccagatatatagaagctctcctatcggagagagccatggccatctatctcctgctcaatttattcctctcccctccctcgcgtacacattcgtgtgtgcacgcgcgcgagcagcacagcactagctctaggtcgatcgaccatggaaaccctagctagctataccctacacccggcgaagcagtatcttaattacgttacctttaattacactgcctggaggatggcttcggcggccaccgtggcccatccatggcggcgctcgtggcagtctcgcatgcaccgctgcctctcgtgccactcgcggtggtgctggcattgcctccggcagtggtcgccgccatggccgccgccgccgccgtggtggttgtcatcgtcgacgacgtcgtcttcctcctggcgcctgtacctgcagtcctgcatgcattgctgcctcttccattggtcgtggtggtgctggcatcgcttgcggcagtgttgctctctctcgccgccgtagttgtggtcttcttcctcgtcgacggcggcctcttcctcctcctggcgccgccactgcctgcagtcttgcatgcattgttgcttcttccattggtcatggtggtgttggcactgcttgcggcattgctgatcgccatggccgtcttcttcctcgacgacgtcgtcttcttggcggtgatggtacctgcaatcttggatgcactgctgcttcttccactggtcatggtggtgctggcactgcttgcggcagcgatcgccgccgtggttgtcgtcttcctcgtcgacgtcgacggcggcgtcttgttggcgctgggggtatctgcactcctccatgcattgttgcttcttccactggtcgtggtggtggcggcactgcttgtagcaggggtctctgccatggtggttgtcgtcgtcggcgtcgacctcctgtcgccggtggcggcagtccatgaggcagcgctgcttctcccaccagtcctgctggtgctcgcactgctcacggcagtccggcctggatccgccatggccgccgccgtggtggtgctgctcgtggcggcgccactcgcactgcctcatgcactcctgcttccgccacggctcgtcgcggtagccacggcactcgcggcggcactccttgccgccgccgccgtgcgtgttctcgtcgtcgtcgtcgtcctcctgctgccgctggagacactgctcctcgcactccctcagctgccgctggtcctgcccggcctcccaccggcactgcttcttgcaccaccggagctcctccttcgggtcccgccgaccctcctcctccgccgccgccgccgccacggccaccaggagcagcccggcggcgagcaggaggagcgcgccaccacctttccacttcacacccatggctagctggaagaagctagcaacaaagcaccgagatagtagtcgtacgccgtcgacaggtggtggtggggaatggcgttggaggaggcggaagcgggggtgcatttaagctcggcggagggcggcggcgggggggaggtggcgaggcgacgtgtccgccatgggctcatgcagcgagcccacgtctcgcgcgggggaggggggagggtggtaggtgtgagttggcgggtagcggcggcgcgcggtgcaactgctacgcggcgggcgcgacgccgatcgggtcgttttttggggggggggagtaggtggagctcgtcggtttcttggccatgccatccatggcgaggggatggcgtgtacgaggatttggatgccggggaagggacgagctggcaagcatatatgcacgtggatatgggtgtggtggcagccatgggtctacgtggaagctgggggtgcatgcatgggccgggcaaaattgggctttatttcttgggtcaaaatgggccttatttgttggctggtaactgatctggtgtgctgcgctgggcttcgacgtgctccgttggatcagggctggtaacttgaagtggacacgccgtcttctacttcacctctcctcttttcttctcttccgttccctcatcttcgccatgtgggagatagccggcgacattgtcataggctcggtcgattcgagataggaggaggggggaaggggggggaggggggcagagcccacggggacccaaccggttgccgtggtcagcatgcactctggcacaatacctccatcgtccgattgctccttaaacgcgcaagcgcaaccccctcccttactggtttccacctctcttgcacggaggccaaggtagcacgagctcagacgagcttgctgaccgccttcccctccctggactaccctctatggcagcctagcgtggtagtagctcgcgcctagagtacctctcacgctcctccgtccacctccctcgcatggaggccgggcgagcttgagcttggatgggctcgccgaccacctctccattcctctcccgcctcggactccttcagccacccctcagggcgacagcccgcaccttgaccgcctcatctgtcgccgccttcgtgaatgcgctctccctacgtcttgcgcttcttcccgaccgcctccccatcaccagggtccaggagagaagaatgaagcaggcattgccacgtgggccccatggttttttatttatttttgctaactaggatgccacgtcagtaaaaccaaccacctatagtgtcataggacctaatttagtccagtttcgtaagttggggttaggattttagtattgtgtgtagggatatgatatttaaacttgatgaaagatgaggaaccttaagtatacttattacgattatcaacgatgagtcggcccttggattaggtgttctattttttggtttttgtgttgagaataatatggttgggttttcacgttggacacatctgggctttgaggttaaggttgcaatttcgagtaggaagttgaagcattttctgagttgaaaagtcaagtttgcaattttgagtagaaacgcgaatcatttgattcatttccgagttgaaaagttgagattgacaatctcaaagttcaaagtgaattcttttttttacacagttcaaagtgaattttggttaaaaccctcaggttgtatttggataatgggaaatatgtggtggaattgggattgggaaatgaacgaagggttaggattaaatggaagaaggagaataaatggttaaaatttaaagatgtcttttagtgggtgggaaatgatttccctttcccattagccaaacggggcctcagtatattttcaattaacagaagtttaatacttaataatttaaatgacagttcaatattttagccatgacacatggcatccaatgaaagggtcgtccactagaaataaaggtgacagacgatcactgaataggtacacccataccagccacctttctattgtctttgcacttggattgaaaagtggtcacaagggttaaaaccctgaatcattcggaaatgtttttgccacacaaatgagttccaaatacactgagtgacactacgggtcagtcactaaaatttctgaaatgttgttacctactcgtctctttgtccaaaaataaaccaaactcgtacggtgtgaatatatcttcaatgttacctacactgtacaaggttagcttattttgtaacggagggaacatacatctttcgataacattataattgttgtgccgccttggttcagttcaaatttctttttacaaaattccgcttgcatctttgtcccggcgcggcaaaaaaaaaatccacaataaaggtatcatataaaaacaatgatggcagttaatcagtttaggttggtcactatcttaatagatgcaaattaagttgggttgtagcgaaaccaacgaacggcatttgttttgtgctcccacgatacaatcccttaaatcagcacacacgcacaatgcatgcaccacattttagatcgatttcgtagagaatatttcgatcacatagccacaattaatctacattctagaagctccaacaaacttatttaattagttcctgcaaattaacatttacaaatatctcaaactgaagaaataactttaattgcaatgccggcagccaacccggcgtgtatgcttccatttgttcgatgtaaagtgctgtttatccataggaagagatgtaatattaataactactccatccgtttctaaatatttgacgtcattgactttttttaaatatgtttgaatgttcgtcttatttaaaaaaatttaagtaattattaattatttttctatcatttgatttattgttaaatatacttatatgtatacatatagttttacatatttcacaaaagtttttgaatatgacgaaaggttaaacatgtgctaaaaagtcaatggtatcaaatatttagaaacggagggagtatgtttgttgaaaatgttttaccttctctcaatcttaataaatttggtcagggcaggcacagaaaaaaaaaaacaggaagacataacagcaaaacaaaaacagtggaaattaagcattgctaattacaaacttttctgatcattcacaccattttcatgtttgatccagctcaaacttcactacaacagcttagaacactcttagctagcaaaagtcctaatcacagccattataaatagacacaagcaattagcctcatctacacacactcccatcactccaattaaccaaagctaattaagctagctcaagctctaatccacatttagctagaatggcgccgtccaagtccacagccgccgccggcgtcctcctcgtcctgctcgtcgcggcggcgggcggcggcgcaaatgcggcggcgacgacgtgcgtggcgtcgctgctggagctgagcccgtgcctgccgttcttcaaggacaaggcggcgacggcggcgccggaggggtgctgcgcggggctgtcgtccatcgtgaagggggaggcggtgtgcctgtgccacatcgtgaaccacaccctggagcgcgccatcggcgtcgacatccccgtcgaccgcgccttcgccctcctccgcgacgtctgccgcctctcgccgccggcggacatcatctccacctgcgccaacgagaaaggtaaaatcaatcaacgcgccgcnnccgtggcgtggcgtggcgtgtgcagaagtccaatgcagacggttttcgaatcatctaagttgactctacgtctgtaataatataacactcgtctccgtaaattaaattctcaatttctgaatttttgttttgccgcgcgctgggctccctctcttgtttaaaatccaagagataggcataggcccaatacaggggttaaaatttccgtccaaaacttccgaaaattccaaaatttgggaatttaggatcctcccctctcatgcaactatttcatacaaaattgttagatttttaaaaatatttatgaatctggttaaaattagttgaattcagtcaaaatgtgtttaaatttcaaaatgtttcgttcgaaatttctgaattttgatacacccgattttttttgtccattttggaagtacaaagcccggggccaaacgaatgtccaaatgatcaagtttaaaatctcagttctaactaggactttgtttatttatagatttatatgttttaaaagtgcaacgttgagtagtgctaattaactaatgtacatatcatgattgacttgtgtgtaggtggtgtgccgcctctctactcttgcccggctccatctgcctgaggtaaaccgtcgtcaaccacaaaattatttccacaaaagagcctataaccatgctaaatttctacagtaactactcatataattcagctgttttgtttatattttttttaggggagctgttttgtttataatgacaagtgctttttaattcatgcagtatatatgagaaaagaataaatgttaccaaaggagggatttcaacatatctaaaagtcaagatggagtaactttggtatacaagaccaacatatatatcacgttgttaaaggacaagtagatattggattattggcatatactgatatatccatgctaatattagtatatgtatattctgcaacatgcatggacatacacattgtcaaatgaagtactaagtaacacggaacgtgtactagctcgtgctactgtcgtgctatgcgctgtcaatagaaataaaatattttacattgtggtattaagcattaaagccatattgtattctaatattatcgggcggagattgcggattattcctaccacacttttaaataattacaatttctctaaaaaaaagttgctatgtcagtattttttacagcacttgtttatctctactattataaaaatttaagatgtttttgtcgaggcttttcgtacgtcaccgcgagatcgtgtcggacacaaaaaatcgcaaacttgccgatatagtttaatttttttccatctatcggaataaatcacgtcagaccctaagcccacttggtcgcgttctcccctttctttcaacagcctgtataggtgaggcttacagccgatacgagcagcggttcccgatttcccgcgagccacgcgctctcacacatcgattgtgattctaggacgagcctgacacagatcgttttttcttccaactccacctccaccaacaatatctcctttgtatgtacgtacgtatgcacccgctgccacgaatagatctatatagatcgagaagcagagagaattaaggtcttgatgggtgtggtaagaaggcaacggcagcgatggctggttgatggtgatggtgttcatgtcggtgaaggcgtggtaggatgtacgctgacgctctgcggttgcgatcgcatatattaacagggcggagctagaacgaaatggatggtggtgccacttacttaaattattctactctagatcgaatttaagctgatgcgggtgcctaagtttgtattgagaggatacatacatggtgaaaatagatgatctatagctaaaaaattttcttgaccgggttcctggacaccccctagtatactctagctccgcccctatatatatatatatatatatgaaggctagcatctggtgggtagagacaatggctgtgggctagcggcatcgatcaaaattaagatagtcgagcgcgtcatcacagccagtgccggcgcgacgcgacgcgaccgatcgacacgcctcatacgtcatcatcgccgtccgtcctcgatcgatgtcacccaggccacatcgtacgacggccactatacggtggcgggggccggcgaacacgacggagatgctttccatgcagtacggcttcgacgacccgctggagcggtttgatgatcgacctctctccttcacgtccgcgcgcgctgcttcaactcccgctgtcccgcaggccgcatatactccctctgttttaaaatatttgacaccattaaatttttaagtatgtgtttagctattcgtcttattcaaaaaatttaagaaattatttattcttttcatatcatttgattctcatgtacatatatagttttacatatttcataatttttttaataagacgaacggtcaaacatgtgctagaaagtcaacggtgtcaaacattttaaaacggagggagtaggatatatctacgtccgcgcgcttgtttcctgctcaacttccgcatgttatgttaggaccaggcctcgatcgccaagctccggctgcaggtccagcatggggccgcgtgcgttagtgtacaaccatatatcaattgtatttatcgacctttaccaaccatatatcaatttttattgggtgtagctatatttatggtgctatattttttataaaaaaatagtcggcatgtatttacattgtaagtccctaaattacatatgtaattttagtgtatttacaatgtaagtcttaaaattacatatgtaatgtaaatttgaaaattacatactaattacatatataagtgaggtgtaaatgaggtgtaactactgcgtaagtggctgaaaaaaagtcgactgtagcatatggcgccatatttctagcaactccgtataatatatagctcatgcatggaacccaatatatcttactactcatctgtgttgacagtacgtatttgccaaagtatcttttgtcggtcctgttttatcatgtgtttactagctgtttaattctttgacgggcacaaaactttaaaaacggaccatttaatatgcacaattaaaattgttttcacccgttgcaacgcacgagcatttatgctagtaatatataaaaatttaattcttccttataaactaaacgtcgggattttattttattatctaacaaactgatcgatccattcatcaagttttatctgtatttcatataagaagcaatccataattatcatattagattcccttctatcaactcagcatattgaagatctaatgtgaccatgcctacgacggatataaccattgatcatatcatatacccacaggtggtctcgtttcataacaagtgccaaattaatctaatcaagaatacgacactacctcataatgtatgcgtttatatgttcatgaccaatccacttatttggggctacatatggaagataaacacgatggccatggtgcatgcagagatggagatgaattgttgtttaattggaattattagaaatgattttaaaagcctagaagagaagatctaattttaaataataaattccaatataaaatggggccagataaaatttcattaaatactttgcttgattctatagttcctagagttttctgggatttatttgagccaaggaagtatttttaataaatggaattgcatttcatgaataatttaaattggaaaatattttaaaagtcctcttttggctttgggccgaaagtcggcccaaaaccttccctctctctcctctttggcctagtcagcccgcagccgcccgcgcgcgcgcgctcggtcgctgacaggtgggtcccacctgtcggactcgtcgtcctcctcgcaccgaaaccctagccgcgccgcgccgccgccacctttccaattcggccgcatctttcccgatccggtgaaatcgtttgaggggaaatgctccccggaatctcctctaccttttttccttttggaatcgatcgccaattcggtttggaaatccgtggattcgagttcgattcggatcgatctctctcctccgaaccctaaaccttccatcgcgtcgccggtcgccgtgggccttcgccgccgcctcctagcccctataaaaggacccccggtgtctccgttatccgtcgccaccctcgccattgcctgccgccgtctgtagcgccctagcaccgtgcagccgtgcgccgccgtcgccgccgtcgccgccgcagctccagccatgcgccgccgtcgctctggtcgtcgtcgctgctcgaggaggtcaccgtcgtggtcaccaagccgtcgtcgatctcgtccacccctccgtcgtcgccgtaggttgccggagcactgccgtcgtcgtcaagccgaaggtcgccgccgcttcttcctcgacgccgtcgccgtccgttgatcttccgccgctgttttggtcaccggtgagttcgccgcgtcgccctctacgtgttggtgtcctccgttcgtgtcgtcgcgccgtcgttcgccggcgagcttgtgcgcccgagccgccgccggtgatgacgtcatcgttcccgtccgtcgtagaccggtcgtagaccgttagatctttgcccgtccgttgtggataggatcgatctcggccgttcgtttccgtgagccaccgccgtgcacccgatccaccgcgaaccctagccgctgacgcaataatacccttttccttttcaaaaataatgcattattgcgtcataattcaattaaaatccatataaatgatttaatctgatttaatcattgaaaattcataactaattcatcttagctcggatttagttggttcaagtctctaaatttttctaaaattgagatctacatgttaaaaatatccacatgtactgttcatgcttgtttatgtgctgttttggtgatttagctcttttctctttagattccgacgtttctggagagtctgagtttgcaggaaaagattttgaagagttccaaggccagcaaggcaagtcacacagatcccaaacaaccctttgagcatgttgatcccgtttaaagctattgtttctattcaactattgcatttattttcgaatgtcgttgggtggaattaacctattgtttgttatagcctttttgttcttgattactttattccttgataccttgggttattataacttgactagttgggctttatatattggttcagctagatattagatatgattgcttagccatgcttagaaacattagcacactattgggataacttatgactcactattatttaatgatggcttaatgatagctcatgatggttaatcatgattggttaattaattaatttgccaactaaaacctgataatggtgggttgtgagcacatggttttgatggtcgtgctcatgacaattaaggaccggttcatgagtttcggttgtgagatattaaccgtgccaaccacaagccagcgtgggcaacagctttaccttttgtatagcatggttcattgcggggcaccagactgagaagtggcggagataagcccacgggggtcgctggggagtccatgccttgtttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacacctctgaccagagtaaaactattcgaatagccgtgcccgcggttatgggcgggtctaacaatgtctttcgtgattagtttcacacttctcaccataataaaagatgctataactggtaataatttgattagctcctggtttggaatggtatattcctggtttggagatagaactgtgcagccgggatagttgttcagaatggttgggcctatgcaacagggtatgttgtatagcgttggattaatattgtttaattactacttaactattttattaaattctgaaatgtttattaaatgctgtttatgcaaatgaaaccctactatgccatcctttgttatcctgtgcacttgcatatttgctgcatggcttgctgagtatgtcatatactcaccttgcaatcattcatcagaggaggagttctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctaaacgagggttcacacacatgtaagcgtttagaattttggatagaaattccgggcgtgacagcgttctggaatccaattcggcctcctaagatagtgctgaattcaaacggtcgccaaatctccatatggcctacgttttgggcccacgagtactttatggaaagctctcggaatcctctttccaacgaatccaacctcattgtcaaattccatccgagtcatcggcattgaaaaaacaaggggctgcattgtctgtaatgggcctataggtctgtaacttcgtctgggaccctggtccaaggggggctgtgccctaaacagagggaggacgcccttatgacctcctctatcctttaaatagctagtaaccccttcagggttagttgggttttgattaattgtaagtttagctattgctacttcgcttgtagcacgcgtgtcggctagaccgtccgtctgcttgttcggaaccccactttatcgtatatcaattcatctttgtgcgtcttgtctatctagcaattcagttgctttctatcttgttcttacttgttctcgattgcttgcaggaatagggttgatctgcaccagcaagatcaacaaactctcggagatgtgtattgatcgctaaggcacaacataacaacgtctcgtacggttgtagtcggatcgtcaatatttctcctaaatcgtagttatctcaactcaccgaaagatcaagccaccccatacatatcaagatcttaggccccctataatttttccgattcatttttggaaacaaatgcatttggatgccaccgaagagccgtgtttgtacttgaaaaaaactgatcaaacaactttgaattattctcgattctggaccgttcaaaactgattggacggcttagatcgctcaactacaccatacatacaaccactcgacctgtttggctaggaaacattcaagagtgccttctccagccaactcgacgagctccccgtccacctctttcgcgaatcgcgatggccacccctaactatacatcactctttctgttctaatataagtgtaacctagaccctttttagatcccatttcaaaatttttcaccctgtcacatcgaatgtttgaatacatgcatgaagtattaaatataggctaaaaaataactaattgcacagattgcgactaatttacgagacgaatcttttaagcataattgctcctgatttaacaatatggtgctacagtaaatatttgctaatgatggattaattagacttaataaatttttctcacggtttactaacggattctgtaatttttttttattagcgtcctaacaccccatatgtaatacaagtacctgagaagacagactaactacgattcggcaaggaaacctatgccgaattgcatctgaatacacacattttaacagaaggcaaaatgtggagcaatgcaagcccacgggttaacgggcctgccaaaatacaaccaagttaccagaatgtgcatccaccagccaagcaaatccaacggctgacaaaatcgactgatggattaaaatttgggatcacctgtatattttatcgacaaattttcttctaaaaatttaatagatataattataatataatcgtagtgtaattatattataacttaaatgtgaataccgtgtaacttgtatataagtttcacgtaattttgaatcgttagatcttttacaagatttgttctggtaagaaagaaaaaaaattacagtagagatatgtgagaggatttgttctcatgacctttattttaccgaaataacatgttacggagattacgaagagatatttaaaagttacatacaagttatattataattacactacgattatactttaatttacatatgtcaatttttttgagaaaatttatcgcaaaatatatagcaaaattgttaaaattttgcaggcgcttgcaaaatagaaaacctgagaaaaaaagaaagaaggaaacactcgcgtggctgcccacccgccgccgtcgccgacaacggcggcgcgaagccgcatcctctccgccgacgagcacgctggcccggagtcgtcgccgcttcaaccgccggccgtcctgtcctcggagatacggcagcgcgtggcggcccccggtggctgtgctacggcggccaaaatcgaccgccggatttcctgtgctccaccgcacggcggcctgacggtggctgcttctcctccgcgcacaaatccactcccgccccccaccatgcacggcggcagcgcttgacggtgagttctccacatgttttccttgctgacctcgattcggaatatggatccgtgtgagccagtatgattcagagtggattcccgggaacaagtctgatccggagtcggatttctcttttgaggacaacaaattccgtttcagttttccttgggtaacttcaggtatataccttgcgtctcttgcttcatcacatgttccaactctgcaagtattcaagcaggcgacgaatttcaccttgcaagaggggctcgatctgctccaattatccaatggcgccctgtagtactatagccaggattatgaacttaggggatctagcgagatgtcccaagaatttgtgcaacctactcttcagagtagtacaatccaagctcctagcgccccttcacagtagtttactgaaggaagtgcaaaaagatgatggtgatcagccatcaatggcagagagtgttgtggcaaatttaccagagctgtctcaggacatcttaatggagatatttgcctcctgagatccctgacctcgtgcgtgcaggatcggtctgtaactcctggctctcggcctacaacgaattgcgcagcctaggtatctataaactgtcccagacgccgtgcctgctatacacctctgaatctgctggcgatagcgtcgtgtgtctatatagtcttgcgaaaaagagggaggtcaagatttctctcccggagccacccatacgcagtaggtttctcattgggtcctcacttggttgtttaattacagctgatgacttatccgagatgcacctggccaatccgatcacagggaaacaaatagctctcccttctgttaccacaatggagcatgtgaatcccatcttcaatgagtctggtgctctccacaagtatgagttctcactgcacactgcaacgagggttagttatgcagagccatcaatttttgcccttggcgagctgcgggattacatatatagtaaggcttttgtgtttactgatactttcacagggggatgcattgtggttctgatccacgagccagctggtcaaatttcatttgcaagggttggggatgataagtggacatggcatccatcacactctcactattctgactgcatctacattgatggtctactgtatgcactgactgcacagggagaaatccatacacttgatctcagtggccccacgatcacgatgaagatgataattggaagtttgtcttacagtaggtacattgtgcaagctccatggggtggtcttctgctagtttggaggtcagttagcacattgaggaggattacgaggctgacttgcatgctgaccatgcaacatttgtgcggtatactagggaaattaaaatatatagtgttgatactatggggaaaaaacatgtagagatcaataacctggatggtcatgtgttgtttataggtaataaccaatcactttgtctcagcacggaacaatatccacatctcaagggaaaattatacctattttactgatgatgacgaagcttggttatttggattcaagaataagcgtcgtgatattggattatttgatttgaaacataacagcagagaggaactcgtgtctcctcagctttggtccaactttcccgctcctgtttggattacacctagtttcacaaagttgaacttcgcctagaagaagcacttttaagttttcttgtttatggatataatagttgtgtatatttcttcttgttctgtacaatttatatgtaaaattatgattggagaactgaaaggtgaatgagaaggttaggttgctccatatttgtttatttgtaccgacctttcttatgtttatttaaatttctaccgtcttaagggcaaacagcaggtcttgtgtgatagccactttctagggaattagtggaatatacaaggctaatgtgaccaatgttattagaaaatggcaaagctgtaagtgcttcttagagtctaaaataacttaactctgagactctgactgcaatcggcaggatgcctgggctaatttggagaagccttgtggaagcatgttttttagtatcttgaaggacaccatgtacttcatattttacaactacagggatagaagattgagaggtatggactgtgttctagctgccatctatttttattttgaattatgagagaccaagccttctgttccaacgtacttaattcattctagataacaatcgcagggtctgtctaggaaggattatgagaaggaattggagcttgcggacagtgagaaaacaaaaaagcttgaacagaagttgtttcgtggtctttaagattcactagtcctcaaggaggtaggttctcatagtctttccacgtcaagatccagtttgtgttcttttcaccatttgatcttgactaaattacgttttaactttacatgctgctaacgggcaaaaatctgtaatggggctagttttgattcctagcactaatacacttccgatttacttgcaatgatgttcaggtgcaaacactaactcatctcatgtacacatatgcaatcgatgtattagtttagtgctacgcatcatatctgcttgtgctagtgtgtgcccttgctaactgtagatggacccattccttaactgagaattagggcctgcataagatattatccattggctaaaccttatgctcaagcttcagttttcataggtaattttctaaacttctaaacaagttttatgcacattacactgtattggctaaaatcgaaccagcaacagcttataacttcagttattgtgcacccattgttccatgtttatcagtttaaataacacatcccagattattctcctgttctctgagcgaaagtccttttttgcagaaaggagttaaggatggaccatcttagcttgtttcatcaagcatgattttgctcttgtttcatcgtggcagagcgcatgtgctcttatcaaatatggcaactagaattatgttaaggtcttaaggaggtgaggagagtaatgtaagtccaggggacgttgaaggagaaaggatgcagttggatggagctgaatggcagtgttcaccattttgcagctggagctggaaaacattcaggaaatgatagcatccttctgaagcttgatgagataattgcaaaaataaaggtgtttgactatgctcctaaggttaccaatgcttcggctgatttgttttgtgtaaggaaaatatcagagaagctgtctggcgtctgctgttcattgggaagcttgcccctttcatttagactggtcagttgagaaagttttgcttcaactgcaaagactagaagggtgtttgagggctgagattcttccgtgaagtctatggaatttgtacaaaatacaggttaattgccttgccaattgaaacccaccatgctgaaaaatgatcaacacagtcgattcatgacgagtgctacttgcgtgcatttgatgcgatggtcgtccaaaagaaaaaagatcttgtgtgccagggcagaacagaacaagctgggcgggtgtgccctatcatctccaactccaaaattctgaacaagcagaacaagcagggcgtggcgggggtactcaaactcaaataaattctgatggtgtgtaatatacacattgtgtatattctatattctgttctgtgacttccattcagccatgttgctacaatcttggttgttgccaaatgatgcttagttggtgctttatttctcatacagatggaggcggttcctcaaacgtgaactgccacgtgacatggtcactaacaggtgggcccgtgagcagtggggcccacatgttagtcaccacgtccctctgacttcacgtcagaggatcccattcccatacagatattaaggctactactggaatgtgcaaacatatttatgctgagatactaatcagtaatcactttagtcacacgcgcatgtcattcaacacatttagagtacgcaatcaaatcaaattatgatattatgattaaggggttacagatatcggtgttaacataagaatagtaagcaaggaactaatccaatagttagcaaggaaccaatccaaaaacatgccgaactttcagttgatcactctacccaccaacccgcaggctggacgtgggagaagtggacgtgtagctctaactcacggggagagcttactatcaccccgcaattcctctgattacatgggatccgatctgctttagggtgcttcctatgccagtggagcaacatctgaaatgcaaatcagcaagcataattagttcttccgaaaacaaatgcagcaatgtaatgttaaaggaaaattaaagcaccgccattcctctctagcagacagattttttgtgacataattttgaaagtagcagtagtggcaa

SEQ ID NO: 16651 - DNA, 4696 bp, Oryza sativa
  unsure (1)..(4696): unsure at all n locations
cgcggtacggatcatcatcctttttagggttccactatatatacctcttgtaagccgccgtgcagcgatgtaacctcaccttagatatagtgaagatattttaccggctgacgcccgtggttttttctctcctgttttggaagggttttccacgttaaatctcatgtcttttatgattgatctattgttttttatcgtttgttcacccatcgtttcctaacagtcgcccggcgcgacagttcttggtgcggcagaagcggtgtcgttcccggcgaagctcctgggccccggcggcggaggtgtcagcccgcggggatggttggcgctggcgcgcacgcgcgcacccgcgatcgccggcgggttcttggccaggggagctcccggtggcagaggcggcgtcgtcttccccgacggttcttggctcaaccgagctccgggcgtcgcacgtgtcgcccgcgggaaaggttggcgcgcgtggacccgcggtcgccggcgcaggaaccagccgagccgcgagaggaacccacgggcgtttcttgcttcttgccgcgtcgaggcagaaacagcggaggcgccgcggcgggttcctgtgttggcggcggagttcttggcgagttcttggtggaggaagaagatggaagcgcgagtttttggtggcaagaagagagcggaattgcgggagttactggcgagatggtggtggagggagaaaatgatttgacggcgagttcttggcggcgacgagggggcgtgatttggggaattcttggcgagaaggtggaggaagaagatgattatgacggcgatttcttggttgtttaagagggaatggggagagaggggagatggagaaggaaatgttgtggtatttatcggggaaagaatcgtctcgatccttccaccgaccatcccggaaggccatcgtcttctccggcgccgtcatgtgttcgatggcgagctctgcaaactcgaagcttctcgaagcgttcttgcggctggaacgcaatacttcttctccggtggctccgttttggtggcgagcgtggctcgcaccggcttggcgagagtatcgccgccggcgtgcacgagcgccatggcagctcacggcgccggtgacatcttagcagaagcagatgggctgtgggcgcacgtatgagacgtgggcctatcacttgcatttcaactttcaaggcccaaagagtgcggtgtttaatcccacctcgctaaccaaaccacagcagcaccgcttataaattgaaccgtgttttttgtttgcaagtgatatcaggcatttgagtattgaagtttcattggtctaaagacttatttttgttcagtctgtgttctctctctcccattctttttttattttttttctacaatgttttttttaagaattacacttactattgtttagtgtgtgttctctctctcacattcttttttattttttctacagttctctctctcccattcttttttattttttttctacaatgtttttttcagaattacacttattattgtttagtgtgtgttctctttctcacattattttttattttttacaatgttttttaattacacagtacaacgcagacactcataacgcacgcacgcaaaccctacccctatgagcatcttcaaagactggaccggcaaatccatcttggagattgacgaagtcatcacaggcgcttcgctgtcgacggatacgtcgcctaccactaaaagtataaagctgaatatgcaagatacactcccatagaaagtcgaacccatgactttttttttctacaatgtttttttttagaattacacttattattgtttagtgtgtgttctctctctcccattctttttatttttttctacaatgtttttttagaattacacagtacaacgtagacactcataatgcacgtatgcaaaccctacccttacgagcatcttcaaagactgggccggcaaatccatcttggagattgacgaagtaccacaggcgcttcgctgtctacggatacgtcgcctatcactgaaaataaaaagccattaaatcctgaaaaatacgctcccatggaaagtcgaacccaagacctaagatgctactgagactcttgtaaccattagccagcttgtttaatatagaccagtaaaattgtacacatcacttttctggtctacaatgttacattgatttatttgttattcatgcaggccaattaaaatttagatgtcaacctattaagaaaacaatatattataaagaaatgtacgtaattatcgaatgaatttcaatgataattattaatgagtaaagtgcatgtgcggttcttaaacttgtagcggtgtgtcatataggtccccaaactctcaaaatgcatatccaggtcccagaacttatcaaagtgtatcatgtaggtcccaaatcaacacatccccacttagattctacgtggcgctgatgtgacctgccacaccgacgtgacgtgtcctttttttcttttccttttcttttccattttcttctcaaggagaagaaaggaaaatacaatagaaggaaaaaagaatatttttaaatgggtcccatttgtcagtcaaaattacgccatgttatatctgtgtcacatgccacatcagcgccacgtaggatcctaaaaggactataagtgatttacaatataaatctcatactataacaaatgngnngccgcgatatgcattttgagatattaaggacctatatggcacacctctacaagtttaaggaccgcccgtgcactttactcattattaattctaggtatgaattaattatagactaccgactaaaatttatacgccaactgattaaaaaatagtactccctccattccaaaatactataaggcacaaccaccattattatcatcttgtagtttggatcatcctaataaagataatgcatgcatccaataggattagataacatgagtggagaatttaaaataataataatttaatagagaagatgtcatagttaattacatacttgcatgtatgccttatattatggaacatttaagaaaagtagttgtgacttgtattatgaaattatgaaatagagggagtacatttttactcgatcaacttcccgcagtattttatactgcaaaactctcttcgtcaacattattacagtgtgaatcaatacatcaagctacatatatctgggcctacgccgtagtaccgaaccttgtggtcctaatagcaaggctaatagtgcagctaacagcaagttccaaaattttatcatgtcaaatagagctaacttaaaaaccaactcatataataagctaactacaagttagctataagctaccttggttaaagcatacatacattaaatcattaaatacttatatggatacatcagagaggttctgtgtaggacccacataaacgcatttttatcgtctcttctggctgcacgcaggcgttacggtttggggagctgtgcaagcgccggcgtcaaaacaagcgcccgcttgtttctttttctttctctacaattttctttccttaatctcagattaagttgattaacaagttttggagcgggtttaatagcgctattgtacctgctctaagcctttctcgtattcatgtatttcttttccactcaattctctcaggtctagagtattttgaattttttttgaactcaatagagagttgcatttatatgtatatatttatatttttgaaattgaatatgcctttcaactcaatacaaagttatatttatattcatgatctttttttactttgtcaaatggtttactaaaatctttcaagtttagtgattttttctattgttttaacacaatagagagttatatttattttatctatatacctccaccctctttactttccctctaaactacccctaaactattggtgcagtccaaattactgtcatgaactacaattctaaacatttggcatccttaatttttcacactagacaaacaaccctcgtccattatagtttttgagtggttttggcatgagttagtacatgtagattttcaagatactccctccatcccattttaagcataaccggaagtttcggtgtccaactttaatcgttcatcttatttgaaatttttttataattaatatttttattgttatgagatgataaattatgaattgtactttatatgtgacttatgttttttaattttttttaaaaatttttcaaataagaaagacagttaaatttgtacacagaaaatcatggctgcatttaaaatggaacagagggtgtatatgataaaaaatgtttggaggtgggggggggggggcaacggcagcatcggccgatgtcatggaagataagttttgctctaaagctgatttggcggaggacgatggaaaaatccagaaccctcaatactccgtatatataaacatgaaaaattaaggtataaataaataagaacataattgcatatatatgcgtaaaaaatggatggaaaattaaggtggcataacatagttgcattaataaaaactgactagattaattatatacaatcaatctgttaatatcccattgatagtctaatttaactaaaaattcaccgacattgatcatactaatcaaccactctaatttatactccctccgttttttaatagatga

SEQ ID NO: 16652 - DNA, 4412 bp, Oryza sativa
actactcctattagtaaacatctaccactctaatttatactactactattagtaaacatctcctaagatagtaaggccagcaaggtcgtcatggccaccgcagcagccaccgtaccgatccccattgtcgcaccacgcgctccatgagaggtcggtggcggcggcggtggcggcagtggcgacggcgaagtgaacggcggcggggacgacggcttgggcgcctgtggcagcgaaggcgccgccgttggagattgcgccggcgtggccgccggagactctgctagcttccccgctgatggaggctgctgcggcgacgacggctcgtagggaggaagcaccagaccttgcgctgcaagatccaagaaattaaattaaacggcagagtcagtcagtgtcagtgacacgatccggcgacgcgccggcgccggcacgccggtcgccggcggcgaggtgaggtgtatgcttactgttgcagagctcgatgggcggcgtggcgaggccgcagctgacggggatctcgagggcgtgggtgacgttgacgtcgtagccggtggagcggccgtagacgccgtcggcgatgtagcagaggcagaacgggtcggcgtcgaacgccgcgctgtacgccgcgcagcacgccggcgacgcggccgccgcgccgccgaacatgaagtccctgcacgcgagcagcccgctcagggagtcgcggcagtactcgccgccggcggcggcatcgctggccgccgaggccggcgacgggagccacgccgacgacaccgccgcggtgaccacggcgagtacgaggaggagaggaagcttggaacgcgccatggtgggatatatactgggatcgatcgattgattaattggattggatttttgcatggtccgcgacgtgtatttatagcgccagagtttgagaaatttaagagaacgcgacattggatcgtgcatgagaggttttctcatctttttggaggaattttatccgaactcaaatactgatcgaagtccacgcggcacaaaaacgcatagcttaagcgctttggggagaatagctaatatggtccctaaagtttcgctcctgagttattttagtccttaatctttcatattgtccaaacaagtcctttaaatttgtcatgtgggctaatatagtccttggtcccaccaaaatcgctacatggacatgccatgtcacctttctatgtaaaatctttatgatttgtccaatttacccttatgcataggaaaataaaaaacaaaaggaaaaagttaaaaaaatatatggtatatgtaagagcaaaaatatacctcaaaagggtgaaaaaagaagtatttttttcctatggttatgtctaattcacccttatatttatttttctacgatatacgtaaggctaaattggataattcatcatagattttgcatgaatgatgacatggcatatccatatgatgattttggtggacccaaggactattctaggccttatgacaaaggttaaggatttctttgaaccatttaaaaggttagagactaaactgatcctacagagaaaatttagtgactaaagtagctattctcccaatgctttgaattgttatccagctaaagagtcttaatgggagaaagttacaagttgacacgttagaagataaccaggtcgtagaacgatgtaataattttgtcatccactcctgtatctgtacgagttttatttagtttctttttttaaaagaaaaaatattggtcccagaacttgtacttgattacacaagttttttctgtttccaaattatcctattgacaaaaacaagttaaaatactgcaacatttgggagaaaatttcattgaagagaataaacacgtggccaactaacttcattacacagttttggtgtaaccaaattgtcctattgacaaaacaaatgaaaatagtggaacatttgggagaaatttttagtgaagagaaaaaaaaagactggaatacgtggcgaacaaactttattacacaagtttttattatgtaaccaaattgtcctattgacaaaacaaatgaaaacattgctacatttgggagaatttcagtgaagcgaaaaagaaaaccggaacacgtggccaactaatttggtccgtgtctctaaaaatatatgaggctttgggcccagtaggcctataggagtacgcgccaaaaagaatttgcaaaccccaaatgcgccgagccgccgccgccgcggcggtggcgcccgccgacccgcagctgctggcggcggcgttcgagtcggccatcgcgtcgcgctcgccgcgcctcggccgggccgcgcacgcgcgagcgctgaggctgatcgccccggcactctcgcccttcatctgcgcgcacctcgtcaacctctactccaagctcgacctccccgcggcggcggcggcggctctcgcctccgacccacaccccaccgtggtttcgtacaccgctttcatatccggcgcggcgcagcacggccgccctctcccggcgctctccgcgttcgccggcatgctccgcctcggcctgcgccccaacgacttcaccttcccgtcggccttcaaggccgccgattccgcacctccgcgctccaccatcgggccccagatacactccctcgccatcaggtttggttacctccccgtcgaccccttcgtgtcctgcgcggcgctggacatgtacttcaagaccggacgcctcaagctggcccgccacctgtttggtgaaatgccgaacaggaacgtggttgcgtggaacgctgtcatgacgaatgctgtgctcgacgggaggcccctggagacaattgaggcttattttgggctccgggaggctggtgggcttccgaatgtggtctcggcctgtgcattcttcaacgcgtgtgctggggcgatgtacttgtcactcggggaacagttccatggcttcgttgtaaagtgtgggtttgagatggatgtctctgtgttgaattcaatggttgatttctatgggaagtgccgatgtgcagggaaggcaagggcggtatttgatggcatgggagttaggaatagcgtgtcctggtgttcaatggttgctgcatatgctcagaacggcgcagaagaggaggcttttgcagcatacctgggtgcaaggcgttctggggaagagccaacggatttcatggtttccagtgcgctcactacatgtgcagggctgctaggccttcaccttggacgcgctctgcatgcggttgctgtccgttcttgtattgatgcaaacatttttgttgcgagtgcattggttgacatgtatgggaagtgcggctgtgttgaagatgccgaacagattttttatgagacaccacagaggaatcttgtcacttggaatgcaatgatcggtggttatgctcacattggtgatgctcagaatgcacttctggtatttgatgatatgataaggagtggggagacagcacctaattacatcacccttgtcaatgtgatcacttcatgcagcagaggaggtttaacaaaggacggctatgaattgtttgagacaatgagggagaggttcgggatagagccacggactgagcattatgcttgtgtggttgacttgcttggtcgtgcaggaatggaagaacaggcttacgaggtcatacaggggatgcctatgagaccttccatttctgtatggggagctctacttggggcgtgcaaaatgcatgggaagacagaattgggaaggattgcagctgagaagttgtttgaacttgacccccaggactctggcaatcatgtactgctctcaaatatgtttgcttcagctggcaggtaaaattaccttattcactttgatgtttacgttaaagttccaggttccaggctatctcaggtccaaacacagatacacacacacaaacaaacaaaaagccactcccggtgatttctcagtaaatttcatactcctgatgtcatttgattgaacttagctctaggacatagcgaagtatattttgatgtctcttggcttcttctgaatgtggaatgtccctgagtttttaatgattataaataatctccatcattgatggacaagcggtaaactaatataaaaggctaagttgaagcactatattgcagaattgtaaggtacatttgtcagcatatctgccagaattcaatgcagattagatgagcatttgtatgccataatccatatacttccaatcagctgtgaaaatataatctcgaaagtgcttgttgagagcttgaagtagactaatgctgattcctgaaacttgttgctcataatttttgttatgagtgaagtgcaccagtggtccctaaacttgtgcaagtgtgtcacttaagtccctgaactctcaaattgcatttttaggtccctcaactt

SEQ ID NO: 16653 - DNA, 10558 bp, Oryza sativa
  unsure (1)..(10558): unsure at all n locations
tgcataccacctggggtacctatcagaatcatgaagaacctgcgaatatgtgtggatagtcatcgcgcattctagttcatatctggtatcgttggtagagagataattgtgagggacaataataggtttcatcacttcaaacaataccaatgctcatgtggagattattggtgacttctatctatgtgcctattgatgaatattatctgcaaaaagaaaaaaaaaacacttcttcaaagccaaaaggaaaaggtatgcaatttttgttcctgtgcaatagttatatcagcatattttttcttatgtgatttctttagttgctgtattagttgaaacttgaaagtttgaaacttttgataagcttccaaatgagtataagtcttgttagtaatatgataactgtgttatctgatttctacagtagaaattagaagctaccaaatcacgcacccactcacagcacacacatgcatcttttactacaaactccagagaaactcagacatccaagaaaccaaggtccaacttgtccgttgaacacacatgcatgtgcatattctaaacaaatgagacacactatgtcatcctagggattgaattcagggtgggtcagaacaagctccctcataatggtaacagttacagaaatggctaaatgggaaatgagtgtgttggaaatcattatttcttttgtttagacacaaatatatttttttctgacagttgtttgtaaggatatctttcctaatgttttacacctttactttccttttatttattttggcttctgtctgtacaggatttggcattaaacatggaacatatgtcctggtttacctaattaccttgctccattactgaagaaggcatactgataaatcaaaagaagagaccagctggaacaaaatttggggttgatgagcagaagcatacactgcctgtttgatgtgccacccatgttagctcaggttgcacatagcctggatttaggggcatcaagggcagaatatgtactattcaagagaagctcagggatatcaatatatgattgctgggtgcaccgtgcacgtaggttgtgatgctggctcaaggatctaaattcctgctatccttttttgggggtgtgaataatatttcttattggtactatttcttggtagtagggacaattccactgtctcaaaatcgtggtaaatattaagcagtaaaacgattttaactttttctatatcttgattttcaggtcatgctagattgagcctattactgtttctaccctgaagcgctaatgtttgcaggcctgaagtgtctcgtattcagcttggaggtgttggtgaattacttaaagcgacgaatgcagaaatctgcacggaagcgatgcatcccatttttgccatttggttaagtaggttttggttattcttatacgttgagaggatacttatcatgggtttggtggattagacgtggtataatccagttctcattttggttttcctttttgtttgctagctgaccttaattacttggtgccatttcctgctttgatttttaggtgttactgtaaatgaagagatgatttattatatatactacagaatatagttcacgcgtattacaaagaaaaccggtgttttgtttctgttgggcactttagttagcaaaagagtaaaatagcctttccaactggggctcttcccatccatttgtttgtgatcataattttccgaaccatatgtttcattttttcttctaagcttatcttagttaaaacattcaacacactttcagtttcagttttcagtctttgagcaaggttgcttcagaattatcaggcatatacatggaaatgaaatgattccattctctgttcagtttattttccttgtaggcttagattgatcatacagcgagttaaatgaatataacttcaaacaaggctcgagtaaaaactacggaggaaaatgcagtcaatagtgacttgtgattgtgatctgcatcgaggattaaaaagatttgtctcgtaccacatgaagtccttcagtagatttgtatacttgttcaaaagattgtaagagcgatgcatcaacttgtttagttgcagaggtatatgatctgagcttgttcattcggattattcagatagaaagacgctgtactaacggaaatcttatacaggttgaattcgaatcttcataccccactggaccggggcccacacgtcagtgacccatctcaagactcaaattaaattggtcacgtctcgttcgtcctcatctcgctcgcgtctcgtcggcatgacgactccgccggcggcgaagcgccgccgccgctgctgttcgctgccgccggagctgaacgacgacgtcatcggcgagatcctcctccgcctcccacctggcgaccccgcgctgctcgtccgctgctccctcgtctgcaagccatggcggcggctcctctcctccgaccccgtcttcctccgccgccaccgcgagctacaccttcgccgccggacgcctcgccccctcctcggcttactctttaaccagctcggggaagaccccggcgtcgcctggttcggccccacctagttccatcgccgcctccccacccccaccattgggactggtacgcgctcgacgcccggcacgggctcgttctcttcagcaccatgctctcgcgcgacgcggcggagcacgagctcgtcgtctgggaccccatgacggggcgccggtggcggctcgacttcccgggctacctcgaggacttcaactggtccgcgtcggtgctctgcgccgccgacggctgcgaccaccgccactgccacggcgcccccttcctcgtcgcggtcgtgtccaccggccgctactgcaacacctccgcggccatctactcctcggagaccggcgcctggggcgacgcgatcgcgctcgagcgcgagcaccccgatcccgatgatgccgtcaaggtcgggaagcccggcgtccaagtggggaacgcgatctacttcccctgcgtccggagcgcccaaatcctcgagtgcgacatgagcggccacacgctggcgatgttcgactcgccggcggccggccggggatggccggacaacggcctcctcatgacggcggaaagcggcggcggcggcgggctggggttcgctttcgtgcggcggtccatgctccacctctggtcgagggagcccaccggcgacggcgccatggcatggtcgccgctccgaggcatcaacctggagccgctgctcaccgtgctgatccggagaccacctgagcaccactccgtcacgcctaatctggtcggcttcgccgacggcgtcggcgtcatcttcgccgagatcgatggcgacgtcttcaccattgaggtgagctctcgacgaggcaagaaggtgtacaggagggaagacatccacaccatcttcccttacacgagcttctacactcctcgcggtggtatcaactttgatccattgccatgaactcactcgcgctgctgctgctgctgttagctttgttgtggatttgacgttagtgatttctttcagtttggaagcccaggaacagtattgtttgctctggtttcagtggttagtttaagccataaaaagagttaagtagcgatggcctattttgtaacctctgtgtctagttgggcagttttaaccaggaaaagagttgactgctcatgatcacttcactatgtgattgtatcaactcatctacctatttctttttcgtttttcatttcctcgctgcctaaagcatactctcgaagatacaatacctctattttttttataatgctacgccgttaaatttttctttacaatagtttgatcattcgtcttatttaaatttgttttgtaaatataaaaaattgaagtcatacttaaaaaatatttgacgataaatcaagtcacaataaaataaataataattatataatttattaataatacaaatgatcaaacatatattaaattgatcaatcaattctaaggttgtgttcggcagccaactttcccaactcatctgtatcatttttcgcgtgcatgcttttaaattgctaaacggtatatttttctttttgcaaaaaacttctataggaaagttgcttaaaattatattaatctatttttttaaaaaatagctaatacttaattaatcatgtactaatgagtcactttgttttaagtgagcgagagattaggtaccaacctcacaattagcctaagtgggaatactaagagtgggtggactaggcaaaatccccccccccctttttccctaaccctcctagagtcgttggatcaaacattgtctgtcagattcaaccaaatacaaggctgggttcccaacccaagctgttcgcacggaaaatgaagtgatccattagcgcatgattaattaagtatttgctattttttttcaaaaatgaatcaatatgattttttaagcaacttttgtatataaactttttacaaaaaaaacacaccgtttagcaatttgaaaagcgtgcgcgcgaaaaacgagatatgtgctaaattggtttcctgattccacacttccccatcaatggtggaagcatccacatctacactctcagtcttagatcaaactatagaaataaatctgaataagcacatgtcggattcatagctaaagtttgatttattctttttatgaagagagtatatgtttgtgcgcagcaaggcacctctgggttaactcttaactgtacagccggccggcaccctgttacgctggccaacttactcctattctcttcctccactagccagctgctgcgaaatcatgcccaagggaagcaactccacccgaatgtgcctccccagtccccagtccccacacgcgcacagatcttggagtaaaatcaatgcccatcaaaatagactgattgaaatcacaaaaagtcagttgactgaaagtaaacaaacctgttttctttaacattgtgtcactaccactgtggttagctgctaccaaggtacattgaaataagtttcaccttggactaggtgttatattatatgattgaaggaaaatcttgtaaaatatgaggaaaagttataaaactttttgaatttagatcacatattcacatttgatgatgatttattcaaaattctacgaaatgccatggaaattctatattattgatgatgtatcctagattcctagtgctccgtattaagtgaaagttttttttgacggtttaaacagtaggagaggctcatactgtgctatattagaatatagaataaaaaaagagtatgtacaaaggatggatataaggggggagaggaaagaaaaaaggaaaacaaggaaaaaacaaagacaattagctaatgatgttaatccatgattgccagctgggtttgtctgatgcttttactctgtgcatatgccgagtaaagaaggatggatataaggggggagaggaaagaaaaaaggaaaacaaggaaaaaacaaagacaattagctaatgatgttaatccatgattgccagctgggtttgtctgatgcttttactctgtgcatatgccgagtaaaatcttctttgaagtccaatttccatttactgaagttgatgggcacattattgaaaatatgatcatttcttctattccagatattccaacatccaattcctaatacttccataaagaaaggttgtgggaaaagccttcttgcagtcatgatcatgttcatgaattctaatgtcagatcccaatttatcccaatacagttccaacattgttgggcaaaaggacaagagaagaacagatgaatgtagtcttctgtggttgtcaaattgcaaatgttacaagtgactcctccttgagtgttgaaatgttttctttgaagtaaatctttagtgtttaatatgtccatcagtagaagccatagaaataccttgatcttcattgtgcctttgcttttccatatgagagtgagtggtatgtctggttgaatatgagaaaagaagagatcatacatcttttggatttgtacaagtttgggttccacacatagttccattgatttgaatgatggcctcatactccactaaatcaaaagctttctcaaaatatattttcagaattacaatttccctgttactttgatggcactgatggatgtattcaaagctccatgctaggcaatcctggatggttctacctttaataaacacatattgattctcatgaataatatcaaggataactgattgcagtctgttggccataatcttggagacaaatttcagaacagagttttgcaaagcaataggcctgtaatcatttggactttcaggattgggtttctttggaactagggttatgaaagagttgttcaggttctgaattgagattcctccactgaaaaattgatctgccatagcatagaaatcctcagagatgatatgccagcatttcttgagaaacataccattgaaaccatcaggtcctagagctctatcacttggcatttgctttattatttggtccatttcatccttggaaggcatggaggataaaagatttaggttagagttatgctgtatcaaactgctcagatttagatcagactgtaagtgctcgggagtgcccattctgtctgtaaagagttgaataaaatttgggccttttcttcatgagatgatattattctgtcatccaactttcatgtgagatcttatttctgttgtgactgtctgttgctgcagcttggaagtattttgggttttcatctccaaatttaacccatcttattgtacatcttttcttccaaaactcattcttgtattttaagagctgaaggatatggtcctttaatatggttctgaaattccattcttgaatggctagatctctttgctcttcaattttgtccagaaaaagcaaaacctcattgcagtttgagacgagggtatgcatatttgagagtcttttcctcaaattttgagtcctttccttaaatttttcatctttccattcaacttgatagcttgatttgatcctctgacaggaatgttccagaactgtgaaacgacatccataaatcctggcatgtcaacccataagttttcaaacctaaataatcttgatttaggaactgaagtttcaatagaaatcagacagggagcatgatcagagatgtatttagatagagctgttaatgatgtgtggagaaatttcagattccaggctggagatgtaaagacccaatcaagttgctggagcagaggttggtcttgcatgttgctccatgtgaaagacatgcctctcagagagatttctaccaatccaatgttgcttatgatttcattgaaaatcacaatatcattcatatctccaccagagagatttctattttgcactgatctaatgaaattgaaatcacccatgaaaatccaattttgatcaatgtctatctcaatggtgttcatccatgaaacaaattcatctcttaattctccagcacaagggccattggccatagatgttagatagggaccaattttcatgtaaagaggagtttgacacaaactgcatagtgatgacatatggatggctttcaatcatggtaccagttgcaacactactgttccaaatgacaattaaaccccctgagtttccaaaagaaggttgaaaaacaaacttatcaaaccttctaggacaaaattttctaatataggagtggtcaaaatgctctcttttggtttcttgcagacagataattgagcatgaagattcaaaaattttgtcagataaagccagccactttcgctcagaattaatacctccgatgttccaacataagatattgcagcttctattattctgttgattcattattctggtttgtgagaaagataaaataggtcacagaataactgtgtaccccgagatgagagccaccagcagagacccgcaacattagatgaaaaaccaaagcatgacaaaatatgcagcataaccaaagtacttatccagcagattaacaagttccaggcataatccaagagaaaagtgtcacaaaagtgaaattctaccctattacataagtgggtagaggggctaagcatagcccaattattacaaagcttagagactttattcatttctttgatctgagaagcttcacttcggacacttcctcaggaagaagtccacatttttccaccccatctcgggagagcattcacatgattacaaagaggaggcaggagccgcaggatagccttgtttagttcccaatttttttttcccaaaaacgtcgcatcgaatctttggacatatacatggagcattaaatatagataaaatgaaaaattaattgtatagtttgcatggaaatcgcgagacgaatcttttgagccaaattagttcacgattagccataagtgctacagtaaccccacatgtgctaatgacggattaattaggcttaataaattcgtcttgtggtttccatgcgagttatgaaatcagttttttcactcgtgtccgaaaaccctttccgatatccggtcaaacgtccgatgtgacacccaaaaaatttgttttcgtgaactaaacaaggcctaagataaaaacacaaggacaactatgtttgcaacacatgcccaaattatttgagtggaacatcaatcagataatttagaaagccagcaacgttttgcctacagaacagaaccatcctaggacgctagatgctaattaaattgaccctgaaaatgacgaccaacatttaaagcagttaatcacatgtctgcaacataacgttagaaatgtaattaactcggcggctaatctgaccaattcagggttaatttcgatgataaaggaatacaaccagacgcaccagtaagcaggcatgtccccacgaacagaatgcatgacattccaagaggagtacctgatcgcctccctcgagctgagcctcctcttcttttcttggcttgtgtctgtctgaatagatccatgaggtgcaacatttgttgggcggcggggctcctcgtgtcgtggagtcggcggcgatgcgcagtgcacctaaagaggtgcgccgcccatacacagtcgcagcccactccttcaaagctgtcccagacgcagcgcaggcaccctccgaatccgcgtcctcgtcgccctggtgatctctctagcgtcgacgaggatgccggcggtggcggacccggctcttctcggtggcgtccaagatggccttgttcttgtcatcttggcagcacggggcatgggtcagacggtgcagacgcggggcgcgaacggtggacggcggagagcaggacgtgccgcgcgtggcgaaaaagggacggcggcgagcgcgcggatgaggcacgcctcctgtcgaacaggttgcgggcgcgcggcggcgagtatggctccccgcgggcggagcgtcacggcggaggcgttgcaggacggagtcaccgccggggcgacaagcgacggcggcggaggtcgtttcttgggcccggtggtgggaaagtgcccgacggcaaaagaagacggcgtcacggtgggaaccggcgatcggcgcggtggagggcgatttcttggagctcaagacccagaacacgaggttgttattataaccgccttctgcacggccgcctcgccgccggaaatccgtcctcattcggacgccagcttcggcgtctgggttcatccgcattgtttcacagccgctcggtcggtcgcacctggtgcgcgtgcggctcaaccgaagcaagccacagcaatggcgccgccgcggctgcgctccaagcttcgagcaggggcatgagcagccaagccaatctgagggcttttaataattatttcctttttctacgtaggttcgaatctccgttggtgcatatttttttttttagccgctcgaattttcttttctttttttactctcaaataattttctccagtgtttctatataataaaaacatacaattttttttatcattcctttcttttacgctctaatcaccaaaatatgaattagagataataattcataataggtctgctcttgtgtttataaccaggtctaactggcatagttggagctgggctaactcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16654 - DNA, 6485 bp, Oryza sativa
  unsure (1)..(6485): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatcacagggaaaaaaatgtgtgcttgctcaaggctaggaaaatgtcaagacccttgtttgaatgccaccttagtttttaacagcattgaatgacaagcaggatatgagtctaggacggaaggaaatggtaaatacataagtggagctaaccagtaacaacccagcggtcagaacactgcaaatgtatcaaggtgcaattatgattttttactgacatgaatgaatttctaatgtggacttcaagctttaaactaattgggtatgacttccccctgaataactttaggagcagttaaatcaactaactttggtcaatagcaggttgctgactattattcatggtcgggggcctgtagttcattgatgggggaacttcatcaagtccaatttctcgttcaagagtgctcctgaactcccttgaaacatcctatatgcggaaaaaagagacacgttacatatgtatcaaggaatcacatcagacaagtcacaaaccaacctgtagctctctaatggttggctggaaagcacgcaaagtcttccccaaattcctggctacctgcatacaagcaagcaagtgagacctaacagttcgtaatgatagaaaggttggcaggaagtacatgctcattttcattcacagtaaaataaagcagaacaacaacatgacatatttaaagtgaagaaaacaacaacataaaatatttcctgcaaggctttttcttttctgtatgtagtgtgtgctttcaaacctttgcagaaaacctaccacgatctggcagtacatgcaacaggttaagaaactataggcgattagaatatggtgctaatgctgagggtttagtgaagaattagctagaataggaagccggacaacagcaaaaatatgatgtccaggtttgttgggaaagagtttacctctgctagtcctttgggaccaaagactaacagagcaaccactccaatgaccagagcttcgggagctccaactccaaataaagaagcataaacacccgttccacgacttgttcttttgctctctacattgaagaagtcaaagaaacacaaaggctgtgagatgcctaatttggcaaagaattatggaacagctcgatacgaatacaggcatagtaaatatagtaaagggaatatccttcatccagctatataaagcaggaaggtagatgggcagttatagcggcgaagacaaattagatgggtataagaaatcctgatctcttcctttcctagtctttagctttcctgtttttcatacaaagatggtagtgtgttgacgtctaattccagcccaagagaaaatttgtagatgaggttaggaatggtagttatggaaacgaaggaagaagtggcgagcagccaggtgatcccaggcattttcccgagcttatggtgggcagcagctgagcctgagcagcacaaggacaaaaaatgttgaatgccgcccaatttgtgcactgtatagagcttgtgacaagagttgctatttccatccaagatatgatgaatacttttgacggatagtaatacaaagaataaggagtacaactaaaaggtaattagatactactactaaatgaatccaaacaatcaaatcaatcaatgaatcgtctgttggttgtgggagagtacccgtacggcggcggcggcggaggaagaagcggtggtggcggtcggagacgaaggataggccgagcgtgcagtagggctgagcgagcgtgagcctcctcctcctcctcctctgtgaggaagggaaaggggaaggggaaggagtgcacatgccgacgcacggaggaggtcggagtagcaggccagcgactgacatcgccggcggcgggcttcgaattcgattcgattcgtagggtatatgcagctcactcgcaagtcgcaccgcaccaccccaacacaagaagagggaggcgaacgatagagggagatattgcggcggcgcccgacaacggggacggcgtaaggggaagncgaaggtgncggcgcgaggggtggcaaagncgncggcgctcggtgccggcgccggagaggaagagggagcgggcagagcgagagggtgcgagcggcggcggataaggtttgggttagtgggtgttattttgccaaaaaacccctactcttttctcattttgcagagcggtcccttttcgcccccaaatactgtttgtaatggcctatatataattacagaaaatcgaaggtctttttcgaaaaattatcgacccacttctcccatggctgggagtactaaattaaacaaattgggtgtaaattgtgaaacgaattttttaagtttaattagtccatgatttgataatgtggtgttaccgtaaatatttactaataatggattaattaggcttaataaattcgtcttgcagtttgcaagcggaatctgtaatttgttttgttattagtctacgtttaacactttaaatgtgtaccgacatacccgatctgacatgtcaaaactttatactactcgatctaaacacaacctaaaatttaaattcctgtcacatcggatgtttggacactaattagaagtattaaatatagactaatgataaaacctattttataaccttgaactaattcgcgagacgaatctattaagcctaattaatccatgattagcctatgtgatgctgtagtaaacatgtgttaattatggattaattaggctcaatagattcatctcgtaaattagctatcatttatgcaattagttttattattagcctatatttaatacttttaatgaaggccaaacattcgatgtgacatgtactacaatttagtccttatatgtgaagttgtggggagtcatctttcttggtctctgcctctctggtgcttctgatggaatattgacgaggttctatcaacgagtttcctgaagtaacaatgtggaaatcagttttctgctttaatacacattttaactcttatcgctagatatttaatatattactccaaagaaagcagttaactgtagtgctaacagattaagaaagagaaaccggttaacatgaaaaataaacattgaagatatcttggtcggccgaattacccctgaactatcgtggtcagccctgaactatcgtggtcagccgaattaccccctaaactcgaaaaccagacattactcacaacgaactttcaataccggacgaattacccccctcggcccaatccagagcgattttgtcctacgtggcgtacgcgtggcaatccagtcagtattttatttaattaaaaaatgtgggtcccacctgtcatactcttcccctcttcctctctcctctctctcttctttctctcttacagggcagcgcgcaggggtgaggaggtgggcggcgatgcagggacgggcggtgggctggaggaggtgtagcgccggcacctgccggcggtggtgtcggtggtggagggtgccgctgcggaggccaaggcggcacgaggtgaggagacggcggcgagagatgaggaggaggcggcctcgctgtgcggccgcgccgccaccaacagaaacctcgccgcggcgcgctccgtcgcccacgcggccacgccgtcggcgccaccgtcatcaccaacgaacacgacgcaggtctgcgcgcccgctgcagcctcgtcggatgcgtcgcctccccggaagacagcctcgccgtcgatgaaggtgtcccgcagtggagggcgccgccgcgcggaggccgagctggggcggtcggctccggcacgggaaacggaggcggcgcgagacgaaggagggtcgccgagggagctcgacacggcagcgggatcgtcgattcctttccgcgagatccgtcgtgggctacgcgcacaccctcaacgcccctgccatgcccgccgccggcctcggggtctcacctgagccgagaaggagagagacagagagatacacacagagagagaaagagggacgacatagcccgctggccgcctcgcctcctcaccgcgcgcgccgcgtgcagcgccgccgcgccctccccgtggaggactcgtctcccgctgcctgcctgagctgagaaggaaagagacacagagagcgagagagggagggacgacctagcccgcctcctccaacgccttcctcggcgccggcgccgcgccatcctcgcactctgctgtcgacccccgcacgccgaccacccgcctgctccaggtgcgtcgtcgtcgccgccgcccactgcctatccacgtgcgctggagagagagagagagagggggggtagaggggaaaaggggtaatgacatgtgggccatatttttttaatttctttttctgattggatttccacgtcggcgccacgtatatgccacgtaggataaaaactgctcaggattgtatggggggtaattcgttcggtatcaatagttcgaggtttaatatgtccggttttgtggtttaggggagtaattcgtaccgtcgcaatagtttagagggtaattcgtactttttccttttagtgatgaaattttcatgacatcataaaaatttccgcccaaacaagccatcatataaatttacatacccaagattttgactgcttatctttattctcttgtacagtgcttgctgccaccatcaagttcatcattatcaggaccaacaagatcaacaaaggtaattctgctagtctgtgagctgctgaagccatttgatgagcaaccctgtaatttggttgaacaaagtaaattcacaagataatgacagcatgtatatatatttgctgatcagttagtggaaactaatagaattgaattgactaaagagcatactgattttttaaatgataatactgacataactattgcaataagagaagttaaatatagctggttatgaggtctccaaacaacagaagaaataccagaggtttaatttaccttgctccatgcttcaatgacacaagtgaatattatatgagaacgtgaacttttcaagttcatactggtggtgccaacttttctgtttggaaggccctgtaagaaaaacaagctcagacaagctatcaataacgcttgagcaatggtaggcttcaattcagattttaatctctatagaggagaaggcagtgactcagttattagaaggacaacatgaaacaaatagtttcgaaagagcatgatacaagtagtaatatatgcgatcttaacaaaaatacagcttgttatcaagacaaaggtctttgtgactacagggtagatcaagcagaggtcctggttgtgatcctcatccatgcagaggtgaaattgaaaagcaaagaaaccctagttttaaaagcaaaaccgaaaggacaatttctttctgctactcttattgatcaaaattgtcccactgatgtgcctatagaggaaaaaaaaattttcgggctggttttgttggattactccgtgccataaaaggataaagaagattttctgaacaacttgacaaatgccttgctatgtttgctttatttatttattgttttgcgaactctccttgctattttctgacagaaacttgcagattagtgcagccacttcctgaccaaagctgtaaagcatcactggctacaaagtacactgacaatgcaatgaattgaaggtcattttgattataccttcatcaagatctgattgacgtcctcaaccgttgactcatactcatcggtcaagttctcaacatggacaccattgcaagcattctctcttatctagaataatggagctgaataagtttaatgcaatccattagcaaacaccatatacaggattagaatatacctaaagttacgctgagatggatccaacaggtcattaatctactcattatatacctggaaagcattgagcaaaatttgcatcatgtcagatatagaaaccttgttaaattaactaaattcagaaaaaaaattcacatctagatgcacttttcagttcaattaagaacacgcagatgagtcagtactcagtactcacctcaagaaacgagcactggcattggtagcttgtctgcttctccggtgagatttctcgcctctgtaccaggaataaacagaattgtgattatatggaacaactagaattttagaattttcaggatataccacccaatacgcactgttttccggatttatcacccaattcacactactttcagaatacactactggagtgtgaatt

SEQ ID NO: 16655 - DNA, 1965 bp, Oryza sativa
cgctgccgcaccgggctgctgccaccacgccccgagccatcgccggtccaatctccgccaccgcagcctcgagctcgtatagagctttgccaccggagctcgacgccctctggcctctgccctccaccgctgctcccttctcctccggcccaccaccacgtacgccaatgacggcgacgaaccagcgacggcgcggctgacgcgggcggcgatggacgggcaatggcgaggctgacgcgacggacgggcgacggcgcggttaacgcaagcgcgagcggtggcggactgatgacggtggcgccgggaggacggaggatgatggtgtgactgacgctaggggatggagtggcccggaacgaagaaaattcacactccattggtatattctaaaagtagtgtaaattgggtgataaatcctgaaagcagtgcgtactaggtggtataatctgaaaattctcatggaacaacaggtttaatcaaatttctcccttaagccttggatttgagcaacgagattctggaattcgtaggatttgtgcaagagcatgcagaattgcaggaagcttagattcaacccgaactcacaacggtgggccgcgttgaggacggtggaggcggcagacgctgccaactgccaactgccaaggcagggggctatggcgacgtggcgaggagtcctcgattccgtgcggcgcgcatggctcctcctccacatccgccggcgcacagctcctccttggtgttcgccagcgagcacggctccacctgccatccctgtcgtctccgccacgtttggctccgcgccacgccgcgcccacgatgccggagggaaggagagagagtttagtactactccatatgacatgtggggcccatgttaatttttaattttttattttttattggattgccacgttagcgctacatgtataccatgtaggacaaaactgttccgatctgccacgtgtacatatataccatgtaggacaaaaccattccgatctgccacgtgtacacgtaggatgaaaaccattctatattgagtagggggtaattcgtccggttttaaaagtggttttaaaagtttagggtgtgaaatatctggtcaaaccgtcgggatccaaaaaacacgtatcgacgaaacaaagtgcatataaagcactcctctctcaactaagtgcacctaaagcactcctctctcaactaccgaactatgattgaaacctcgaagtaatccctctcaactaacaaactatgattgaaaccttgaagtaaaccctaactttttttcttcgtctcaacccctcatctatttatataaaaacttgtaaaacttttattaacaataggactcaatcccttaatttccaaacctatacattttccgaaactacagccggactgcttataaaccaatcaaactcctgcgcgaaaccgactgcccgtcgatctccgtttcctgtcaacacacgtgcgcctcctctactgaagcttcacgcatgggccatctcctccacgcgctgacccttcttccaatgggccagcaaatcaccaagcaggccgtcgctcgtctgggcctcctcctgggtcggttgttccagcacaagccgacgccaacacaacagtatagcacacgcaagtacgcagcacatgcatgcaacgagacatgcatatgcaccacgctacagtaccatgagtactgtagcaaccatatactccgaatttcctcaaccaatttccttcgcgaacaccgacacttgcatgcacacctcgtgaagcctattacgaagatttctcccacacgatgtccatccaccgtatactatatcgtatccaacttcgttattcggtatccttgaccgtctggacctcaactcctccctgagtttagtcctgatccccaccgttgaccaaagttgatcgacctctaagaatcctgactctagtcaccttctcatatggtat

SEQ ID NO: 16656 - DNA, 915 bp, Oryza sativa
  unsure (1)..(915): unsure at all n locations
aaccccagagtncgcacatactcaaatacaaagcacttccctagttagatgtaggttagacttcccgttcgagaaactctatcttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggcgaatggctggcggcggttcggttgctttgaagcatttgttgctatctaaattccatttaaggtcgtaccttatcgcccagcataatcttattctctatttgattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggcccccgcccgtttcctgttccacaagaagaatctatactactccttctacacctcatcgcgaatcggtcgtccgcgtgccattcaattcgttgatgatgcgggtgtaatcctggagg

SEQ ID NO: 16657 - DNA, 802 bp, Oryza sativa
attttctgatggtaagaaacagctcaacatgattttggatcaatctaaggtgactagttacaataggggggttggttttgatgttcataactatttcaccaaaaatcatcccaatgttttgagtgtgactgaacatggtgaaattttgagaaaaccaagtgctaagaaaacagtttttaagtctgctggaattttgccctctctttctagaactttaaaagaaacaaaaacaaatctttcaaaaccatctactttacaaacttgttgtgagaattatatttgttctttttgtggaaaagatgcacatttggttagtttttgttttcgacttgcccgtaaacagaaaaaggaaagagaaattgcttttgcaaaacgacgatggcaaaaatcgggttttggttcgaggagcacggttagaccgacactgactagtcggtcagaccggccagcggtcagatcgcagttgaaccggtggtcagactagatgccaggcccggtcagaccgcagggacaacggtggtcaaaccggcttccgggcgattttgcacgtaattcaaatcggacttttgtgaaacgacaaggtaagttttcaggtaagtttagttctgattttgttagtgcatatgtacctattggttctactggtcgtgtgactcagtgttggattccaaaattttttatttctaaccccaacatggaggcctcgacattttcttgttcgtaggtattttggtggcatactccctatgtgcgttcaacgttgagatggtgagtgcttttcaaggtaatatcaagataattt

SEQ ID NO: 16658 - DNA, 2098 bp, Oryza sativa
ccgatgtagtgcagatcactgcaaacatgtctcaaaggtaccagaatatatctatcgtgctatcagcgcaccgacagtgcaacatagctagagatgattaagtaattacaggtccagagtctccagctctgcaagacttctcgctgcatatatagtagtgtaggatatggtaggtaaggtaaatgtaactaagtttcttcagctgtaagaaccaccatgtactggacaaccgttgaagggcgtaagaacaggcgtgccacttagatggagaacgagagctgagccatgaagaggttgatgacgtcgaggtacagcgagatggcggcgatgacgtactcgttgtaggtgtggcgcttgatcagctgattggtgtcgaagacgatgaaggcggagaacagcacggtggcgaggcagccgtagatcgtcatgccagccctccccagagggaaacagatctgccgggtcacggtgaattgcacaatgagttagacagcacttgagaagaaaagaaaaacggagcaggttgagcagggaagaagaagataacctgaatgatgaggtatgccagaagcaccagaaggctggcggccaggaagggatacatgaaggtgaaatcatggcccctgtgggctgcccagaatgtgaaaatggtgaggccgatgacagcaaccgccgttaggattgctgcttgcagaaccactttacctgttagcattgagcaaagaaatgtgaacttcaattgaggatacacaaatcattctgaaggagtatttgaatcttgtttgcaagtaacaggaagtaacaagaaactctctgaggtgtcaaggaaatcatccatgtaatctagctcagatctaaagaacaagttctgtgttttgggggttgcagtctttgaaatctacaatcactcaaaatgagaagccatgtgttgtgcccagggtttacattaccgtcggtaaccgcgtggttaccggccttaccacgggggtacggtaatagaaaaaccgcggtaacctccttaaatttaaaaaataatttgattttttgataaattttgcacggtttcgtaagatttttcacggttaccgcgcggtaaccgtgcttaccgcccagggcgcggtaacctcggccccggcggtttgggaaaccctggttgtgccataacaaaaatggtgttcaattgccaataaagacagaagatagaaaaggttggcagttcaatctcaatatatgatataaaacatagcgaccaagcactcaacgcagtgaagcccagcggaggtttctgcaagtagatctggaggagccacttgctccatcacaaacacagagtaaaaaaaaaaaacagagatgatgcaaaaggggtcaggggacttaatcttgacaaaggaaacttagcatcctactagtgctaccacaacaaatttgttgactgaatagtagcacactaattagccagaattttcaaggcatggaagcatttaaacagggcaggtatacagaccatcctttaataatatagtatgaatatgaaacatgtgatggctaaatgatacaacagacaagaaagaaaacagtaattgaaaataaattcagcacacaatatgtagttccaacagttacatgcaaaacttatagaggttgtccaaaaaaaaaaaaacaaaattgagaattccgcttaacaaacacttttgtatggtatttttgagggaaaaagcatcttgtatggtgttggcacatcagggtttgttttttatcccaaaaaaagctgaccctaagatcatccccaccaccgccaacactatcattatctaatcaggacctcggtcagtcagtcacagcaaccaaaatatgcaacatagttaagattgctgacacctaacagcaacatagtcatatatcataatctcccaggtaataggaactaggaagcgggccaggtcataatggtcctacccatacaacaatatgcaacactacaaccaatatatactccacatcagaataacctcaaaagtcaaatgtttccttcccaccagaaaacacaacacaaatctgctttgtcaataatgcactaccaactactccctccgtccca

SEQ ID NO: 16659 - DNA, 2113 bp, Oryza sativa
cactatagatatccaagaatggtgatcttgtaaggtagtattttatatgggaaaaggcatcgtgtatggtgtttccaaacagcgcgtgcgttttataataaagaaagttgaccaccaagatcatccccacccccaccactaaccccacttataaaacatgtgtcaagactataaaaatctaatcagggtctcgatcagaaacagccacaatataatgcacagccaacattctggagtagtcaacagccaacattcataattaaaattctgacacctgatagcaacgaatatcataatctcccaggtaataggaacagcaagtggtccagatcctgatggtcctacccatacaacagtacgcaacactacaaccaaatacactccacagcaaaacaacctcgaacttttccatctaatcacaaaacacgacatctgatctgttcaataatgcacgagcagctacatccctgcaacaatgctactgagagagaaaaagaaagaactcctgggaatcgccaatcccaccaaaagtccagaaccaaatcacacggagacaatcaattggcccaagaaccagccataaaatttacccatccgaacccaactgcatctcaaatcagtcaatcacccacgtttagagcatcacaattcccccccccccaaaaaaaaaaaaaaacggagacctttttcttcggagaaagaaaaatggagacattttggggaggagagaaatggagagcgcatttggcgtgtataccgaggaaggtcgaggagcagacggcgatggtgaggctctcgcagagcgtgaagaggcccagcagcagcaggttcacggggtgcttctccctgtacttgagcatcggccacagcactgcgcaaaccccaaaaccccaatcagataccaccatggaagaaagaaagagagatcgaggaaccaagcaagggaagggaggaggaggaggaggaggccgcagagaccgatgaaggggcagaggaggatggcgaggtagacgagccacgaggcgagggagcccgccgcgaagaagcgcgggatggggcggacggcccacgccacgacggcgatcgccgccgtgacggcgaactgcagcgccaggatacagtacaccttccgcacgaacgcccaccgcagccgcgggtcctcctcctccgccgctaccttcctcctcgccggtgccttctccgcaaccacctccttctcccccgcgactcccatctccgggtcgggcttggcggcgtcgccggcggcggcggcctcggccttcgacattccggcgacggctagggttttcgtcgtcgcgggttttggggggaaaacggcggcgagaggtagacgaagcaaaagcaactgcacagcggaagccatggcgcggatatatcgagcaaggcccagtcactgacatgtggggccaatttgtcagtgtaatggagcgtcttcgactgatcggttagagattctctggacacgtgtctaggggtggttggaggattgtggcgagttgggctcacgctcatttttgggcacacggagttggagtacctacacagatttttaatttttaattaaaatctaataaatacagtaaaatataaaagcaattaaaaaaataccataatagacactaaattaccatatctgcaagaaaaagaccatatccaatataaattttaaaacttacatgtgaagattaaaaaattacactgtaacttacaagaaaacacactgtaaatttgagtgagagataagaaaaaatctttcgagtgagatatagcgaaatcgttgggcatatatgctggttggtggctttgtaataataaactcaatataaaattgttactgtgctgtatgtgggttaattttgttgatgaaatacctctaataaatatccttataccctccttctctgaaataaaaaaatcaaccttttaggatatatctgaacagtgtttatccaaattcaccttagaaattgtgcttgttaaattcactttacaatcgaaacaagacactgtattattatagaatatatgcctcgtggctaacacgtatcaccaactacttattactccacaagtaaagaggatccgctacaat

SEQ ID NO: 16660 - DNA, 15888 bp, Oryza sativa
  unsure (1)..(15888): unsure at all n locations
ctattgtttggggaaaggtaataattttttttttataccaataagtagtactagtacgagggaattttacaatgtgagatcgattactactggtttatatttaagtgatgagctttctctattttttttaaaaaaaattatacacgagaatcatgatttgttggggtgtttttggaaaagctagggtcaaccgatcccatagattaagcatgaatccgccactgactaatgctacttatatatactatacttaggccctctttgtttaggtttataggtttgttggattaaacttttaagtcagcttattggcttatatgatttatgccggtggatttattgtcctaagtcaaataagtcaaaaaagcttctccaacctagcttttggcttaaaagtgttagattgtcttatggcttcaaaaaagccaaatgaaaaaagccacttgtttgtttaggcttagacttttcggattataagttggcttataaatctaaacaaagagggccttaatagaggaagtatgtgcaggtgtaagaaataaaacaatagcaaattgtgtagatatttagggtgtgttttgaaaggaggtgaaaaagagaatattatgaagatatgcaagataaggtgtaaccattagcggatgattaattgatattaagcattctaaacttgtaaatggatcggtataattatttttaaattaacatttctatgaaaaacgtacgcataaaaaatgagctatatttatcctttgtgcttcaaacggacgcatcctcactcctcagtactaacaactttgttttgtgtcatccttgttgtatgccacattgccatgacctcaccatgcaagaccaaagtgtagtatttatgctttttcctcatttgctcaaagtttttccatctgcccacctccaatcacctcttcttcaacatcttcccctagtcttgagctacatggttcctgatttacgcggcgaacccaactaacctctcgctctcaccgctgactcatatccaatgatcattcaacaaccaaaaaaaaaaactctgagatcacacacaaacttgaaaggaactggtacaagaaaacaagaaggaaaatgaattaaattttccataaccctaaatctaggtaggcagagggtggtttaacttgttcaaaaattttgccgtgcacattgctgtgtaacatttcacggaatttcccctgccgtgtcatgtcactccccccaaatttgggtgcaacaattttgcaaccttttcttcctctccggtgtaactgcgtgcaatctcgttcaactcgttttcccatttttatggtataaatatacatgcaggtgttgtaactagcttttgttcacttttttgttttgaccaggaaagctagcttggccacttcacacggcagcatcctctgcctttgcagatcacgtcttgccactttggtactccggtgcaggttcacagttccgacgaaaaccggtcgaatttcgtgaaatttcgatgtttcaacatggctcgaaattaagttttgatcaaaatttcgaaggttaaacagtaaattcagttaaaatttatcaaaaatcataatactaatagggctcgaaatttagtagaggtaatgtaaaccctcctccggcgacggcgatgtcactggcgatggtggactcctccgccgcagccaccgtgcaagccagccacgtacgtcccgatgctgggccacgtggcaagggcttttcgtgagggagttcagagaagaaaacaaaagcccatgaagctctttttatactccctccgttttacaatgtaagtcattatagcatttcttaatgttaatgaatctagacatatatatctatttagattcattaacatcaatataaatgtgggaaattttagaatgacttacattgtgaaacggaggaagtatgttcttttaaaacaggatacaattttgaactaaattcatctcacctctacatgttgcaagtttggactaatttcatctcacgaagaaccaaccaaacattgacacaaaagaatcaatcgaacacatactgatactgaaaagagagcggataaattaaggagaaggaattggaattcaacttctcaattaacgaaccagatggttctcaaaaaaaaaaacaattaacgaaccagatgatgatcacacacactcgtggcaaggagaagtatgcggaggtcggcgacgtcgtgatcagaggcatctctacactgcacagacgatagaaataatatgggactgcctattcatttgtcgggccggccagcccattcatgttcgtctgttacaagaaacagcccatagattggcccatttgaccgtgcaaaaataaggacagttttcagaggcctctctccatttctatgatgtaggcttgccttgccactgcagctttaaacttctggcaaattgtccaaccaaatattcaaaactgaaagtcgagaaagttaatcttcgatgtttcagacggggagacatatgccctttattttacagaaaatttaacgatctgccactccctagatcgtcccttgccaccccatgagaaataacaccaaagatcatttcagttagtgagacgtgagtcaggataacaaattatcatcacgtcttttttgtttaccagaaacttcagtctcctctcagtaccatcagagatttgactgccaaaattcactgtgcattcacattctactctttccgttccaaaataaattaacatttagagtttaaattttgtcctccaaactatactaccttttctatctattattggtttgcagatcgataaattttatgccttcaatacccccacctactcattcatgaatacaactttcctacttaagggtattttatttattttcttatatactcattgtgatgttatgatttgatttttattaggatggatggagcatgtttataggaaacataaatttagctagataacaaagtttttttcttacagatgcgccattgactaattaactagcaccaataatttagatatataggatcgaattggcgttcaccgcgtccgtagtttatatgtaaggattggcgacagataccagctgatggcacgtgatgatcgattgatctccatacatgcaagcagccattgaacttatttttctttgaatcctggcattatttatcactcgcatgttcaggaattgagctaatctattgaaccactccgtatcgagccctactctatttacatgttcagtagcgcatctaattcggttaaacgatggtggtgactgaactgatcaaataaaattcaattagttagcagttgagatcgaactactaattaaccgaatttttcggttttgatcttttcagtctatttaaccgttcttttctcattaagatacaaactttacctcagttttcgttagcaagtttttcaaactactaaacggtgcgtttgtacgaaaactttttatatagaagttagttttagcgtttgtacgaaaactttttatatagaagttagtttaaaatataaaatatatccatttaatcaagtgctaatagctttctcgtttacgtgcgcaaaaaatctttcatcttcatcagtttcatcatgtgccgaaaaatatgtcttgatcttttagtttcagcccattttgcctgttaaatatgttatctgaattttggcccataatatattcggattagttttttaataggactctgcattataggattaattgcctattaggacggctagatttctccgatatatatttcttgtaagctgcacgaaaaaggtgcgacaacccaatatatccccagcggtatccatctgtatctctttgtctcgtgtgtctgtgagaaagttagtagtggcacacagtatctctcacaagtatcaatatgcacagtatctcacaagtatcaatatgcatgtgtgtgcctccttttcacaaggacggtacggctgcagggcaagtaccctgtacccttgaacctcacatgacaaacaacaaaaagatatactgtactcctttacttgtagtagtatggagaagaaaatgtagaatacaaatatatttcctccgtttcacaatgtaagtcattctagcattgcccacattcatatagatgttaatgaatctagacacacatatatatctagatttattaacattaatatgaatgtggaaaatgtcatttctaaaatgacttacattgtgaaactgaggaagtacactggtacttcagaaatgacaaaactattttgatattttttttccaaagatgctgctagccaaacaaccccctcgatcttgttggagtctgtggggttgggttgctgacctatgctatgccatgggcgaacactatttttcaacccctctaatcctctccttatgatattactcctatctgaatagtgaatgatctttcattcagaaagacaggagtaccatgatgatgatcagatgcatgccatcttatactactactagtattgcagtaacatggagcagctgatcatcggacagctcctgcctcctgttttggcagtgaccattttggaatcagtgtgagacatagccagtctaccaggttgaaatgggatgttgtaaagctagctggtagtatatctgttcaaggatgttgaagttttcgacactgcatgcagttcagcagtttcaggttagagcaagtataatagtaggctataagccggctaaatgctgatgtggagaagagaagagaggagagagaggataaacgggctgtaaacttacagccggctcagacacaataaccaaaaaactctatgagagaggcaagtgggccatatattaattgtaaagagctaactattatatggtaggctgagagaatgctacaaagaaccttatagctaacaggtcggctgtattattaaccttgctattagggaggagtattgcaggggtacagttgacaggttgttattatgtgcatcctgcagcatcattccatccctacttacagttgatagcgagtgttcgcattaattcagatggtagaatatgtgcagaattccaaatataatatctagcggctatcttataatcttgtacacatgactattcagcaacctctagaaaatagcttagttttgtattcaagtgccttctatgaaattctctatcgtctatatataataacaaatatgttactgttacttaactctttttctgtgttctagcaaccaattaaagcgtcatgcaagagtcttcgatagtattgtaacaaatgtgttgaattttcgtgcggttacttaaacaattctatgtgttatagcaaccaactagagtgtcgcccaagagccaattttcgacaatttatttggtgtgcgtgtatgcgtacatagcctattatattatgctaccagtagagagtatcgtagcgagactatactatatatgcactgctcacatataattgatgaatctcacaggagatatcctaaagttgtacacctatagcactttcacattcgaagcaaccacacatgagtgcacggtttttatggatagcgtgttgtgtttgcatcggccgatcatacatatgcacgcatgcatgaaatgggaggagaaatcgatctgcacgccttgtctcttctttgctcaagaatttagagtttttttttttgatcagtacacccatctcctgtttcagtttactcgtctacaggggtgtgtatagtgtgtgacactgtggatatatagctagctatagctatagctgccacaacaagcctcttgcatataaaatctctgagattatttatatctgtgcaaacatggatggaacagaaaggccaaaaagatatagccattggagcagctaggcacagatcagagagactcatgggatggcaacatgataagtaatagggcgacgctccgatgctttttacttgtagtatatactacaagtataattaatctgaaccgtttatttttaagggtagattagtaaagttggagtaaattagtttggggtagatttggcacttatttcttcaggtgggtcccatagtcaagcctgctccttctcttcgcaattaggccgtggcgttctgggccggacggacgtgttgatgaggggcgcacacatgtacgtgactacacgtccggtaaaaaaaataaaaaaaatgtgtcgaattaaaaaaaataaaaagaacgtgtctgtggcgtaggataaggtaggctacaacgacaagaaaactggtttaaagtttttaaactcaatgaaactcggtttcaatttgagacgaaatttatactataacagaactactatatattttaggacacatcgtattttatatccggaattcatctgggaatgtccgaaccaagttggaaaaaaacacatggttttttttgtcatatacacatagaataaaggagaaatattattttaaaacaaaattggttatgtccggaatccgtccagtctgtctggatcgggtcgattaaaaaacacgtggttttccgtccagtctgtcttgtagacaaagaacaaatgagaaatgctattttaggacaaatttggttacaacatgcgaaatccatccggtctatccggactgggtcaattaaaaaacacgtggtttttcgctcgtgcgcatatagaataaaggagaaatattattttaggataaaattggttacgctcggaatctgtctggtatgtccggaccggatcgattaaaaattaagtgttttttagttttgcgcacataaaacaaaggagaaatactattttaggaattggtcacaatgctcggaatccgtccgcttctgtccggaccctcgagtcgattaaaaaacatgtggtttttgcttgtgtgtatatagaataaaggagaaatattattttaggacaaaattagttacgctcggaatcggtccgatctgtccgaaccgggtcgattaataaaactcgtggtttttacgtattgtaaacatagaacaaaggggaaatactattttagcacaataatggttacaactcttggaattcgtccagtttgtccggatccacgggttgaccaaaaacacgtggtttcttgcttgtgcgcagaaatattattttatgacaaaactggttacaccagaatccgtccagcctatccggaccgggtggattaaaaaaatactccctctgtttcaggttacaagacgttttgactttggtcaaagttaaattgttttaagtttaactaagtttatagataaatataataataataattttttttagataatggaataaacatcccagcctttgctaaagagagctacagatatttgtaatactaaattatttatattttcataataattttgtcttgggttaaaaatgttgctactttttctatgaatataaagttggtccaacttaaaacagtttgacttcaaccacaacttataacctgaaacggaaggagtacatggtttttgttttttggaccaaccatattattcctgtcagaatctatccgtatgtcaaccgggactttccgtttttcatctatgttgttttctctattttctcttttttttccgtacgtacgagatccattttcttttttcgttcgtacgagatccattttctccgtttccactgcagtttctttcccctattaccccgtttccacccattatcgatccgtccgtttccatctattatcccgtcaatttatcctgttttaacgtgatttgttttctccgtttgcacttgctgtttctttcccgtactatcccgtttacaattggtgcggtttatatttttaatcgtatcgagttctttaccgctatggaattaatgttattaattccagtgaattcccaatctgaacatataccatgcggcggagcaggcgaggtcgtccgaggcggcgatgacggcggaggaaggagctgcgaggttctcttcgcctcggcttaggttagggatggcgttggctctggaacgagacaggagaaagtgcagctaaggttaaagaataaaaaggacgaaaatacccatccgtaaatattttttcctggacaaatatacccctctacgattctactaccgttaaatgtagttggagtagaaatagatttgaaccctccgatcaaataagatcaacggttcagattattttctactacgagtagaaagcaccggagtggggctctaagtaatatagtcagctgctttcatcatgtttgtcttgaaatgtgtaatttggatacgacccatcataagagtcctctgaaacatagttttttttaattagattttaattatgtttttgaatttgttatgtaatctcctgctatccaaaaaaagtccttagttttatagccaaaaggtgttagccatattgtggttactcttgcagtttgtgtgctctataacttcaattttaacttcatcattttctgttagcacgcttttcaaactgttaacagaaaattcaaataaattcatttttttgattttataataattaatacgtaattaaattattttttaatacgtaattcttcatccttttataaatggtttctatgtagaagccatttaaaaaattcaaataaattcattttttttgattttataataattaatacgtaattaaattatttgctaataagctttctcgttttacgtgcgttgaaaacctctctcaagtaagaaatcgaacgggcctgagacatcagaatttcataggatatggattggccgcagaaatctaagtcataaaacttatttttcgatgggaggggagcgatggtttgtttgttggagtctattttttagctttgtcttttaaatatctagtagtagtagtataaaggttttactccctccattccaaaatataacgctcaaccacccttaacccaaatatcaacaaataattattatcacctcataattttgatcacccaaataaatataatgcatacccaatagaattaacgatcttaagtatggaggatttaaaaaataaatttagtgggaaaaaagttctagttaataatatacattcatgcataccttatattatgaaacattaaaaaatagtgtacggagagagtacatgttaattattttgtataactttgcttatttttcatgtctcgttagcggtagctcaatcaatcagagtcattactgtgtgattttataaaattaatccggtgaataacaaggatgcaaggaagcaggtgttgaacattatatttggtcggtgagtgagagtagtgaaagaagatagaaaagtaagaaaaggaagagaggaataaagtgtagagatgtggcttggactggggaggagtactcttgcagggttacaggggccagctttgaacccgggtcccggtcctggccatgcatagacgtcaaatcctggagaagactatggagttcattccaagccaaaatttttaatcatgagcaaacagacaagcttttgtattttccttgcttggttgtttctccatttaccagtcaaacagcgcggggtaccaattgtaaccaaaccattgatattattgccctctctatcatatataatatagaatattcgtaccaaaatataagaaatactggtcatatatttggaccaagaactagacaagtacaataaagtagaatgtacatggtactgtatttgaccaaactatgcattggattggcggatccaccgcccagcgaccctattggcgtctgagctcgttagaaagatactccatccgtccctaaatataaagaattttagttagatataacgtatcctagtactaagatacattacatccaaccaaaatcccttatatttagggatggaaagagtatacaatagaatttgaatgttttcggaagatttggagacaattttcattgcaaatactccctccgtcctataatataagggattttgactttttacttacaatgtttgaccattcgtcttatttaaaaaaatttggaattattatttattttatttgtgacttactttattatccaaagtactttgcacaacttttcgttttttatatttgtacaaattttttaaataagatgagtgggcaaaacagtgttaaaaaagtcaaaatcccttatattatgggacggagggagcataacaagatttgctcagactctgaaagactgaggctgtgtttagatgcaaagtttaaatccaaacttcagtccttttccatcacattaacttgtcatacacacacaactttttaatcacattatctccaatttcaaccaaaatccaaactttagatccaactaaacatagcctgaaactctgttggattcgccgctaatgcaagctgaacttcatatgaccatgcatcgatctatgcatagaaaatgaaaaaaagaaagtccatgcatatactttctccacaactaaatataaatttttttattagatgtgacacattctaatataatgaatctgaatatgagagagttctatgcatgatcgatgctgaagtacgggtagtaggcactgtactcctagtatcatggggttatgtagcctgaagtttcaggataacatcgtcctgacattttagtactccgtgcatccatgtgatgatgtgatctatcagagtgagtgacctcaccagacttctaacagctgagaattgctttcacgttgtcagtccaaatagacttgtaactactccctcggtcctatctttacttacactgtttgaccactcgtcttatccaaaatattttagaattattatttattttttacttactttattatttaaaagtactttaagcacaacttctcattttttatatttgcacaaattttttaaataagacgagtggtcaaacagtacaaacaaaaacttaaaatcccttatattatgggacggaggaagtagatagtataatattctacttcctccttttttatattaattataagtcttttttattatttttttaattaaacctttttgagttcgacaaagttataagaaatatagtagttttttcgaaacaaaacaaacataatattaaaatatattgaatgctagatttaataaaactaatttggtattttagctctatgatgagctcctgcaacatgttaatgtaatactctctccgttccataaaaaaacaaacccacgataggatgtgacacatcctaacattacgaatctagacatcctataataatctactaaaactaatttggtgttttagctaaaatcttttttactagaaaaaaatcaaagtgatttataatatgatgaaatggagggagtatactgtaaatttagctaggttggtttatttattagtaaaatctcagtgtatatatattttgtaatacttgttattcgtcgaactattctgtttttttaagtacaactgtcaatttaggacggcttatgctgtgtttagttcacattgaagtttggaagtttggttgaaattggtacgatgtgatagaaaagttgtgtgtgtgtaaaaaaggtttaatgtgatggaaagttgaaagtttggaaaaaaaaactttagaactaaacatggccttatatgctttaagattcgtgctgaacccctagttaattattctctcttcaattctcacccacttttagacggctaggaaactcttgcctagtccaatatcatgagaaaatcgcgtgatgtaagagcacaagacagataattgtccatcttaatttgcaattacaatgacacagtataacccctacaacctgaagaatgcaaagtgaaaaattacctaagcaaaagaactagtcgaaaaagggaaatcagataaatcaaaaagaagaacatacacggtaaaatccagatcttaaatttcacatttacagacattaccggcatcataaactcgatcagtacaccatcttaagattaagatcgacctagttgattaattaactagtttataatcaccacaaaataaccttttaacttaaattactttctcctccccctcttttacacactactacacccctttcaaaactatgctactgatcgatcgatccacgcagccatggctggcgccgccgccgccgccgggctacgtggttcgccggcggcgagacggcggcggtcacggcatgaagagcttatcgccgcacttgcagcgccacacctccgggtagtactcccactgggcgccgacgcccggctggatcgccacgtgcaccggccggcacggcgcgcaccgcccgcaccgcgcccggcacgtcggcggcgacgacccgggcccgatcagccgccgccgccggacgtcgccgttgtcgccggcgccggccgccgcgttggtcctcctcgctagcatcagcgacgacgacgagtctagtctcctcacgtgcgccgctgctgctgctggtctccgtagtacacggattggcctccttgcagcagcggcaactgtagcatgcatacatgtatatatggttaattgttagtataaactttactgaaagcatatataactatattgatatatttttttaatgttcttttttacaatgaacagtggatcatcgatgaatccgtacgtagaaaaccaacctatgaatttttttttgctcgatcagtttgtactatttaatctataaaaaatatagccatatataaaatagttatattttttaaatagtacctactaatataatacacgacctactaatataatgcaagtacgttcttttcaactacttcaccaccagattattacctcgaattattagctccacgcctaaaaatacgactctttttacggcatgaatgatatccggtcatatcacttatctcaactagcaaagctctagactttgtgttttagtatttttataggatgtataaatgtatcgatgtatatatatatgttatttccagatttaataaataataaatacttcagaattaatacaacaagagacatctgcctctcaatacagcaaaaagaacccttgaaaaatctcctaattacatactctacattaatcattcgtggtgaccattgctaattagaatgggtagttagctagctaggatctcaaggagattggagcatatggtcggcgtcctaaacgttaagcaggtgagaccaaaaatgtatttgtggctagctagctgattaattgggctgtggattgtacgtgtattggccttgcatgggctgttctcttgcagaatctttcttcttctctccctgtactaaagctgatgtcgtgtattatattagtaggtcgatcgtgttatatattattttctggaccagagcgtgcagtgccatcgtgtgggcaccagcacactacactgctgggagaaaaaggctctagttggtgaagaccaaatgagaatatgagactatgagagagagagagagagagagagagagagagagagagagagagagagagagagagagagagagagagagagagtgtgtgtgtgtgttaagaagcaaattaatataggtttgcatcttgaaaatgtgtggagatatgattgagtgtacagcttaatgagaaagttaagagatcctgaccttggtggctttctttcactagctagctaggatgttgcaagtgtgaggaaactaaagatcaatggcatgcaacaaggaaattgaaattgttaattatattgcaatttaattagcttttgggctaattacactttagtctctgaggaggtgccttatattagtgtatttgctaggtgatgggacgaaaagtaattagcagagagaagggtgtagaatgtatatatggaccttaatttgcaagcatgcaagaactacaccaaaacttttcatcaagagagaagggaagcaaataaaaatgttaccatttgagagataagcctctcgatatttgtattcggtacatgaagagagtagagacggcatgctaatcaaccacaagaatttctaagaaaaaaaactaaccactagagaagaacacttaatttaattaaggttcagtttttaagattgtttaaggtagtttccttgagagagaagacctggccagagatagctaccactctaatgttatatgtaaagtagtaaaacattgtagctagattaattaatcaacctgcatgcagttaacaagcttctgatgaacctaatcaaagatccggttaatttggtcttcagacaaaaagaaaagcaccaaaaaggtgaaggaaaaagagagagctagagcaagtaatcactgattatatgcagaagatcaaaagactagacgctcagattaaaaagtgcacgcatgaaaagaagagctggcaagagagctagctcgcctctgccatctctgcactcaccagctgccgcggcgaagacgacgacgacggcgaggcgaagggcggcggcgcgtcnccnccaactccctctccggcagcagctcacggcgcccaccaccaccatctcgccggcggacaagagaggaagactggccagctagcagctagcagcagccaagcacacgccggagaagtctagctacgctagagagtcttgagcagacaagcaatggcgagctcttcctcactccaggagctagaggaagcaaggaggcagctgcagccggccagggggctcgatctggtctctgatttgcaggtcggagatatcaagaacaggcgcccgctcgtgcgtgccagcagacagtccgtcgtcagtcacaggctcacaggcacacacgcttttgaaagagagagatagagaagaaggatgtgattgctgggagtagtagtagtctagtagtagtgtgactgtgtaagagtgagtctgcttggtatgctgcagctgcagctggctccagtgtgtgggagtgagtgagtgagtgaatgaggtagctacaaataggtggaagcaatggtgtgatggtgtcccaattgactatacccaatgtatagcaagcacctgttgtaattttgtttctgtctttttttcttttcaatgtaggagtagttataatgtgtagataaaacatatatgaaaagaataaataattaattaatttttttaataagacgaatggtcaaatacgtactaaaaaagtcaacggtgtcaaacattttgagacggagggagtaatgtggccttgtggttttattggttgcctgcatgactgtgttcatggctgtatatattgaccaagagggcaaagggacgaggaaaacattaatgaagatatgtccccgttaaaagaatttcaaaatacaccttataggatgaacagagtggagtaagtactagtgatggttgttcttctcatacatcccatagtagcagggtctgcatggttggccattgttatatggtcgagaattttccgtgtttgtctatattacaaatcatatatattcaactacgaagattttctctagtgttgagctttatatgtttcacaacttacatattagcagcagatcgaatttagtttacggtaaaaatacattgatatatatatatatatatatatatatatagcacactgtagtctttgcgaaacttaaagcattgtcaattgacccaatgggttatatgggtttatagaaatataatataggggagtttctataaagctacatgaattacactattacaaaataggctcactgaatggctggtgcgtgatgttggatttgatctaacggctttaaaaaagcttacgatagtaaggtaaacctttttcgaaaagaaaaaaaaaagggcctgacagtgtttagcaacatgtggcaacaaaccaatgagatgacaaaatactttttaatgtaaaca

SEQ ID NO: 16661 - DNA, 1925 bp, Oryza sativa
gttttatgatatcctatatacttatatagttcatcatcacttacttagtgcttaaatgattaatttatggttcaaattaactttctcttttttctctaattaagccataccaccttaattgtttttgtctttagatgattaatatacggttcaaactatctccctacttttcttctttaataaagtcataccactttacttttttatatttaaatcatcattctacatgctatttaaatttaaattatcatgaaccacattaacttatttaatctgatgttatcatcttacacgtattttttttattgttatcatactaaattttcgtagcaatgcgcgggatttcagctagttatattaacgatcgatcacatcgatctctcagtactattgccgtcgccggctgatttaattaattgctttttgcccggatttgcatgcatgttaactcttcaacaaaccctacttgcagtagtatcatcacttggagtagttcaataatggaaacgaccagtcgatggattgagcttgagtagctagctaggtatctagcttgctagggttttatggttcatgcaaatgtcgagtagctgagaggtcgcttttgagcatagcttcatacgtgtatccagttcaaacccaggattaatttattttggacgcaagtacgtaagaagtagcccactaagagcaaccacaatgtgggaataaagcaggtaataaacaatcaatgctggagtagtttcttacctggtaagccaatacaactttaacaacatgggtgacggtagggaaggaacgacggcgaactcactggagaagaaatctaaggctgtgtacggacgcccccttttccaacttctctctcgttttccgcgcgcacgcttttcaaactgctaaacggtgtgcttttttcaaaaaagtttctatacgaaagttgttttaaaaaaatcaaattaatccatattttttaaaaaaattagcaaatacttaattaatcacacgctaatggactgctccgttttccatgatcactgttcctgatgggaacttcttctagctaacacagcctaacatgcatgacacgaatcttggagcaaaatcgaaggtaatagcatgttttttctccccttaatagttgaatggctgaatgatcgaatgattttgtgataactatttgaggatatagacgaatgagtttactattataaagttgaaattttgatttaatgcagttttctaagaaattgatatatacaaagtttttgtaaaaatcatactgtttacaagtatggatagtgtgcatttcttagaaaagaacacaaagaaattgagttcaaatgcagattgatttttaagttgagaacgcacaaatttcatccaagtggtgtcaattagctagtagagctgtagaggttaatttattctcatcttcttaattagttagtactgtacatgcaagcgtacattgtttcagctggaaaacaacatctctctctccccgggaacatgcatggaaaacaacatctctctcccccatcgtcgtcgttttgctacctcgatcaaatgatgacgcgtgcagagacaattccatgaaaagcatacgcatttggatccatctatgcatgttgtgtcgtagaatatattatggtttttactccctactccctcaaatattttatattttgggacagagatatagctaccagggtttgaaatttcggtaatttcgcccccactggcatgctcacatctcgcccgaaatttttcctttttttatattttttgaatttagtcaaattttattcaaattcattcaaaatcagtcaaaatttcaaataatttctgccaaaaattaccgaaattaccgaaattttggccccctagcaaataatccaatttcaaaattaaaacccctggtagct

SEQ ID NO: 16662 - DNA, 17785 bp, Oryza sativa
cccgtgcttttttgttaatattttgtttctataattcttcttaatcgataatttgatatctcgccttaatttgagcattttgcgcggctttttcataattagtacgccatcttaattagatccttgaataatttagcacaccgtatcgcatggctaaatcctcttttaatttttggtcatgtaattaataacaaactaaaccaactaatgatttatatttttacaacgtcttaataataatcgcatcacaaaatccacatggtaattaccactagcttgttcgattaaaatccaaaaatgtatctggcgcataaaccaattgtgcaagggggaattgattttgccaacaccaaactctgaactcatgcattaattgcaagaggtgtgtaaatctgagtgtaatattatccaaggaattagaccatgcgttcttatccttattggaaggacatactgacggtgctatatgatcccttaaactatactgcatggaccatatgagatttaatttttaatacacttatgaatgaatgcatgcatgcaatcctatcatttcttctacatcatgcatgcatgcatgcatgcagtgttctttgctgtacatacacttgtacaagtacacgtctagtcatctctactactaactcaattgaaaagattatcattttttctcctcacacctgctcctcccctcctctagaatggcatttctcctgcctctcttcctccagacacatgggggccatacatctcactgattgtgcccatggtctaaggtgagagaagatgatcatgcacaaagaggagctatagctaggaagaaaggaatcttacaaatgaaaaattcttggtcatcaaaatcagctacactacacctttctttactggaggaccctaccacatgggtgtagtcctcctgagttttgttaacttgtgtctacagtgaatttcaggggtagggcccatgcatatactatatggaacatggtcatggtggttggccaacacattgccctagctagtgttaggaattatactggccatagcttttgtgtagcttcactgttcatgtcagaaagccaattcagagtcaggctaataatacacccaactgctgattgtatagatctttatagtatatctctcagctcactcatatagtggttagttcttcactataaatatatggtccacctgtctgtcttatatattttcttagttcctgtgtctaagccggctgtaagcttacaacctacttctcatctctctcctctcatatcttatccacctcatcatttactcgtttagtcttcttatagcttgctattattcttgctctaattaagctatcctttatttgcacattgccattctatagctgcagatagatagatgcagctttatatttagggtgttagctcaagggtccatgtaagatgagcacctcatttttgacaggccagatcaatgaacagctagcatcatattaacctgtactatataatgtagcaggtattggatcaatttaatttttggattatatactatttatttaattaattaaacagtagtttttactgtggccgcagcatgcatgaagcaattgggggcgaagggcgcctttgaccgtgtaataactagagcaagattttgttcatgtggtgtgaatctgtacgtgggccatgcatgacctgtacgcgaacattatatgcaggacacgtttctgaaaatcattcagtgctacatggattacgtgatcgatcgagctgcataaatatcctattgctgcaaattgcaaaaaatgaagtacaaataaattcgtcttatattgcaatgtacagacagtacagtaaccaacacgacaggaaatatatgtagtacatgtcatgcatctagtcggcattttgtgcagatatgttcgtactactgcctccgtttcaggttatataacgttttgattttggtcaaagtcaaattgctttataactaagtttgtagaaaaaataataatgcttttaacccaaaataaacttattatgaaaatatattcaattatttatttaattaaattaatttggtattataagtattattatatttatttataaacttagtcatacttgaagtggcttgactttgaccaaagtcaaaacgtctttataacctgaaacggaggaagtaccaaactagctacctagaagattggtactccctccgtcccataatataagagattttgactttttgtttgcactgtttgatcactcgttttattaaaaaaaattgtgtaaatattaaaaacgaagtgcttaaaatactttgaataataaagtaagtcacaaataaaataaataaaaatttcaaacaaattttaataaaacaaatggtcaaacagtacaagtaaaaagtcaaaatcccttatattatgggacggagggagtagctaggtagagctagcaatgctacgtgtgtgtgtgtgtgtgtgtatatatatatatatatatatatatatatatatatatatatatatatatatatatatatatatatatacgaaaatcaaacatcgtacatgatgcattgctgttagataattaagtagctagtgaaagcatctatgaaaagcacgacatggatgggtctagcatcttaattagagcatctccaacaggggagcgtattttatacacacaggccctcgcgtgtacacatcgtgtacgccaactaaaaattatcataaaaaattctaggaaaattcatacatgtactttcaatagtattacatctacgtgcaaagtcgcatcttcaaattcattctccatagagaataacaaaaaagataaaattctgacaaaattgcaaccttaaaattgtcagattttttgttttttttgttacggctaaaatataatgaatttgacgttaagattttaactctaggtgtaatacaattaaaagtatgtgtatgattttttctagattttttggtgacattttttagttggtgtgcacgtgtgtacacgtgagggcctgtgtgcataggatatgttgccctccaacagtctcttcaaatatatatttagctaactctccatttaatttagcaagtcaaattcattgttttctctaacagcctctccattcatcctctctattctgagtctatgacagcgggacccatatgtcagcctctataccactttctttctcattatcctgctccctctcttccccaatcccctttttgcttgcggcagtgtggccgcacgcggcgacggcggggtagcagtcttcgggcgcagcgacggttgccgtgcgcagcgacgacggggcggcggcggctagcgatggtggcggcagcggctcgcgacgacgaccacgcgagacaggcgtgttttctttccccttctcgagctttcttcttccttcccctctctccaatcctctccctcgtcgaggccggtggtggacggagtgatgaggcgaggctggtggcagatcgagatgtggatagcatcagcgctccttggctcgggggatgacggccgcggaggaaggagggggaagacggcggcgctcctcccggtgtaaggagacgacgatgacgctcctcccataggcgacgatggcaacatggagagacggcacaacgatgccgttgacggagaggcggcgccgcggtgaccctgacgacaaaaatgtggcgtggcagtggagctagagggagaggagagaagcacgagtagaggagagctggagagatagctagactaggaggctggccaatattggccagtgggtgggcttggatggagaggcagttggcttggagagttgaatggagagtctgttggaggagtgtatttggttcatttgccaaatttttagcttggagagttgagtagatagtgttggaatataaagtggattgcccaccttagttaagcttttgggttgaactggtcggtgcatgcaactcaatagagaggctgttggagatgctcttatgtgcatgttcatgtgggtagccaggggtataagcatgagtacatacacaaagtaaatttggagaaatttttggaggaaaatagatgagggaaggagctaaccgcgttggtgatgaccccccctccccccccccccccccaaaaaaaaaagaaaacatcctcatagctctgtcgctactgccatgaggagaaggaattggggctgtgtttagttcacacaaaaattagaagtttagttgaaattggaacgatgtgacggagaagttataagtttgtgtttgtaggaaagttttgatgtgataaaaaagttggaagtttgaagaattattttggaactaaacaccggcctgggtgtaggaatcttcaagcaattaatcactttcgatttagccctatttagtggggtatgcatgtgttctagagtatgtagtgaatcccatgcagtagccatatacgatcgaatgccttggctcgagccaacatgacgcgcatgcatgcatgctacaacatcattattttggtggtgttgccgtgtatttacaatatgttttgaccgtgtacgtccgtttcgtgaatacggagaccggatttggaaaaataatttacaatgtgttttacgtgatcaagctctaaagtgaacaaagcgttgtgggcccagtatttttaagggtttgttggaatcatgccaacctatatttgtaaaatttaagatatgccacccgtatctcaatgatatgtaggacccacataagtcaatgatacgtggaccaggtggcatatcacaaattttgtaaaatttatgtggcatggttcaaattgtccttatttttaatgccaaaggggaatgattttcctgcccacaaaaagaagtaggagcaattaactttgaatcgttatcatttttttgttttttttttctgcctcctcatttcatctttaacctgttgatcattcatactactcctacgtactccccccgttttacaaacacaaacatgtatctaacaccaaatataacggatgtaacacatatagcgacagtggaggagtcgtcgcaatgagtgcgcgcgcggtacggccggtgcagtcgcagtgccagtcgctgcctccctgctgctacccgctcgtgcgtgcaggtgccttctctctctctctcactcactcggacactatagctacctgtcttttgtggccgagtggacttgtttagatgggattaaaacttttaaatccctatcacatcggatatgtttagatattaataataaatattaaatatagactattaataaaacctatctataatcttggactaattcgcgttacgaatctattgagcctaattaatccataattagcctaagtgatgctacagtaaacattatctaattatagattaattaggcttaaaaaatttgtctcacaaattagctttcatttatctaattagttttataagtagtctatatttaatactctaaattagtgtctaaatacagagactaaagttaagtccctggatccaaacaccacctgatcgatcgagagcagctgagctgagctagcccaaacgcagccgggcaggtgtacttaattcgtggggttgtacacacgcatatcgaagggatcgatggcaatgcgactccatgggctggctatatcgcggccggcgatgtgtttaggagtgtagggtgtgtttgctcttgcttgctcctagttcatttctctaatccaggtcgagtttgatccaacaaaggatatatacatgtagttgtttgtatagaagatgatggatgtatagaaaactttgtttggctggtggtatgtatgaactctaagggcgttttcattcgctagagattgagagaagatttatgttgtttttcgtgcgcacgaatttcaaactcctaaaaatgtattgtttgcaaaaaaaaatctatagaaaagttacttttagaaaaatcatattaatctaatattcaggtttaaaataattagtactacctccgtttcgtattataagttagaacgttgcatcggctaattaagattggtaaagcagtatcggctggagtacatcagttgcaagctagattacggaggtagctgacggaagatggacaatggtcagaagtcgatttctagtcagacttggttggggaaagtttgtcatattgtgtcaaggagaggctgagttcgaggagaatatggcaaggtgatttatctattaattaggtggagtcagttatttttctttttttgtatagttcgactgtgcttgtaatttttgctttatccttaagggaagtttgagttgtgttggtaaggatttttctcgatgagttcttgtctttgagttgggctgcatcaattaagttcgatctctgacaagagatgagttccgtctgtagttgcttgtatcggcagggctagggtttccatcggttaagttcgacactctaaaccagtcgatacaagtgctaatttatcatatacgctatttaatctaagttaaatagtgttatttatccttatcggttgattcgcgttgaataagccgatatcgtttagattgctctttgttagattgtttagtgtatctatcacctaaaaaacaatctgttgacagaaaacacgaggcctgggagatttgcttaactccagtgcaggtccaaaacttgccttcggatgtatgagcgtgccagttgatttgatcctgcaatcaacaagaaataaagacaaaagaaccgtagttaaacctataaatgatagctgatcggttaggtaccgatgacatatcatttatatctgagccaatgtcatctgtgcattgatcgacaatcgtgaataaataaggaagaaaactaaacctacttgatcagctgtagatgttagcgatatatactccttatatcgatatatacttaaatcaagtgactgggatagatcggtcgccatgccgagacagtatgaatcacttagaccgaaatatatattaataacaagactatataagcttacagcatagccgatcatatagatctagcatgtatcagcaaatacctcgatactaccttatgtcaggatattaaaacaggcatagaatatcaagcaaatgcctaatatattcaaatacagcaatatcttggcataaagggcagatttaacatatcagtaaagcaaatagaaataattatagttaaatcagatacgatcggctgaaactccgatgctattctaatcgacaactaggtggcaggctggagatcaatattctaagcacgactcaatagatcaaactcaattgatgcagcattaagtatgaaaagaagaatgatatctagacaatcaagctactagaagattcatagaatggtagatatcttatataatctagatcaatgtcaacatttaacccaatcggctgccgtctgttaatatatgttagccgattgtgggttagatagcgatattgctatagattatataagatatatgataactcggcgaattatataaacgagattagagtgtcatgaagatggaagcactaatccctaagaacataattcgtcacgacgagttttacctcttgttgaagatcgaaaccggtgcagctcaacgcgaaagcaagaactcgtcgaaataaaactaaagcaaaaggtggcgatgcacggaattgtattggatgtgtgttgtgttttttttacatagggctcggggtctatttatacccgaggaatacaagatatgtccatattgaacacgactcttatctctaacaaactctaagatattgtaagtctttgcggcagacttttgcccgaacatatctctaaggaatttacataaaatatcctaattaatagatacaattgccttctcaggactctatctatgcgtggcaatcatcttgaagcacatcaactcaaacccaatgtcgcacatgggtcatattgtcggaatcggctgtatcacttaaccagtccaactcagattagccgatcccagtcatagccgatccggactccagccgattcttactctgttttcgaaaaaacccctatcttcgattctccttcgatttcatcttcatctccgatactgatattaccaaatttggtcgttaacacatgccccccaagtccgggatatttggtaatgttccggaatttgccgtgtatcgactccgaacaagtttcgcactctaacattttcccgattgttactctagtgcttcaaatactaaccgttatccccgagatctcacaccgtgacttccgttttccccgcttaagcaaaacttttaccctctctctctccggcgatccctccgacgcgcaaggcaatccctaggcgacttcatctccggccagatctccgcctacgacgatgtcgatctccgccagtccatccgccgcaccatcagccgaatacgctgaggtaagttaccatcagctagatcccctttttcatcattggatcagttttctctcgcctcttactgctttcttttctcggttactttgaacttgtagcatctctccaatttggtcgcaattcccaccttgtcgcatgaaaaccactactttctcggcctagtcggcaacctcgaccccactgagttcatcatcggtgagaccaataggattcctttcagactatccaatccagatctaggtcattggaagaatacctttaaatcttggccatctctagaaaaaacttcacccgagaaaagttggattacatggttcaagcgcatatcggctagcaaaagagttcattgggacgaaattggaatcggccaagcacttaacctaaccatagcaaactcagccaaggatgaacctctaatggcagccgcctcctatttctggtccaacaccatcaacgccttcttattcaaccaagaaccgatgaccccaactctcatagacatcattatgatcacgggtctggatgtcacttcatcggctaaccccatgagtctgaacacaaaaaaccaatatgactttaagaccaagagtataggaggttggtcaggctatgtaacagcatacatgggtcagggttctgtcacccctcgagaacatgtggcctttttgctcatgtggctagagaaatttctcttttgtagattaagctgtggtcctacaaccaactggcagtttgtagccgaagctttggaagcaaagaaacaatttcctttaggcaaaatcctcctcggctacttgtaccaaatgctgaacaatgcttcggctaagttagctgtcggctcaatagtcatagcaggtggaccatggtggctgctgcagacttggttgaatctaatagtcatgaaagtcgtcaatcggctatccgtcacagaagctgaatttccaagattagagccgatcatagagaacaacaaagaacgcactcatcgccgatgtacgttatatggagaatacgcatccaccccggccgatgctggagcaagttatcagccgaactgctcaaagattggttttgcagcttctatgaaggctttcaaaaagatgctcgagtttggtttccctatgaagattcagcagacctcgagcttccatcagatttcagattagaagacattaatcatgaaagattccaaacatccagagaagtcttcacagctgcaatcagcccatgcattcttccagtcggcgtccatcaaggaagaaacatccaagccccttacgaattctatcacctgatgagttaagctagatagcttggaatgggccaactcccaatcggcttattctttgctgacaagatccaatgccgaggagaaatttcatcaaccttgatgatggatcggctgctcaaccttcaggaccccctctaggcagcattgaaaacatagaactagcaatgttcaggagcaaaaactttgatagatggtggggtgaatggaagttgcatctattccaccaaccagcttcaatgtacatgatagacctctttccagatgttgtccctcaagtaagtctttaactttacttgatttcatttgaatgaccgcttagccgatttatcttaactaattgtttctttaatttgtaggcaacagaatcctcccctcctcatcaaagcaacgtggcagggatatcacctacgccccaggcttaattcctaatggaggtgggccatctcctcctgtcatcggctatgatgcccccaagacttcagctcttcttcaagggcttatcagagaaccagccgatgccggtaagaaaaggaaaaccagatcatcggctgtagatgctttagccccggctccaaagaagaagatcaaaaagaaagctaaaccagctgatgatctgcctgccctagatccatccattgaacaagctctggatgaagaagaaatcggagaagatgttgatcaagccgcagccgaggtaagcgatattgaaagaacaccatcggcttcacctaagcaggcccctccaactccttctgctccaactcattttacaatagtaagcaaccttctctaatcacttttgtaatcatatcactttatggccgattgctcacatactcggtaactgcagaaaaggaaggctgctgtgaagaagaaatcggctccaatgacatctgagccagccccaccggtacaataatcttatttctttcattagttaatctcgaccgattttatataacacctatctatttttagcctccttcccctcctattcaacaagcatcaagcgatcggaccccatcagctgtaggatgtcgtcatgttgaagaagaagaacaactagccgctcttgctatcccagtaagtttctcctaataagcatccaaatcggctataattgtttaacctctaactgcttctaaattgtcaccacaggtcctagccgatcttttctcttttgacatcaaagactatcttgacgaaggagaagaagatgtcacaagcaaagcattggctcctttatctgatgatgtcaagaaaactctaagaagtatcttggatcggctagaagcatcatcgctagatagcttggtagtcgactatggtccaatcagggctcggctgcatgaaatccaagccttaatcccagatgaattagccgatgtccttactccagctgtttaccttgagcagcaccaattcaagttggagaaagccaaattaagactggccgaacagcgagaacgtaaggacatcgagggcactatccaagccaaccgtcaacttgtgcatgaagaaaaatccaagctcgatcaattatctgaaggtccaatcaaatctaacattgatcggcttgaagctcgcaagattgatctcttagcacaacttgaagaatgcaacgctgagctggatatggaacgcaagaagctagccgatctcccccagtccattgaagagcagaaagctaggctcaaataggctattaagcatgttgctgaactgaccaagtccttaaaagttattcctgcaaccgatgcgcaagatgctcaagccatagaggaagtagagcagattaggcagaaagctatatcggctatccagcaatacttatcgcagtaatcttactgtaataggacttagagcttctgcaatcggctaaacattcttcatcccttaacatccttctgtgccgattagtatgactgtgagatttgctcaaaaaattttgcactatatttactgcattgtaacagatctatgccccctagttttacaatgtcaacagcattgataaaactataaaacaactaagggcgatataacaatatcggccattgtcaattggcaaacctcagccgattacattataaaacaactaagggcgatataataatatcggccatcacaaggcgatgtacacacatcggctatcatgtatcgacattagtagccgatcacgagttaatccatacactcgagtaatatttcttcaagtatttacaattaagagctcggccataaacttcaccatcaagcccttgcagcatatatgctccccccccttttttttaaaaacaaccttttgaatctagaacggtcctccccaatttggcgaccacttgtcgaatttattatcacgagtaccaatcagcaaaatcaacttccagacaagttctccttccgaaaaatccttaggcacaactttttattataatgccgagcaacacgttccttatccttagtaaccttcgcaagggctcgcaatcgggactgaaccaaatcctccctctcatcggccataagattgtaatactcgtcggctgtcaaatcattttgcaactccgtttgtcgagagccgattctaacttcccatggtaaaacagcctcatgtccataaacaagtttgtaaggaggaacttggatcgatccatgacaagccatcctataagaccagaatgcttcggccaatcgagtatgccattgccgaggataatcggaaatcttccgcttgatcaacttaatcaaactcttattagacgcctcggcttgcccattagcttgtgcataataaggtgaagaattcaacagcttgatacccatgctatcggcaaactgaacaaattcatcggacacaaatattgaaccctgatccatagtaatagtctgaggaagaccaaatcgataaattatatgctcttgaacaaactgaatagcatcccccgaatcaactttcttcaaaggaatcgcctctacccatttggtgaaataatcagtcgccaccaatatatatttatgccctttacttgatggtgggtttatcatgccgatcatatcaattccccaacctctgaacggccatggtttaattataggattcatagccgacgccggtgctcgctgaattgctccaaacttctgacaatcttgacaacccttataatatcggaaacaatcctccagcatcgtcagccaaaagtatcctgtacgtcgaagcaaccacttcatcttgtgagccgattgatgagtaccacaaatcccctcatgaacttcaccgattgcaaccttagcctgatcggcactcaagcacttaagtaataccccatcaatcgtccgataatagagctcatcacccagcaacgtatacttcaacgccttatatcgcaattttctggaagccgattgagacggattgctcaaatactgatgcacatcatacctccagtcatcggctgacattgccgcaatttcaactttaacatctttgatcatcggcttataccccgagccccttgagccaaatcattagcttcaagattttgttctcgagatacatgcttcaaagtcaccagccgaaactctttcattaattccaggcacttctcattataaacgatcaatgtatcattcttgcattcatattcgcctgccaactggctgattactagcaaagaatcccccatgatttcaatagtatcggcttcaacttccttgagtaattgcaaccccttaagcactgcctcacattcagcttgattattagtcgcatatggtttaatagtataagcaaactcaaaacatgcccccctaggggaaattataactaagtcgatgccacaaccatcagtgcgtaccgatccgtcaaagaataaagtccacggtgctatctcaaccgagccgattgaatcatcatgatgttccacaataaaatcggctatagcttgtcccttaatcgccttcggtgattcataccgaagatcaaactcagtcaaagaaaatatccactttccaattcatccctttaatattggagtcgacagcatatatctgactacatcggctttgcatataacagtgcactcattagataatagataatgcctcaacctcgtacacgaaaaataaaggcacaagcataacttctccataggggaataccgagtctcagcatccaagagccgtcgactaagataaaacacaactcgctccttcccttccaattcttgaatcagaactgagccgattgacttttcaccagccgataaatacaacctaaatggtattcctttccgtgtgggaatcaaaacaggaggagaactgagatattccttaatattgtccaaagctttttgttgctctgcccccaagtgaattcttgatcggctttcaaccgctataagggtgtaaaaggttccaaccttccagataatttagagataaacctcctaacaaaatttatcttgccgatcatctcttgtagctcggtcttattttccgggggcttaattttctggattgcattaatgctcctctgagttacctcaatccctctttcatgaacaagaaatcccaagaactggccagccgatacaccaaaagcacattttgtcggattcatcttcaagccatacttcctggttctctcaaaaacttttcttagatcggctatgtgatcatcaagttctttggatttaacaaccacatcgtcaatataaacttcaaccaacgagccgatcaaatcgtgatatatatagttcatggccctttgatatgttgcccgagcactctttaagccaaaagtcatgacaacccactcaaataaaccgattgcaccaggacacctaaaagccgttttatagatatcctcttcagccataaatatctagttataacctgcgttcccatccataaaactcaaaatcttgttccctgacgcggcatcgactagctgatcggctaccggcattggatattcgtccttcggtgtcgctttatttaaatctcgaaaatcaatgcacaccctaaccttgccattcttcttaataactggaactatgctagaaacccattcagcatatcggcagggacgaataaaaccagcatcatacaatcgtttaatttcagccttaacagattcaagcatatcggctttgcatctcctcggaggttgctgatgtggtctaactcccgttttgataggtaaccgatgttcgacgatcgatcggctgagtccaggcatttcataatactcccaagcgaagcaatctctaaactcttttaggagctctatcagcttggttctaaactccgaagacaaacctttgctaatgaatgtcggccttggctgatcacctgggcctatatcaatttcttccaaatcatcatccgacataaaaccttgaccctgcttgtcatcgagatcatctactgtatccttagcgtaaacatctgaaccctccacaacgccctcaaagtaatagcttgggttctccatcttcgattggctgtatatcagaatcggatacttttagaaaatctccatcccagacttttccagataaacaatcaaggtcatccatctcccaaagagctaaatcggcattagcaacattaactgacctgtcggctggcacaacctctatcttgtcaccttgccactgaatcaagcactgatgcatagttgaagggatgcaacaattggcatgaatccaatatcttccaagcaacaaactgtatgaacccttcccatcaatgacaaaaaacgtggtaggaatagttttactgccgactgtcagctccacatttaaaacacctttggtctccgatggattaccaccaaaatctttgagcaccatatttgtcttgataagatcctcagcattcctacccagcttcctgaacgtagcataaggcatcaaattcaccgcagccccaccatcgaccatcattttagacatcggctttccattgacgtagccgtttacatacaatggtttaatatgccgattctccgttccctcgggcttttcgaataccgcttgctctggtgacaggaccaacttggccgattcctcctctacttcatcaacatcggcctgattgattccaaattcggctggtagcgtaaagaccatgttgattggtgctgtaacaacactctttccttttgccaacctcttcgcttcatcggctgcagcatcatcggctgtaggagcttgattcttaacacgccacacctgccttggtcttggtttcctcagccgatgattgattccctcttcaacctcttgaaaacgttccctgctcctcaatctctggaccctccttttctgattttttgtgtaaataccagagggacaccattgattcttcctagtcccttcatcttcttgaccatgatcttgactcatcggacccaatctttgatgaacaggaagtcttgtctgtcttggccgatcaccctgattatgtggtcggcttgagctctcaatgacgtcactgcacccaggacagttttcaatagatggcaacctcattccttcgttgcagaagaatctaaagaactcacaatcccaatgaggatcgaaaccattgttgttctcttcataacgcctcgcctgctgcttatcatacttcctttgatacttgttaataatcttagctccaccggctgcttgactagctgtatgtaccatgttgtcgggaaaaggatttccatcgaccttcatcggcttcttggaatcgtcaaacttaatcttccccccttcgatggctacctggatttgctatctaaagaccttgcaatcattagtagaatgagacccagaattatgccatttacaatatctcctcttgcctaataacttcagccgatgggatcatatggctaggagggagctgaatctgcttctctcggagtagcaaatcgaaaatcttatcggctttggtgatatcgaagtcatacttttcctccttcccaggacttttcacccattgacatggtataacctttttgctcctcacccattcgactgcagctatctcagaatcatcgtcttcatcgtccgatccatacgtatacgggcaaacgtgattaaccttcctggagcttctcctgacgtcagccgacctatgctcatgcaaggttaccttttgtatcagatgcgacaaactattgaagtcttcggacgagaatttctccctgatcggaggaatcataccctggaaggctagatcggctaactgggcatcggtcaaactcaagctaaagcacttgttcctcacctctctgaacctctggatatactcgtgtacgggttcatcatacctttgcttgatcgccgttaagtcagacaacttcatctcgtggaccccgttgtagaaatagctgtggaattgcttctctaaatcggcccaactattgaccgacccatatggcaaagatgaaaaccaagtaaaagctgacccggataatgataatcggaacatcctaactctcaaggcgtccacagccgatgcttcaccacactgagcaaggtatcggctgatgtgctcataagtcgacacgccctcttgtcctgagaacttggagaaatcagggattttaaaccgattaggaagaggaaccctttcaaaccactcgggataaggctgccgatacaaactcccagtctcttttggtctcagcccaaattgctccctcattacatcagcaatgacatcagcccatggtcgttgctgagctgctccttgtggttgctgctgcatgggctcgaactgaccaaactgatgagcgaattgttgctgggccgatcccgctggttgatattgggcttgcggggatggaggctgatactgatagctcaagttacccccttggtagttatgcagattcggctgaatgttgcgcaccaagtgctcaggaaccatctgaggtaccacggtgccatccgattgtgcatgatgaaccaaatgctctgggataacttgattcacaaactgctgcacaggttgccccccatgtgctgcaaatccagccgatgcattg

SEQ ID NO: 16663 - DNA, 2651 bp, Oryza sativa
  unsure (1)..(2651): unsure at all n locations
agatatatgataactcggcgaattatataaccgagattagagtgtcatgaagatgnaagcactaatccctaagaacataattcgtcacgacgagttttacctcttgttgaagatcgaaaccggtgcagctcaacgcgaaagcaagaactcgtcgaaataaaactaaagcaaaaggtggcgatgcacggaattgtattggatgtgtgttgtgttttttttacatagggctcggggtctatttatacccgaggaatacaagatatgtccatattgaacacgactcttatctctaacaaactctaagatattgtaagtctttgcggcagacttttgcccgaacatatctctaaggaatttacataaaatatcctaattaatagatacaattgccttctcaggactctatccatgcgtggcaatcatcttgaagcacatcaactcaaacccaatctcgcacacgggtcatattgtcggaatcggctgtattacttaaccagtccaactcagattagccgatcccagtcgtagccgatccggactccagccgattcttactctgtttccgaaaaaacccctatcttcgattctgcttcgatttcatcttcatctccgatactgatattaccaaatttggtcgttaacacaatcaaaagcatgtttggaccttataatttcaattataacttggttttgcatcaattaagtttgacctactaatttgtagttgaagttgtaagaattaacatgctcattgattgtcggtaggggtaatatcgagtttcagctgatcttacctgtataattgttttgctttaagattgcaagttgtctttcgcttaatgtgttatatctgtcatcttatataagtttatcaaacctttaaatctattaaacttgccatcaattccgtgcggtctcagttaggtctgatctattgggattacagcttgttaaatagatttaacctaaattttatattctttaatctaaatttgattatcttcaatcacctaagttacttcaccggctatgatataaatccatataattattaatttgtctgatcttggctatcagcaattaatattgtgtcgattatgtccgatctatcatagttgcttgtatttaagagaaagattaaattagtaattacaagtcatttatctctacagtcgattgtagttatgttgggcctagtttataaatatatgtccatcggctagctatttaggttatataattgtataataaatgacttcaatcttatgctacatcgattaggttcgacctatgagattggtcctgttaaagaaaagctgtttacagttatattcaatctaaagctagtctatgagtagcatcctattcacctatacccgattcattcgtgcatcggctgatacgatactgtaacagccctaaattttgacaactttttaaaaccgatttaattttctttggttctctaaaattataaccgtcgagttagtagtttatttaaaatattattttccatgtttgtttctagtgtttatttcttgtttaattcggttgcaatgtgcatctcaccttccgaacaattctttttgatccaaattcaattctatcccgagtagaaaaccatttaaagcctacaacaattcaaatactatttattttaattttccccatattttctttttctctaattttaccttaattctctttttccatctattttattttcttttctattctttcctttttctttcccctctctctctgttttcttttccttcttctcttctcctgctgcctcgcgccaaacccgtgccgccttgcgcccagctcgtgccagcccacgcatgatgccacacactcgcacgcgcacacacgaggacgaacgacagaagaatgccgccgtgacacctccagtttcccgcctccgtatctccttcgtccctccactaaaaggctcaagacctgtcacaccctaaaaatcctaaatatataaattgttgtttaaatggaattattagaaatgattttaaaagcctagacgagaagatctattttttttaaataataaatcccaatataaaattgggccagataaaattttattaaatactttacttgattctatagttcctagatttttctgggatttatttgagccaagaaagtatttttaataaatggaattgcatttcatgaataatctaaattggaaaaagggttaaaaatctctcttttggctttgggccgaaagtcggcccaaacctctctctctctcctccccggcccaggttggcccgcagccgagcgccgcccgcgcgggcgcgtacgcccgctgacaggtggggcccgcctgttagtcttcgtctacctcgcgccgctgccgcatccgaaccctaaccaagccgcgccgccgtctccttccaaattcggacgcgcctttccttctctggtgaaatcaatagaggggaaatgattcccgggatctcctctacctttttccttttggaatcgatccccaattccgtttggaaatcccgggattcgagttcgattcggatcgatctctctcctccgaaccctaaaccctccatcccgtcgccggtcgccgtgggcccttcgccccggctcccagcccctataaaaggaccccc

SEQ ID NO: 16664 - DNA, 6555 bp, Oryza sativa
gccgtcgtcgtcaagccgaaggtcgccgccgcttcttcctcgacgccgtcgccgtccgttgatcttctgccgctgttttggtcaccggtgagttcgccacgtcgccctctacgtgttggtgtcctccattcgcggcgtcgcgtcgtcgttcgccggcgagcttgcgcgcccgagccgccgccggtgatgacgtcatcaccgatgtcatcggtgccgtccgtcgtagaccggtcgtagaccgttaaatcttggccgttcgttgtggataggatcgatctcggccgttcgtttccgtgagccgccgccgtgcacccgatccaccgcgaaccctaaccgctgacgcaataatttccttttccttttaaaaaataattcattattgcgtcatcattcaattaaaacccatataagtgttttaatccgatttaatctataaaaattcataactaattcatcttagctcggatttagttggttcaagtctctaattttttctaaaattgagatctacatgttaaaaatatccacatgtactgttcatgcttgtttatgtgctgttttggtgattttgctcttttctctttagattccgacgtttccggagagtctgagtttgcaggagaagattttgaagagttccaaggccagcaaggcaagtcacacagatcccaaacaaccctttgagcatgttgatcccatttaaagctattgtttctattcaactattgcatttattttcgaatgtcatggggtggaattaacctattgtttgttatagcccttttgttcttgattactttattccttgataccttgggttattataacttgactagttgagctttatatattggttcagctagatatcagatatgattgcttagccatgcttagaaacattagcacactattgggataacttttgactcactattatttaatgatggcttaatgatagctcatgatggttaatcatgattggttaattaattaatttgccaactaaaacctgataatggtgggttgtgagcacatggttttgatggtcatgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgttttataagggggcgattatgatccaggaacagtgcgctgtggtggattgtgttgtgcgaggggtactgtcacagctcctttccgaggtaccgtggtggtattgaggcgcatggtgacatgtcgtggggctgtgtcttgtgggtatagtggtacatttctggccagtgtaaaactattcgaatagccgtgcccgcggttatggacgggtctaacaatgtctttcgtgattagtctcacacttccaatcataataaaagattctataactggtaataatttgattagctcctggtttggaatggttaattcctggtttggagatagaactgtgcagccgggattggttgttcagaatggttgggcctatgcaacagggtatgttgtataacgttgaattaatattgtttaattatcatttaactgttttattaaattctaaaatatttattaaatgttgtttatgcaaatgggactatactatgccatcctttgttatcctgtgcacttgcatatttgctgcgtggcttgctgagtatgtcatatactcaccttgcaatcattcatcagaggaggagttctacagtgatgttgatggtgtggaagattaggtgtagccctggtcaagctgcctgtggagtggagtcgtctgcgcagtttatcttttttttccgctgcttagatctttattgattgagagcaactatctacctctgtaatgacattttattcgcttattaattagagtgataattgtactctattatcaatttgttattgtgtgcctcggctgattcctggacgagggttcacacacatgtaagcgtttggaattttggatagaaattccgggtgtgacaagaccggaggcaaaagaaccgcaatttcaacctctttcacctcctcgaatccgccccaactcccgcggactcaatcgtcgggggaaaaaatccccgaaaccctaatccggcgccattaaaagaatctccgaaattcgtcgcatacatcgccaaccctctgaaattgatggtaaaaatggaatctccatgatgagtactccctttcccctctcttttccccctcagcccgtcgccggagtgccgccggcgctgcctcccggagtcaccgccctgttcggccgccgccggctgcattgctcgcgctgctccaggccaccctagcttcggccgtcgccaccctgagactcatctcactccattgatgctcaccaggcccgccgcccaccccggagttcgccggagtcgccgccgccgcctccagctcctggccgccgtcgccagcctcgccatcgccgaccacgggaacggagtcgccgcaccctggagaccgcaaaaccggcgcccccttgtccaaaaccagccatcttcaccgccggcgccagggagatgccggccagttcctgtgcagagcgagagaagaaaagaaaattagattatcctattgaaaaataaatcagaaaataccctttttcttttcctattatgttgaccatccgtttgacctcaaaatcaaaatccgagacctgttttaaactcatagaattatcccgaatccatccgtgtcagtttcgttgcaatctgagcaaccgttgacgcgaccctaattttacccctagggttcgtcgttcaccgaaattccaaaaatccctaaaattaaatctttaaaatcctttccacccatcgttgcactttatgataccatttgttatgtttaactttgtttttctattatttattgtgatggtgattgttgcataaatagaaaacgctaacattggtcctacgactacatcgagcccgaaggttgcaagacatgcaccctcccttgaacaatttaatcccagtagttagtgagttattttggtaccgtacttgtcctttggagtatgatagactgcacgaatgcttctaaattatattgctattattgcattatattttctgttgctattatggacacattaaagagccttagagtctaaaacgcttaggataaaatttgaggagcacttaacaaactgttaattatttagcatgctattggtttaatatggatattattatcgcatatgaaaacatgcttatggaattgttaatagctatatgctaagaactgttgacaccgcttgtgagtgggtggtacacatgatagagttcatgtgtttggttttatggacctgtttatggtcgtgttgaatatatggatatatttatggttatttcttatttaaaattgatataataatcagcccccttgtgtcaataagaatgacatagtttcgcccatccacacgatcaatttgtcgaacctagccgtatattgctccaattgattgaacttctataggcctttcggtgtactggccattagatttcaagtgtgaagcaaagtgacatggtttatgtttatatgatttatatatgtgggcttgatgggcccgagagtttagaactgccctatgggcccatgaagttctgggctgtccacccagtaacgaacaatggtaagtggatgcggaggtaggttggtacacacctcggaccggatcactccgagtaacgacccgagcatcctttaacttactaagcagaaaagagagatatatggagcaatattacaccttgttacttttcagcctgtggatatcgtgtgggtaaagctgggcagacgctgcagagtcgtagagtattcgaatacgacgtgctcccagttaatggagatgtgtctatgggtataccagattgtggccacaagttaaactaaatggctattaattaatatggtcaacttatttattacttgatgttctattcaagttatttataagtaacatttatatttttatgcccgttattatttttaagattaaatgttcaatagtgttgtttatatcaaatgataattaagataggctctatgaaataattgttaaggttagggtttaaaccttcctgctcttaatatggcatgttttatattgcaattattgtatttgctatcataagcatgtcttgttgagtaccttttgtattcataaatgggttcagatcatgaggaggaagatgcttgtggagatcccgttgacttgttagatgggacagctatggtttctaggtcattctatgatcaggcagttcctgtggtggagtctagtagtttatctgtttgtagaaataaggatttataggccatatatgtaatggtttgtatttatgttgtgttgtgaactaagtgacttaagtaatgtataatcgaagtttatgcttttatatcatttcatgcataattgaacatcctaggcggttacgtattcgtgggggcaccatgactttatcgggtgtccccacagatacaacatcagctgattggctatcatcttctaatgtttgctatagtctatcttattggtagcaggatcaaatcaactggcatgccctgaacctgaagctttggacctacactgaagttaagcaaatcttcgaggccatcgtgttttcgcatcaacagatactcatgatccaagataggtctgaaaggttgaaagctaaccttccaaagagtggatggaaacatttaaatacttgacctaccgcgaaattagtcattactcacatatttgaatatcataggttttgattagattgatcagaactttaatccacacttcgcatattgtgagaaaggggattgaaacttccgatcaatcctctgtcctggcgaggagcactgatcagaacttccaatgatctccaccgggactttccatcgtccctccacaataggcatagagctatgattggagattccaatttcaactatcagaagttccaatatggaagctataagaaccccatctttcccatgtgggtgttgcgcaacgtctctctctaaagatcaaagtaacattgagcagacacaaaagtcagcgttgactcgaacacctctccatagtgtggcatttcctatgactcgaatttcaaaataaaaaataatgtaaatgccttgagagttttaaccttgctttcatttgtaggggtcgtcatgcattatcaatatcacaatagggactaatacaatccaaaactcattagagacttagatatactttcacccatatcttttagtatactacataatccataacacaactatctcagtgtgctacacatgctctagaacaatcttcaaagatatttaagaataataaaagtctaaaacctcccaaaaatatcatacaacctataagccagtataaatatatccaataggtagcggcatatgcattattttagccggtgtggttataacatagctatatcatactacattaaaagatgcaagtggggtgggcaagcttattttttttcgcttatcacaattctataaattagcaagtgggaataaatgtggtttttatacgtgtagcgggatttcccacttatatcgctactactagggctagtgtgataaatcagtgacaatcaattgatatttagatagattgacgctaaatacatgcataaatcatttgagcggaatgtcaggtagacaaaaagtcaatacgtcgtgcctacataatacaaacatctgacactgctaacaatgatcctgaaaaaaacgaccttaatcatatattagcaacacaaccccaccagccacacctataaatgtaactcgacggctaatccaagcatgacgaacaatacgatattaatttttaatgttgctttcatttgtagatgtcgttatacattatcagaatcacaatagggactaatacattcacttatcctcaataaacctatcaatccattaattggtcttgtcgtcaacaatccaaaactcattagagacctatatgtacttttacccatatctgttagtgtactctattaatccataacacaactaagatatactcctcagtgtgctagacatgctctctagaaccctcttcaaagatatttaagaataatataagtctagaacctcccaaaaatatcatgcaacctataagccaatataaatatatccagtaggtagcggcatatgcatttttttagccggtgtggttataacatagctataccatactacattaaaagatgtaagtgggtgggcaagcttatttcttccgcttatcacaattctataaattagcaagtggggataaatatggattttatgcgtgtggcggaatttcccccttatattgctactactagggcagtgtgataaatcactgacaatcaagtgatacttagataggttgatgctaaatacatgtctaaatcatttgagcggaatgtc

SEQ ID NO: 16665 - DNA, 313 bp, Oryza sativa
actgttgtcggtgtgcactctgccaaatttgataatgaaaaagatcttgaagccatcagaaatgctgttctgcgctacaacattactcatccggtaatacagctgtgataacttgtgaaatgttgaaatgagaaacatagattcctgtgctcctccctggcatagactttcatgtctattgcttttttgtggtgttcttaactttttaaagctatggtctttcttaaggttgtaaatgatggggacatgtacttgtggagagaactgggggtgaactcttggcctacatttgttgtgattgggcccaacggga

SEQ ID NO: 16666 - DNA, 108 bp, Oryza sativa
ttttgatgagagtgtatttcctttttctaaattgcatgacaatgctggcgcacgtattcgtcatgagatctctcttttgccctctgatctcttattcacacgtctcat

SEQ ID NO: 16667 - DNA, 491 bp, Oryza sativa
ccctatagtactttgtaagataaatctactaaataatttaatcttatttttatccaaaactccaaaaatcatgaaacggggagtatagaacaaaatgaaaccgcgtccaaattgcaaaggcgtaaatcacccccgccgtgtctgaccgtttcgcttcggtgcggctcccactaccgcctcctcctccttgtcctcacctctctcactctcctcccttcacttcccaaccaaagcgagctccattaatggcgcctcccctaatctagccgccgtactcgcctccttcccttccgagaccacgcgcgaactgccccatgacactccctcctcctcctcctcctacttaactaggaaatcttcgcgcgccagctgatcgtataccacgtacgtacacatgggctaccaccagcccgtacacagcggcgccgcggccggtgccggcgggagtggcggcggtggcggcggcgaccacctgcatcaccatcaccacc

SEQ ID NO: 16668 - DNA, 3484 bp, Oryza sativa
gtagttcatcatatagaatactcaagcttgtaagctttctacaatgtgcaattgatgcaagcaaaattgtgcgggtgttattattacgcactatataatttagctgacaaaccatatggcgacatgaagttttgtttgacatacctgacagcatggcagatattgaaaggatctcatttgaacagttgtattttggactgatgacaagcatctttgacatctggggatctagaggaaattcactcattgtttcacctaaaggcgtgaggtttccatcatcatcaagtgcccctaagtagttcaaaacttccaaggccctcatcaaagtttctggtgcaggaggatccataaagtcaaaatgcactaaatcatcaattccaagcttcttcaaggtaagaaccgtattcgccagatttgacctaagaatttctgggtatgtctgtggctgtaaatcatcgttaaaactcttctctgtatataacctgaaacacttcccacgttgcgttcttccagcacgaccagctctctgatgtgcacttgcctttgaaattggcgacaccagaagggactccacccttatccttggattgtaaaccttctgtttggaaaaccctgagtctatcacatacactataccatctatggttagggatgtctcaccaatatttgtggacacaacaattttccttccagctgggcctccctctctggatggggctggagcaggttcaaaaatcttctgctgcattgctggaggcagcgtagaatacaaaggcacaactttaactgggccaacctgatcccccatgttattaatttccttatttatcttccgacaggcatcctcaatctcctcctctccagtaaggaaaacaaggatatctccagcaggttcacacatatgtatctgaacaactgtcctgatagcagcttccaggtagtccctttctggttcttgtgtatagaagatctcaaccggatgaagtctcccaggcaccttcatcaacggtgcaccactgaaataggtctgaaatttctcagcctcaagggtagcactcataacaacaagcttcaaatcaggtctgttctttagaacctccttcagaagcccaaacagaacatctgttgctaatgtccgctcatgggcctcatcaagaacaatcaccttgtacctctctaaaagtgggtctgccatagcttctctcagaagcataccatctgtcaaatatctgataggaagcaatagtgttcaacacaacatgattagatcagaatacctaaaaaagaaagaaacatccgcaccatatcaatctgccaaaggatgtgcaactaatcatgttcttccattaaacataaacaaactaaggcttacttgagaactgttttgtgactgctgcaatcctcaaaacggatgctgtaaccaacttcctccccgatagtaacatccatctcctccgcaacacgccgggaaactgacatagctgccaccctccgcggctgggtgcaagcaaccatcgagcggctgctcaaaccttcatcctctagcacgaattggggaatctgatcaacacaaaacgaattaatccccaagaacaaatcatcaataaggcacccatatagcaaccaaaaaccttgacacagcgtcacacatcaatacataaacaaaatctaaccaatttaccatagctccatgccactagtatctaggggaaaaatatcccctaatcatataacacaatatcatcacatctcaatacacaaacaaaacctaaccaataacgatcccctaataaacaaccaataacgacaaacctaaaatacttttacagttcaatgttgagatgtacaggcacagggacagattcaatacctgagtggtcttgccgcttccggtttctccgacgaggatgagggtctggttgtcgcggaggacggcgaggaaatcgtccttctgctgccacacgggtagcgtgcggcgcttctcgaggatctcgaggtacctcgccgagtagggcctccccgtccaccgattgatggacgggttggccgcggcggcggcggccgagccgttggtggtggcggcgcggccgagcttggcggagacggaggtctcgtcgaccacgtcgaagaggctcaccttgcgcttccgctccgtccccatcgcggctgcggctgcggcggcggcggcgaagtgggggtcgggtcggttcgcgcggtgcggaggaggaggaggcggggcgggggaggcgaaaccctagctcggctctgttggggtcgccagatttatatttgggaattgcgcgattggaagtcggtttggaaggggcgaaccgcgaacgggcttcttttccgttaaccggttcagaaggcgtatttccttttactcagtatacgtgttgtagtcatattctacatttctacctggctctttacgtggagtccggtataaactcgtatatagttggggttaaggcaagcacaatgttagctgccgacttcggcaatactgtgggctaagaggtcagacggtattaaaccatcgcacccttcacattgtttatgcgcgttggagaggaataagatgggcccagctaaaaaaaaatcaccgatagtaaaattcccgtgactgctgcatgactccttcccacgagttctgtcagaaacactgtacaaataatattgtttatctcttgttcatcggtagtagctgtatgaccaggttttaactctttgccactctcacaatgcttcctaccgggtaggaagagagcatgtattgcttattaccggctaaaaagcaacaatgtggatgcccttataaaaagttagctcgattttttaatatttttttagcaaatccatctatttcactcatataagattgaaaaagatagtaaagtttagtttagctctatcttcaattctaactctaaggaacaagaatcaagagttaaactgttgctaaatagacattaaggcaataatatatatctaggtttttttatttatttttttctattgaatttttaagatttttaaaatgatatttttctttacaattacggttcgattgtaacttgtaagaaataataataataataataataataataataataataataataataatagagtaaagtccgtcacctgtccctaaacttatactgctgtgtcatctcggtacctaaactcgcaaatcgatcgtttagattctcaaacttgttcgattgtatcatctcgatccctaaacttgcagattactcgtttaggtcctccaacttgttcagttgtgtcaccccggtccctaaacttgaatttgaatatcatctgggtcaaataggacgatctaaatactttatatttaaaaataattcataactttttcatgtgaactctaataaagacaaactttatatcaaacttgtagccctcgacgcgatctacaactttgttgttgaatttttttttattttaagtaatt

SEQ ID NO: 16669 - DNA, 727 bp, Oryza sativa
agtgatctgcaagtttagggattgggatgacacagtcaaacaagtttgaggacctgaacggtcgatttgcgagtttagggaccgggatgacccaacgctacaagtttagggaccggtgatagattttactcataacaacaacagcagcagctctatgtagggaaataaaaaagggagacaagagttctcctaactaaatagccacggtttgattcctctgaaggcttcaattcctttttacttcacattctctataatgtatacatgaaaatataattgcaaaattaaatggtttcgaaggtgaaatgggatggaaaaaggcaccaatttaggagtttcgcaagatggcttggtctctttctttgctgttacatttatatggttttgtttagcaaatgggattgggacccacactccaaagggcaatattgcatcctagccattcattcttcacacatcatttaatcctagccactcatccatttccctttcccaatcccatctcctatattctatttgccaaacacaccctatatgtactttacactcttggcagaatgaaaaactttaagggcaccatcggaatgcaaatatttgacactagaagatctacaaacacacagaagtcctacaaaatacattcatgtcccactggaaaatttcaattgtattacatgtcatgtgaaaaggaaaacttcttgaccagtatatctatgatattcatatc

SEQ ID NO: 16670 - DNA, 5595 bp, Oryza sativa
tcaaaactattgtttacaaactaaaaatatgaatattagggaatgacataatatcaaataattaaaaagagtagggctttgaacccaagtcgactagcccaccatcttttgaagctagcgggaagatccctgagtgtttttcattgtatacaaaccacactgtatatatgaaaacaaaagctaacaattgtatatgatatccaattatgtttttttttcaaaatacattataaaaaatatacttgtatttattaaaatagaagctaagagttgtatatcaaattcaattttacttttatatagctttgcaaaaaatttgcataaaaaatcactagatgtcataatatggaccatcacgatataagggggtgttcagaaggttacggctgcacaacccaacgtttatatgatgcttgcgacaccgttggcgttgggctacaccccaaccgcagctcaagctaccgaatagctcaagttggcctaagtgtgcatcttctttctttgtctaattcgattaatatggtaattttcagatcttcatgataaacatgttccgccccaggaataagctaaacgtcatatttgcaaacgataaataattgtgaataaaacttttatttacgtgttcttagtgacctaaaagcaaaggttgaaaaataaacttcgatgaaaaacctcaaaatcagcttcaaatttaatgttgaaaatttaaattttggttgataagcataaacataagcgaaaagatgggaccaattgtattcaaacctcgctcgatagtgcataatattggagcaaatgaggacacacctgaatcataacaggttaattaactaaatcgaaaatgagcacagtcacaactttataattatgctttttaattaagagttaaatcccatttatttattcattttaaatttataaattattgaattgggggaaaaagttgactccaaagccgagtacctaattatgatctttttaaaatccactcttaacgcttttttcggtaactttcttttttaaaagtactaattatattgatttttgaaattgttgatgagattaaattatttttgttcttagtacctaattataaaatttgcatatatgcaaggccaatagagaaagcatttgatattccacattcattccgttggattcgtaattagaacagatcacgcctaaaaatacatgtacatcttccttgtttgcttcatactaagatttcggttgttcaagctttcggtcgattgaacaaacagatattgtccgctctctttacacactcgcaccctcttgccaccctgaaccaaccggtggacaccgatctgaaaaagtccaaacctggtggacctcataattagctggttactcccagtgtcacacatgcaaaatggatagaccatagggatataaaaaaaattacaagaaatgggacgagcaaaattacacttatttaactaacacacacagcagcagcacagagaagagaaaaaaactcggaaaatccaaaaggatcacaggactaatgggagcaccatcagtgttggcatttgcacatgccaccaccccctttatattccccaacctcccaactcccctcctcccccattccttccatccatctcaccacccctctcctcctctgcacagcaaccaggtgtatgctccatgaggaggagggaatcttgagaggtcacagatatcctgatcctgctgttttttggtggtctctgtgctgtaagttgggtttgtggcaagaattctttgctgcgcgaggcaatggcgtccacctcgggctcggcggcggcggtggaggagagggggaatagtgagcggaagaggaagcgtggcgcgacgggggagtcggaggggtccgaggcgcagccttccaagtggcggacgcggcgggcgcacgagatctactcgtcgaagctcctcgacgccatccgcctcgtgcgttccgggtcgccctcctcctcggcggcggccccgccgcgcagccgggccgtgcgcgaggcggccgaccgcgcgctcgccgtctcggcgcgcgggcggacgcgctggagccgcgccatcctcgcgtcccaccgccgccgcatccaggccgcgcgccgcgcgcgcctccgcgaggccatctccccgccgtcgcgccacccatcctcgtcgtccggtaaagggccgaaggccccagctctggcgaggaaggcgaaggtgctcgggcggctggtgcccggctgccgcaagctcccattcccggctctcctcgccgaggcctccgactacatcgccgcgctggagatgcaggtgcgcgccatgaccgcgctcgccgaggtcctttccaccgtctccggctcaggctcagcctcctcctccggcggctcctcttcgccggcgtgacccccaagcctcaagattcgtgcattcgttgtaaatttgttttttctttctttcattttttccttgggattagttagcctcgagctgtctgctctctagtttgtcctcttcttttccatgagctgggtgagcggttatggcggtggtggtgatggcattgcggtgattaacccgcgctgtaatgcagtaggccacatttgttttgttctcttctttctcctcaggattcttttgtaggatgcctcgtttgttcttcttccatctctgataaatgcaccatgaatggttcacatcacttctctaccactgtgttttctctcgtgcgcccagtgcgtggggatgaatgtctttcctcctcctgtcgacgaaaggcctaattaaccatcttgttactgtatctaatactgtcttcagtgtggttcaagttatatgccatcatctcctaatcatacttactgctctcgtgaaggacagaggcatggtcgcatggagaaaggacgataaagcaatgaattctctgctacatctcggtaaaagggaacggagtatcccaaatgtggatcccaagcctgtagtagtctctctcaaactacaattaacggtactaaattagtggagtatactactactgctaactttacgaaatgccaacgcaaggaagtaggcctctcgtgtttgcagtttgcttcatctcgagctgaggcaggagtaacatggaacgggaaatgtggcgatggattcagtggcacgtggccgatctgatctgaacggcgcgccgggttaaaaacccgcgggccccacggtgcagccacgaaccgtgggtccggctccggccagccggacgcggccgtccttcgcacgcggtaaattttttttttttaaaaaaaacatccctcgtctctcatctgcacggtgcggatgagggcacggccgtgccttttctttttcttcaccgtcgttgtaatttatcatcggggcagcgtgggtaggggaaagtacggcgctgcccccgcgctacgcgacactggccgggagcagcgctggtgctccgtcgcgcgagcgcggcaggcgtgcgggcgggcgaggccaccggtggtggttcggtcggtcggacgccataggctaatgcctagctgtctcataatgaagggcagggcccacctgtaagccagggctcctcctccgggccgacggggggaggcgtccacgtggtccgtacggggttgggcagggggatggatggacggtggtgatgtggcgggcatgattggctggctggccccgtcgccatccgcattcaggtgtggggggttgtgtgtgcggtgtgccgctgcaatgctaggctgtgccgtgcctgcccgggctacgtgacaaaccgtatgtatgtatgtactgatggtgtacagtggtagtatgcgcgatttgtattttgtatcatgggcgcgcgcccctgtgcgcctctctgtccttctcgtctcctgtatgaagcgacccggcgatctgcgagatgctccggtccctgccgtgtcgtgccatccgtttacctgtttcctgacctgaatcatatcctgacctctacgttgggtaccgcctatcgctgcaaattgttactactatacctgcatgcggcgtcatccaaccaccgagcagttttcagcccgacagtgagggtagtgctatattgaacttggcaatttctccttttttaatttttttttgctttgcccactgttttgtttagctgattaactgagatatacccttccatcacaaaatgcatgtcgtcttttaaatagggttttggataaaacctttttgagtaaacgtccaattgtacctaaacctaacctcgatatctctatctcaaaaaggaaaatgagctcaagatcaactcgtactttatctaaaaaactgaacttacccaacgacagaagctaggagctcctaattaggggctgatcctgagtcagggcagccgtgattctcacataatctgcaacggccaggggcagcggtaaccggggcccctggattgttttcttccgagtgacggttgggcccccgacgcatgagtccacgacgcaacgtgccatgtgggatgcccataaaaaacgtggggtcccgtccagttctacgttcccgcccttttttcgtcgggtcggagtggcgatgtgtggcatggcatgggtgtggacgtgtggtggcgtggcatcgcgccgcttttactttcgtccgctttctccgtcgctgcaggtggggtcgccatccccctattagctgtttctctctgtgtttttcttttttctcttcctaaacggaacaggaaacggaaaccgtgaagcagcccagcacgtgggtgtataattttttgccgggcccaccgatgggccagctataaaacgtccggtgctctggcagcttttgcgagtgacgtggccgcctcacctgatctcctctcgttggcgtcactgggatcgggcgccgagatctcctctcctgatctctgggcgctgaaacgaacgggcagatcaggcgcgcggccgtactggaatctcaccggctcgtcgccggtgacctggagcaggttgttcagggcgtggtggtattaattggggtggaattatggtcttcgcctaatcccttcctctgttgtcgtctcgggctttgtccagaccagattcagccacgcaatctgtgttcggatttatatgtctctcgcattcatcaaatgcggttgcaggtgctcgcccataagaccataataagtactatacgtacgtacgtacagtcgagacggtccatacctcagtcgcaaagccagatgcgtcggccatgcgtatgtaagctgtcggtcatatagttttggtatgtgtatgcatgtacgtgccctgtgccccacccgtgtccgtccgccgatctctgagacgtagttaatttctgttgcgcgtcgcgtgcatccttgatgattcctaattaactgagctgttgcgaagccacggcgcgtgttgctttcgcacgcacgttggatgttggcgacccgccgcaagggggccggccggggcaggcaggcacgcgcatgaaagcgggtacaggcgcaatcattggtgttcgccggcgagagcgaccacacatggacacggccgggcgtacgtcgcgcaggtcgatcggttttactacatcctccagctctct

SEQ ID NO: 16671 - DNA, 4795 bp, Oryza sativa
aaatattgaaggaagttaaaaaataaagcctgctaattagctccaggacatcaccagcaggttctatatcttcagtgaaaggtgttgttttaagaaaacttgactgaatcaacaattaatcatgggacaattataacacatatataaggtagtacagaacactaattatgatagcatgtaactatagtcatgtaatcaaaacaatcataagacataaggtacttgcctctgcagcattgataactggcaattggacatatgggaaatcaactaacatcccgttaaatttaaagcgcatcaatggaaccttagcattttcaatagaatgcaggtctgatacttctggcctctcttcaagcatttgtcgcaagacaatgaaaaaatggtgctatacaataacacacatacacactgagttaatttcgaaagctccaagctagtggacaaagggaaaactgaaagagatattcacctgtaacgatgcaatacaagggccaacacagactgcgtctatatcagattcaggtccatatgccttcaaagcagaacattttaggcaacgcttgtcacaataagatatattaaaaatctcaaaggggaattcctagttacgaggcaatgttatagacaagcaaaacaaagttaaaatactactattaacccagtctattttatcaacatgtaataaaagattaaccgagccaagattgtatgcataagtatatttccatccttaaaactctgcacaatgtcaacaatacaaatggatatttagtgagttctctaattccctgatttgcctaccatcagtctttcaagcatggatttaaacatcttacatgttatttacatgtagaatattgtccatgggaacagatgtcaagatttaatctttctatgtattccttaaccatataatcttatgtcaaatcaacaaacaccacattaagttgactatgcacaagcacaactaagaacatatgatctatccattcagaaactttattcgcttacactcactagtcactatggcatattctggctcatcaatccagaataaatcattaagtcaccaagaggcttagaaaaagaacaatgagcaagccaaagaaccaagtttctccttttttttctctctctctctctcaggttctggtcatcttctttagcacacaaaaactagagcagtaaattgtttccactcaaaaaaatgattgaaagattgtttgagctcacaaataaacatgctctgctaaaattaacatggcatacatgtaattccaaatattaaaacaacgagctatgtctagctcgtggcttctcctgtagcagctctaaaatgctcataaccaagagcagtggctgaaaatgactgggcaattgacgaattaatggtaacacttttaggttcaaaatgagcacaacatatgacagataactaaatgcattgcaaaataattatatcactccaacagtatacactataaaatcaatcggacattgcatcaacacaaaaaaaaaatcccagaaattgtgcacaaatcgaacatttcttgtttacccccaaagcatacgacccaaaggtcaacaccgtagctgttgtgttccaatattgttccctctggtcgtacgccaccctcttcgcccaacccatcactatctgcaaaaaccaccatcggatcaaggctctcagaccagtcagcatcgcaaactttaacctttaagctccgaaacccgaacgatcattaccttatcgagctcccgcaccaccacttgcctcttcaactcctcctccggcgagggcaaaacccccgtacgagaaatgaactaaacctcgtaaaaaaaaacaagaagatccccccaaaattagccacgagatcaaacaccataggaccatacgatgaagcgtacgaagcttaaacgcccccggtgctcacgttgaggagggatttgctccggaaagcgtcagtccgctcggcggccgcgggatcgagcccgcagatgatcaggtgctgcgggagccacggcgggggcggcgggaccccccggagatacatcaccgggaccgggggcatcggcgggggcggcggcgggcccatgggtggtggtggcgccacggggaaacccggtcgggccctggacgccatccgggtggccgacgaggccgactgcctgccgccgcggctgctgcgggacattgcccggggccggcgaggccacgccggtccgcgtcgccgcgcgcggtggtgttggccgcggccggggggacgtcgagagaaccccccgcgttttcagttgtttcgaggcagaaaaaaaaaggctcgaggcctcgagggggttttgagttgagaggttgtgtattggggggagttgggaaggggaaaatgggggagaaaagagtcgaggcagggcggaggagaagagagaagacggtgtggcaacgacaggagacgggggggtttatatagcgggggttggtggtgccaacggacacgggggttttgcgctgtgtttgccgtgtgcgatgggtggagggggggcgagcgcgagccgctgacgtggtggagcaccggtagggggcgtagggtacgcgtgacccggcatgggtacaaacggcaacagctgctgacaaaaaaaaaatgatgtttatggaactattctgcaagccggctgcagactactccctccgtactcataaagaaaattgtttaggacaatgtttaagtcaaaccttgaaaatataaatcatgaataactctcaagatgttgagtttgaaaatataaaaattatatgaatagatttgtcttgaaaaatgctttcataaaagtatacatatatcactttttaataaatatttttatataaacaagaagtcaaagttatgttttggagaccgtgtcgctgtcataaacgactctctttataagtacgaagaaagtatactcctgcatacggcactgttggtgtcaccgaataggtcctatctcaacaaaattgctactctaggatggttgtagttttttaaacttctaagatagtagtatgggtcgattttagctcaccatattcttatgtatgtgctagatagtgctactataaaaaaattgattgtagcgagagaagttaatagtatcatagtatagtcctgcttttcgtgccacaaatatcataactcctcatgtaaaacattataagtatttttcgtgccgaaacttgaatggaaacaacgattatattgttttattgtaaatgcaccattataatccgtgattagattcgtgcttttggtacacgctattctataacctggagaaggattgatcgactgaaagtaggattaaagccaaggtaaaatggtgagaaagaaaatattgtcattgtgtaattattccttcatgagaataatgagttgcattcttttatgatattgaatgactgctatctgtaatctgtggctatagtttaaaaaagggcgcttgataaatgtagccatttatgtccatatagattgcagttactcatgatgaagacgaagatatgcataattaattcatttatgaaaaaagatatgcataagtttttatgtacaaatgatacgcggattaatttggagagagagaacgatttgtcacttaataagtgtagtcatttaatgtagtcatttatgttcagatatgcttatgtttatcaatgactgctatctagagtcaaagttatacaaaagggcacttgataaatgtagtcgtttacgtagagatagatgttactcaatgtagatgaagatatgaataactaaaccatttatgaaaatatacacataaatctttgatatacgaaatgagatacaagagttatatgggatatatatagagaaccatttctcactttataaatgtagttgtttacttccagatgctttagtgtttatccattgggtatacgaagatacaaattaatctgaccatgaaaaggtacatttctaatcttgatatacacaatgaggtacacaaattaatatgacatattgaaccacagctcacaaaaatgttacaattatttccactatgtcgtccataaaaaaccagtacattgatccgtgacatttaaagaagtgatttagatccttataaagaataataaagatttaatcttgggataaagaacagcaaaaaagaagtaaatgtaggacaatgataaactacctaacttgaacattatctaggcttgtgggctcatcccaaagaaatgaactactgaaaacattcacagtgcacttaagtagttaatgatgtgttcggaggtgggggttgggaacccatctcctatgcacggaaaacggagcggttcattagcacgtgattaattgagtattaactatttttttcaaaaacggatcaatatgatttttctaagcaactttcgtatataaactttttgaaaaaaactcaccatttagtagtttgaaaaacgtgcgcgcaaaaaatgagagaggagagttaggaaaatagagtaccaaacacagcctaaggagagaggagtggaggcgagtggcttccacatgaagcttgtgcccctttgcaaggaatgagtgcctcacctagaaaaggctcctgctatgtagagccactcaaggggagccgcattggttgatcttgtcacctcgctacatactgcaacggtccctcattagcacgtcaagctgctctgttgtcgttgttagggtcttcaccaccatgggccacgcaaaccatcactacatacaaaattttcgttgagaccgtttgttctaagcag

SEQ ID NO: 16672 - DNA, 1801 bp, Oryza sativa
accccctcaactattataaaagcacaaattatccctcttaactccaataccatacattttatattctcaatttttcaaactagacaaaataccgccttaacctagcgaggaacaatatttttgtcctacttgacatacaagaggcaaccccatcaaaaaaacaaattaaaaaaatggttgaacccacgtgtcaatggtcgcctcatcttgatgcactcttcctctcttcgtcacttctctcccatctgccaaccaccggcgaatttgcctcctctccactgcccacgagcagtagcaaaggcgagctcgagctccaacaccgcatccgcctcctctgcagagatccatctccaccatgtgtgtttctaggagctttagcaccgcagcatctcatcacctcttctctttctccctttttgactggagcggtagggtgcggatcaattaaagctagtggcagtgtgggccaatgtggagctttaggcagggtctagtgaggtggaggatgaagtgacatcgacttcttccccctttatcttatctccttccttcacctcatctcgagcttagatatcgctggctgcctagcacatggataccaaaaggagatgcatggttgtggctggctggctcaacaagggcaaaaacaactaacgtggatcgctggtcatggagtgcccggtgagctaggcgttggagctgagaaagggaaaggcacttacaatttagtcccaccattttttaaaaatgttgtttgactggattgctacttcagtgccaaaaccgcttgagaacaggaagggggcgccatgtgtccggattaaatactataggaggtcatttgtacttttgaaatcgtgaatgccctaaaagaaggaataagttcaccggaggtccctcaactcaacagcaagatttttcgaggtcccttaaccacaaaaccagaaatgtctacccctaaactcactcaaaccattcaccggaggtccctcggcagtattttcgcctgattttgctgacgtggcatcctagtcagcaaaaaaaaattaaaaaaacacgtggggctccacatttttttcttctcttttcttcttctctcctcttctccttcaggctgtgggcggaggaggagcagccgcgcgccgtggccgccgtcgtcgtcggctctccaccgtcgttgtcgccgtgagcgaggctacgcggcgcggccgtccggcggcgaagcagaggcagcggagcgcggcggcggagcggagcagccgcgcgccgtggccgccctcgtcgtcgtctctccaccgtcgtcgtcgccgtgggcgaggcctagagttacatgcatatatgcattcattcatgaatatatacatatacactttcaacccgtgcagcctgcaaatcaatcacaagctgcttttgctttggtctttttctctctattgcatgcatgtatccctcacttgagaacccatagctatcatgcatgcgttcacgggcttttggcctttcttctctcgtgcgcggagggacgccattgccgccgacaagctcgcgagtgaagctcggccggctctctctcctctctggcgagaagagcgccaaggccgccctgcccgacgacgacgattacgagccccctgcgccgccgctcccacccggggacggcgacgacgatgaggagcccatcaacctcgtcttcaagggcggagatgaggccagcgggagagggggtggcgctccgcatcggcgaagaggtcgccgccgaccgcctgccgccgctccgcagccacacttgccccccctcccc

SEQ ID NO: 16673 - DNA, 2939 bp, Oryza sativa
tgagagcatgacgagcgccgccgctccgctgccactctcacccgctgccctgcccgccgctcccggcgtcccagccgcctctctccccctctcccgccaccgctggcgcactcgctccacgccgaccgccgacgcgcccacttcctctcccctctctcgcttattccccgcgcgccgctgtgcccgcaccgccgcctgtcgccacgccctcatctgcccggccgcctcactgaagaaaacgagaaaagaaaatgtgcagctgacatacatgtgggtcccatgtactttttaatttttttttgctgactaggatgccacgtcagcaaaaccgggcaaaaatactgccgagggacctccggtgaacggtttgagggagtttaggggtacacatttctggttttgtggttaagggatcacaaaaaatctcgctgttaagttgagggaccccctggtgaacttattccctaaaagaatgattgggctggtgattgggctcaggcaaggtgattgggctgggctgagaaagtccgggacagaagggaaatgtgccttggaagaaaagaacggtcatggtggcgcggtggcatcgcccacttgttgggggtgttggaatctatcggttcgccacttcgccgtccatctcccccggaaaaatttccccctccccttaaaccctacgaatcatttcctatccatctcctccgccctcctttcttctccggccgcgcgccgcacggcccacctgcagccacccagcaaagccgccgcgcgcgtccttctcgctctagggttttcccacacgacaaccccccaagcatgtcggcgccgccgttgctgaaggctccggccgccgccgccgcctccctcgtcgcggcggccgcggcccaccgcgctacggccgccgccgccgccccgtccggtgcgtcccgcgtcccgccgcgacgcttgcgctgctctgcatcaggcgccgccgccgtcgaggtgagcagagactcttcccgtgcaaactctgaactcccgcttgagtagttgtcgttccttacgggggggggggggggggtctgtttggttaggtgcgtgctccgatggattgggcgacgaggtcgctggaggagatgcagcgggcagaggacttcgactctttctgcctgatggggctttcgccgctggatgggcggtacgagcgctttaccagggacctgaaacccttcttcagtgagttcggcctcatcagataccgggtcatcgttgaggtatcatttatttggattcctttgcactcgtatcatttgtagtgtatttcatcatttcctcacataaactaggatgcttgattcatgtgttaaatacagaaactggggcatgatgctagtgttataatcaatgttgcttatctgaagtgacttctggctctgtaggtaaagtggctactgaaactctcccaaatccctgagatcaatgaggtgcctccattcagcaaggaggcccagttattcctggatgcgattatccaggatttcagtgttgctgatgcaaaagaagtgaaaaagattgagaaaacaaccaaccatgatgtgaaggctgttgagtactttctcaagcaaaaatgcagctcaaatccagagattgcaaaggtatgtcagccttctgtgtgaaccaatacatgaacatactattacttcgttgctagctgttgagtgtatctttgtccccaggtgttggagttcttccatcttggatgtacttctgaagatatcaccaacttgtcacatgcattagctctaaaagagggggtaaatacagttatgttccctgttatgatggacatatgcaaagcaatgtgctccttggcaacacaaaattcaaccatccctatgctgtcgcgaactcatggacaggtacgagaaccacctctgaagtatactcagtaatatatgcttgtactgtcgtacatatgtacacagagtcactgtaatcgatgctatatgcttagaagttataacgctagcttagatttccactttcctgcttgtagccagcatcgccaacaactctgggaaaagagatggcgaattttgcggccagattgtcaagcataggaaatagtttttctgaggtcaagatactagggaaattcgctggagctgtcggaaattacaacgctgatgttgttgcatatccagaagttgactggcctaaggttgcagaagattttgtcaaatcgttgggcttggagttcaatccttatgttacccaggtggtttatattcattattttgatatccagttgtttcatttgtattcccagttcagtgctttattggagttattattcttgaactatggtggtgtggagaatttcctattaatacactttccatttatctaactgcgctgtaaattctaaagtcatatgatactctttggtctgacgcagttttaacttttttttacagattgagccacatgactatatctcgaagctcttcaatctatttgttcagtttaacaatgtcttgactgatttcgatagagacatgtggacctatatatcactaggctacttcaagcaggtaatactaacatgcaaggactgttctttaaggtttggttgaattcgtttagtacatagtgggaaaaacttagtggtctacagttttagattctgtttgaacttactgcatccttccaaatgttgttccagatagtaaaggctggtgaagttggatcttccacaatgcctcacaaagtcaatcccattgatttcgaaaatagtgacggcaatttgactatagccaatggtacattgtcttctttaagcatgaagctaccaatttctcggatgcaggtataatactgtctgtactcttcaatttccacttttactatctccagttgtgaaaaaggggtagtacatcatccattgttgatgcacatgc

SEQ ID NO: 16674 - DNA, 4167 bp, Oryza sativa
aacaaatgtgtacattcatggacaaatgttttcccccggaatgtgtgatggaattttcagtatattttgcattgtgctactcctacatgataacatgttgtagtacgcaattaaccttgttctgcttcgtggtttggaacattggatattctcctgtgtaccgtggagcaaataaggtcgcgaccagctcggatttatctcaaaactgcagtgggtatgaaaccagaccagctcgcgcgatccacgaccctttttttttttttttgaaaactctccacgtctaaatccgattgactctttgtttcttcatagtagtgtcatgaacagtatgtcgtcttatcgggacaaaagcaatgcgggcggccggggccggtgctcatcttaaatgaatgatatcatagctatggactttataattcactgcatacagctcactgcaacaagttgtttcggttttatgtgcatgactgataagaaaatgatcgagtaagtgaataactttgttgccatttatgcatttcatagaaaatgatatactaaagaacatatcagatttaaacaaaaaactagtatacgaaatgtgatatactcttagcttttaattcaataaatatttttctaatatttatataacatattttaaatttaaattggacttgatatataatattagcttatatttttcatcgatgcaattgtattttctacgcaattatttctttaaaaatattattagatttcatatacatttcctgtgactcctttgaaaccaagtatttttcttaggaacttcatccaagaattgaaatcctataaaaatatttcctataaagccctcaaagaattgtatatataggaaggtattccaaaatttcaataggatttcttccattcatccacttggaggattccaaaatttatcaaaggtcgtgttttacatttccttcaaaaagtcgaaggcagcatgtccatatgatgcatctaaacatatcttttaccagattttgtgttttcccccatattgtgttttgcattttttttttatattcctacttttttttccaattttccattccaaagtagcccttaatttttttctagataaaatcataccttctatacaatcataataaaaaaataacatttcaattaatatgaaaatttctagtctcgagagtgaccatgtcaataccttctttttagccatccaagagagcaattcttatgacagtactactgttacatgaccacacatggtgcaaagctcccaccccatgagatatgttcatgcctcctttcaaatggggtaatttcaaagataagaaattcctatatttttttcgttccacaggaatcctcaaacttaggcgggggctttggagagtcaacaacaaattatcaagcgattttcacatttcgcatagtggtagatcagttttgtttcactaaaaactctagtagaagtaaataatcacatagaaacaaaatggatctacatcaggaagttacgtgatctttctttttaaaatacagctcaattaaacactatcattctcctatactgttttttttcttctcaattaaccacaatatttatctaattattcacacctacctttttttcatacacgtctgaacccaaaaatacggatcattgcaagcccctactgtacaattgcactccggattttgagtttttgcttacactatttgaccactcgtcttattaaaaaaaatttaaattattatttattttttgacttactttattataaaaatactttaagcataacttttcgttttttatatttgtacaaattttttaaataagatgagtgatcaaacagtaaaaaaaacttaaaatgcttggacggagggagtacatacactgcggacaccccgtgggtttcgggggttctcctgggctctcctgctgccgtgcacgtagtcggcgctaggcgcagccgcgcaggttagtcgaggtcgacccgtcccctcccccgcggggcccgccgccgtcgtcgtcgattgatggccgcacgccgacagggaggccgctcagtgaggagatgcgctgcatgcagccgcgacgtacgacgtgattgaggtgagagatcgtacgtgctatgctactcctcgatatcgcttcggacgcacggcggtagccgggggcgtgcagcggccaccgggaccggggtagcaagcgggggcttcttctcccggtcaaagggccactcaatcaagccggccgcctttcttttcttctcccttttcattactgcccccctcctcctctcctgccgttgtccagggcttttcgattagttgtttggcacgtgacacgagtttgctcttcttcccggctggatatgcagatcggcggcgattcactgtgtattgcactgcacggttatactatgggaaagcaaaatggtcgtttcatatccctaaatttttacgtaggctatatttagttcacaccaaacttttctccaaatctcaactttccatcacatcacatcacatctaaaactttcctacacacataaactcccaacttttttttccaaactaccaatttttcctaaacttctccccaatttcaaaaactaaacacagccacgaaaacgaaactcagtaaactttagttaaccggaaactgatcatccttaaatttccgataccgcgtttacttacataaataaagttcagggatgaaaagtgtcagatttccaagcttagagataatctttagactttcatggaaaatttagtgttgtaccttttcctatagaaaactaaaatttaagtttgtaatgataaaattttggcaatcaagcaatgttgctacaaattaacctttcggttagcctggttggtaggacagcattgtatttggtctgttaccaacaacaatggcagttatataatttgatattacatgggtttggtttaagaataattattataataaatagccttaccaaattttgattagcgttttcatttagccattatactagtatacatattatatataagagagaatcccttatatgtcactctaaattaactggctctcttatatgccacttcaaattggcttctcccttttatgccaccggttcaagtttctcctcccttttatgccattgccgtcagtccaccgtcagttaaccgttaacttcattgtaaaaatacgcatttgcccttgagaattagtatacaaccaataataggtattttagtactaatatagctactggatacaacatataaaaattgatttttttctgcatcacatgcaattttagccattaccatcacaaataaattttcaatataagcatgaaacatgcagttttccaacaatatttttaatataaagagcatttttcactggttctgacaaaattttgttcactcaaaaagaagtttacacattttttagttgagagggcatattggtcatttacgaaaaaaaactaacctttgactaacagtcaactaacattatagtggtgggagtggcataaaagggtagaaaaacttgaactagtggtatataagggagaagccaattttaagtggcatataaagaaactggtcaaattgtagtggcatataagtaattctctctatatataatatatgaatagtccgaatgacccattcggcacgacccatgctaacatcacaccatatgtatccctatctagtgacgtggttagagatgcgctcatttcctcattttcttttttaatatataggacatacctgcaagttaactaggccacaatatggcatatcttatcaacagctatagaactcgtgtaggcagaaatggtccattcagtgacgtccatgctaacatcatatagaacgttcctctaacactgctatagttgtctcaaaatctaaatattattttttttatttgatcatatactcatgttttgttttcctgtgttcaaaaccgaggataaacatacattataatattattataatattatgtaatcaaaagatgctaagacacacccactcgtgtgtgcaaggacagacccaggctcctgtgttacaataaaatattatcgtgtactttatccatcctaaaataaacaaatttagtacgagatgtgatatattttaataatacgaatctga

SEQ ID NO: 16675 - DNA, 1315 bp, Oryza sativa
accactacgaaattgcaaaaatatcactataactttcatttaagtagcatccttgtaaaattaaaaaaaaatagtggcagatttgtaaatgccctaatttttatgtataaagctttatctataaatcagacatcatgcacatgaaaattgaagtaggagggtgtccacgcgggcgtacacgcacaagcccttcaaaagatacgtttccgtggatccgttgatgaatgtcgtttgtgtagctaataacgggtaggtttaacgcgtggatgttcgtgcgcctaacccctacgaagcactcgttttccatttttgcatttgcgtggtttctttttcatttttaagtttatgaacccaaactcaatgtatatactgtaaactttacaagccgaaactttatacatataaacctacaagtagaaactttatgaaactattatatgtaaaatcacttgattcgaattagaaccagatataaagttttagtatataaaattggggaaagtccattttacaccctcgaacttttaacttgtctaaaatatacccctgaactacgaaaccgggtataatacaccctctgaactgtcaatatttgatatttgacccccttgggctgtttatgatggtttttgcacacgtggatgatacgttggatgccacatcaacccttcgccacgtcagcgcatatgattatatggggcaagcccatattgcttggttgttttgaccttaattttcaggagcggcggcggtagaggcactgcgaaggcagggttgagcggtcagtgccgcgtatctccgacaagcagctgcggtcgtcggcggagaaggtgtcgcaggaaagtagcatatccaagccgctgcgcgcggtcatcggcggaagccgcgcacgacccgcatatatggctaagcagggagcagggaagaagctgctccgacacaagcacgatatagacctcgacctgtctcttgtgacctgtgtgtatgcttctcctgtctgaaaaaaatttgaaaatatactgttcataaatatttttttcataaatataccagatgttggtcgacttacacaaatatactattgaaatcgcgggaggaaagcgcgataccgaggttcgcaagaggattgagagataccgacacggtatcacaatatcaataagcgaaagcgtgacgtcagctccggtatcgcttattggtaagcgataccgatgcagtatcgcttttcccttgagcgagagcaccacgtagagatgacctaatccggtcttgcgatttgggagagagagcacgaatggacccaacggtctcgctg

SEQ ID NO: 16676 - DNA, 1334 bp, Oryza sativa
atggtccttaggcaaacaacaaatataaaatatgaaattaataaatataaaatattaataatgtatagtatattattattaagtaggataataataacagaggtagtttctgttatatgggttagagtcggttcgggtttaaaaattagatagacataattaatttatatggtaaaaaaaattaaattaaagttacaattaatttgtactaattgtaagttacaattaatttgtagctcatgtgattttttattttatatagatggccaatgttgtgtctaacaaatgaaaagtttaaataatggtagttatatttctagtacatatacagaaggtttctcatatatatttactaacgagccttaaaacaaatgttattatcacatgttgttaattcatgcaaatataaaattgtaattaacttaataatcagtacattactgattccgtctggctaatttggaaagcgaagcgcggtctcgcaaatcagacaagcgacagcgctgtcacatcgctcgtgttcggcgcaggggcgagcctgtgctgtgcactatcgcattcccattccgcgagaccgccgcgtggcgctatcgcattcccaccgcgcgagactgcgcggcgctttcgcattaccttcgtgcgagaacgcgcgtcccgtcgttgctttcataggcccgcggcacccgctcgctctcgcacttcccaggcgcgagaccgccgccgctctcacgtttcggcgccgcgaaactggtagcaacgctggccccatcgcactcgctaacgcatactgcgagagtgctgacgctctcgttactccaagccgcgagaccgccggcacttcgtcctcgcttatctaaacagcgataccgctctcgttctcgcacatcccccgtgcgacgccgcgttctcgctaaaccaaaccgcgacagtggtatatttttataaaggaaaagtctatacgtactaaatttttcttacaaaatgtttacaaactctgatttgtcaagctatgagtaaatctagatttcttacaactttcatctagttaaatcaaacggttgagaaatttattagtaaaagttttgtaagaaaattttagtacgtgtaacagtactcttttgtaaatcgtcttatattcagcattttcatgcaaattccacggaaaaaaacgtatatttttaaattatttcctctcctgtctatcacaactactcatactactattagggtgtgtttaaggagagggggattgaggagattgggaagatacgcaaaacgaggtgagtcattagctcatgattaattgagtattaaatattttaaattttaaaaat

SEQ ID NO: 16677 - DNA, 724 bp, Oryza sativa
agaacggagctcgcagaggaggagctagcgggccaccgatgacagagctagctcgtagacgccggtcgcaccgaccacagtctgatggaggcgagcccgctgctcattgagtaaagcttgagcttgcttccgccaagctcagcggatgggtgcgccaaactcgcggtggtcatggcgctcgagctcatccccgcgcatgtatcttcggcgagctccacctctccactcggagctacttcgtccctgcgcctctgccttcgctggagaacgccgcccccattgccgcctccaccaccaccgccgtaggtgctggagctcgatttggttgcggctgtcatcctctgtggcggtggaatgggcattagaggacggtgtttgcaggcggcgaatctgcagctctgtaccgtcgcagcgagtttgtcgatgggtgtgtggcggtcctcgctaggcagagggataagccatgcgcgcatgccgaaggggagagagagtatggggaggagggagaaggagaaccggactgacatgtggggctagctaatctatacaggtggcatcctagtgcacaaaaacagtgtagaaaaccacaccaggtggtcttttgcacggtattaaaagttgtagggggtcagatgtccggttttaaaattgtgaggtgtgttttagacaaactaaagacttagagggtgtaaaatagacttatctctactattataaaagttta

SEQ ID NO: 16678 - DNA, 4688 bp, Oryza sativa
aataaatacttaagattgtgtttagacacaattttttttatgaaaaacatgatacacattaccataaaaaattgggcctctatattataatttgcaccggtccctaaaaactcaggaccagcgctggctgcgattagtggatctaggtccttggcaatgaggtagggtgcgtggacacaccatgtggttcggcaatgagttggctctggatacgagccgacgcaggaacaacgataggtgtgcaacacccgcgcacttggtgatagtggtttggtgacctatgaaacatacgaggtggactttcatagctaaggggccacaacattaaggcggttggcagcatgtctatgcatatgtgtctgcgtttaaaaagtttgattgaatcttatcctaaatgccaaatattgatgatgatagggagtagaaaataacgtaaaagaataagcaacaaatgaattagttgtactacatatctttactgttataaaaattgaagatgtttttatcggtattttggtacgccatccatgtttgaatcggttttaattttatgtttcgggtctaatttctatctctactaccgagacaacaaattccgttttgtaaaaaaaggttcgacttactcaaaattgtagtcgtacaaaaaaaaattgtccgactcccaaaaaagactttcgcctgtaaaaaaacaaaaaagtccgtttgattttttgcaccggttttttcccgaccttttttttcacgcgaaagagtttttttcgcacgcgctaatgctttggttttttttcgtccggtttttttaattcctatctgttcacagcgcgcctggcgcttttggtttttttgtcaattttttgttgctatttttttctcccgtgcgctttttaatccgatccattccccgcacgcctcccgccgcccaccgccaccatatcgatagtgtgttttctcctccaatttaattgcaaaaatcattccactcctcacttatcattttctccatgattttccctttcgattcggctttaatagatcgagtggatcaaaaatcctcaaccaattttgggtgacaggcagccatatggacacggacgagactatcttcgggaggttgaagatggtagtggacactgcgagctgggcttacggctccacttgtctctggttgtcccttggtcgaagggaagcaagccaaacggaaggaggcagtggactggcctaggtactgagaaggaagaaaggcttttggcccaaaagctagaaaagattttcattatttttttcaattttaatatatatatatatatatatatatatatatatatatatatatatactttgatcctaatgtttatattttcattaaccttttcaattataatgtaaagtgatcccaatatttcaatttattactcagctcttattctcttaatactccctacatctactgttgatagccatattttcaaatctaaaaaatttatttttaataggcatatttcaatccaacaacctatcattttaatgactttctcggatttaatgcgtgactctccattcttctacacaagattggctacatgggcattgagaaatgcaaatattaatgaatcgcttgtttacgaggaataactagtagcatgtttaaatggatgataagtagagttacttatccttagtctgtgtaccaaggtgaaatattaatatcaaaagtagatggagggagtatattatataaaatacgtctttacctgttgcatatataactaattgaatgttcaccctagtcttttcaaagcaaaatttcataaagtattgcacatacgaggatttcatatagtcatgttgaatttcatgctttcagagcgataaaggaatttcatagacataatgttggccaattgaggataatatgccgaatgatgtattagcaaaataataataatttatagggaaaatatttatatacatatatacttagtgatttaagtgtcaatgtaaaaaataaacctcgatgaaaaatagttcaaaattaattttaaaattaattttaaaaatttaaatttttggcagcgaatacttgtgttgaattttgtgagtattcctcacgcggtgcttttggagcaaaataaaagttcaatttcccattcctattttttttgtgtgactggagtcgatcacgccaagataaggccacaccacacggcagacgtatccaccacaggccaacagagccgcagaaacacacctcgtccatccactcgtgcgtcgcagccatcgccgcgcataaaccgtccccaaccaaccgccacacacactcgacactactcgagctcgcgagcggcgagcccaaaacctgacaaaccacacgcccacctcgccatggcgcggcacctcgcgccaccaggaagcttccaccgcctcctcgcctcccggcactacccgccttcctccccggcaccgccgccgcgccctctccttctcctccccaaaaccctaataccgccggccgccgccgcaatggaattccctcgccgcgggcggcgcgacgtcgccgccgcctccgccccggcatcctcctcgccggagaccgaggtagcgccgggggcctgggggaaggtctccgccgtgctcttcgacatggacggcgtgctctgcaacagcgaggagctctcgcgcctcgcgggcgtcgacttatttgccgagatgggcgtcgacgtcaccggggacgactttgttccttacatgggcacaggtaaattgtctcgacgttcaacaacctactggtactgggaattgacaatgtagttcgcgcatttttattttacttttctcgattactcatgattcgtgattggtaagcgtagctatgcttgtgtgacataaacttggtcgtaggctgtttaagttgcgtgtgattcggtaattgtagcaattagtagcttcctatattagacataatatttcccgggatctcccttgacgtcgttggtttcgtatctccgctacctgccaaactctatatgtattatagtactatactcctatttcattaggatgcctgtaacagtggtctgtggtcacatccatagttatacatttccatcagaatagtttttgacagggtgcttgtatccagtggcggaggaagagaaaacaataaggtgtggcagcaaaaacaacataatactttgtaggtaatacggcatagttttgcaatgtgttcccatgcatcgctaaaagttcttgcaaaagttgttttgatgcaacaaatcatattgatctatgttaggattcaaaattcccgaatgaaattttcgaaaatttggaaattttcaaagaaaacttttgaatatagcaaaatctattcaaatttgatcaaaatttgttcaaatttcaaattatttcggaaagatagatattgccaaacatatagattaaaccttgatctaggttacatcatgtaactagctaacaacttatgcttatacaagcagctaatcacaaggagtgaaaacaagatactaggttagttgcttcacgtaactaactaacatccaagtcagctaattacaaggaggaatcagtgaatgttaatcatgcaagcatagactccaccggtggctaatagaattgaggtatggcgagtgccatatcttgccatatcggaagctccgccgctgcttgtatcctctgaagttctgtggctttatgtttcttaaagtggatacggcaatcagtatgtcatatggcctaccattgctgatcttctgtgatcccttggcaattgtagtgattgctaagctgaatgctaattagatagtaaccgtaaaccccttagcatgctcttaatgcctatagagtatattgttgcatcagagtgcttgcgagagatgttaattgcctactttgtatgacaagtatgtgaggactaagaaaatattactttttttttcaatatagaagttgggagaagtattgaggctatctctagacagaaaatgtcttacctattttactttgggggatgacaacctataactgctgccgtttttgacaggatcgccctctacacaaatgaatttagctaccttcagattttgttgggtgtagtttgtttgaaatgttgtaatatatattctaggtgaggctaatttccttggaggtgtagcgaagttgaagggagtgaaagatttcaacgctgaaagtgccaagaaacgtttttttgagatatatcttgacaaggttaatttgttcataccatctctcctgtttattctcattgtagtttgatggcgtcattcttaaattatgttccattctgtagtatgcaaagccaaatgctggcattggattccctggggctctagatctcgtaacagaggtatttctgtatttgcagtgcctgagttaaaacttgttgtactttggtaataagtgatcatcagctcattcctgtcaatatttcagtgcaaaaatgcaggtttgaaggttgctgttgcatccagtgctgataggattaaggtggatgcaaatttggcagctgctggtttgcctctgtcgctgtaggtgtttgcttattcctttgcattccaagcacttacttgctaatgccatcgttgtgctcacgttccaagatttctttgctactactagcattttaagtatcattgttattccaatatatt

SEQ ID NO: 16679 - DNA, 1259 bp, Oryza sativa
  unsure (1)..(1259): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccaccatcaaacagaattttcgcctgatggggcaaaccagcgtggaccgcttgatccaactctctcagggccaggcggtgaagggcaatcagctgttgcccgtctcactggtgaaaagaaaaaccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattcgagctcggtacccggggatcaagttcaatatcatcgcctctctctatgactacaacccccaacctggcaacctacatgaagccagagatgtgggggaagtgcctgggctgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtatgccatcatcgagcgtgtgcagcgctacctggaggagaagggcactaccgaggaggtctgccgcatctacctgctgcgcatcctgcacacctactacaagcttgactacaaggcccattagcgacagctgaccccgcctgagggctcctcaaagtctgagcaagaccaagcagaaaatgagggcgaggactcggctgcgttgatggagagactgtgcaagtacatctacgccaaggaccgcacagaccnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16680 - DNA, 3383 bp, Oryza sativa
gcaagtagctcatcaaatataaattccctgattttaccgataagctcacagaaaccggtcggctttgacaaaattctgagcgaaatcatcaaaatttcaatcggtaactagaaaaagaggtaaactgaaattgttttccttttttaattcattattcttttctttcctattgtaaatttcagtaaatacacgaaatacattaatttttttcaaaaatttatatcccaataggttctatgaatatcatactatttattagtttttttatttttttttcttttttatcaattcaaatttgaatttggatgaaacttatcgaaatctcaaacggcttttattttcgagccttgtcgaaacctttaaatttcgcagaattcgactggttttcgtcagagttgtgaaccctacttagacatacctgttagtaggggtgaaaacggtacagaaacggacggaaaccatctttatcgttttcgttttcatattttattcggaatcggaatcggaaaccccggatacgaaaatggaatcgaatattatcgaaactgaaaacggagcgaaaacaaacccggcgcgaatacgggaacgaaaatttatcggaataaaaactccctcaaactgataaatccaattgaataaattatgtatgtttaaaagagtaatgttgttgataaatccccatgtaggacaaaaaaatattcttatgtaattttagtttgcataacaaatatttttttaaaaaaaatagccaaacaccatggtattcactattcagtgcttaaaaaaagaatccagggtatttctttcacaaaatttctggtaattccgagaaaatttccgaccgattccgagttccgacagaaactgcccttatcatttccgattccgtttccgagaaaatatttccgaatttatttccgtttccgaaaaaattccgaccgacatattccgttttcgaaaaataggttcgaatccggaaagtttccgtaccgttttcacccctacctgttagatgttgcataatcgaaagctacggatggatccataggctaagccagaatcatttcaagtatctcacactctcacgcgcgtgcatgatctagacgcgcgaacgcccgtccgttaaacccactcaccgccatgtgcggcatatgcctgagtgcgaagcatagtcgcatgacgacctacagggctacaactcccagtcccagcactttgccgagaaaaaaaagaaaagacccaaaccgcccatgaccccgcgtctccgccacatcgtgacaccggacaccggtgctatgcaccacgagagcacgagaagagacgcgcgggtacaactacattccacacgcgactactagctaatagcaaagcagcagtaagtaacacgttacaccggcatccccccaggccccaacccgtcaaagcataagcccacacagcgggagaaacactcggcggcgaccggccgtcgcggcctcgccgggaagagcaggttaattagcggccgctcgatcgacgatatggggggcagcctggtgtccatgctgcggtggccgccggacctcggcgtgccgagcctggcggcgctgctgccgtcgtcggcggccggccactacgcgggcgcgccggccctccgcgggtggcactggcagcactggtggccggagcggctcggctcggcggtgcggcggtggccggagctcgtgcaggacttttcccccgtcgtggacgccgtgctctggggcctcgtcaccgccatcgagtccgtcgcgctcttctccatggtgtgctgcttcttcctcttctgcggctgcacgctatgatcggtgccactcccccaccatatagggcgcgcgtacgtacgtacgtatgcataattgtatatgatcgcttcctagctctgctctgaatctcccaactgtttttgattgattttttttttcagatgattctccattttgttgtcggttattcactgtgttcatgcttcatggcaaattaatttagatgccgctaattgtattgtactggtgcttagtgcgtagatttgttactggattttgcttgtctgatgtatgtgcagagcagtgaggcagaagaacagcaagcaccattgatagttttgggtgatgaaatgtttggggagagggattgagtgagattcggttggactagttggtgcgggtgcgcggtcggaacgggggtgagtccaaccctcgaaatatcttatgattttcttaatcgtggcgagtccatgaaactactatttcctacctgattatactcgtcataaaaatataacaaaataacttcgaccactatattttttattataatatataaaaatattaataactgtattaaaatatcaataactgtattatgattttatggaagtaatttttaatcatcatattttataaatattttagatgttatttatagtcaaagtttttaaagtttaacaatagtctgatatgacaaatattattaactgaggaatatataaaattctttttttactcccttgtctcatataagtgcacttactcactccgtcacttaagaaaactaacctaccggaagtaacacatatttttagattaatagtatcataacatgtcacatccaattatatatttgttatttaagattgaaggaatattataggatatgattgaattgttcagatttatagtacacacgtagtactagggtattggaagtttggaactgaaggtgtagttaataccagtaggcagtagctgttgtagacagtgcactgatgagtcgctgattgcatgtcacgtttcggtgttgtcgttctgtcctaggacctcgtgaagcgccactgttgcagtcaggaccatttacaggttaaaaccatgatccgatgactgaccaaaatccggcttcattcctactaacacggcccttttgttcagagagctgtgatgctttcggacgtcgcataacacggcctggcttcaacaggcaatttggcggcatcaacgtgtgtataactgtatatgctcataaaagattatctacgctttgaaatttatttcgactgttaccgtagagtgttcgaatgaaatggtgtctttctgaagctaatgagcgaaccgccacaatttaagatgacaaattttactataggaaatcgtcggttttagctaaactcgtcggacgaagcgtcgccttcctctgctgcccacgcgctgcttcccatcgacggcgatgacccccatggcaccaacggacgggatagagagagaaaagagatgaaagaactgacatgtggatccagggggtaattttaagagtaattttaatatttcaagtgatttttcgctcctctccaaccagaaattattatttta

SEQ ID NO: 16681 - DNA, 3966 bp, Oryza sativa
gagtgaaaatgcagggcttgaaattgttagcagacaggcttgtttagcagccagtaatcattccaaaaattgatagtgaccagtgagattaacatgaaaatttaatttttagtctcaacctcttctttaatagaggtggcgggactcgataagaagtttattgaagattaaattttaaataaaaaatgaatggttgagatttaaggattttgcttccaattaccatccctactccctcaattctctatcttatcctaccaaaactctcaagtctcctaaccaaacagaatcattaatagtcccatccctttgaactcttagggtgtgttcgcatatgttggttcccaacccggaatagtaacacgaaaaacagagcagtccattagcacgtaattaattaagtatttgctatttttttaaaaaatgaattaatatgatttttaagcaacatttgtatagaaacttttttgcaaaaagtacaccgtttaatagtttgaaaagcgtgcgcgtggaaaacgagagagatgggttgagaaaaaggggtgccaaagacacccttaatccgtcctacaaacttcctccaaccacaacgaaccctttggtcataaaattttgatgtaagatcatattaaacttttagaactttaagcactctagcactaattaactccgaaaaacgtccattagtcttctggctagcttcataaggtgatgggctagacgacctgggtttaaagacgacctgggtttaaagtctcaccccttttaattatttaatattaggtcattcctaatactatttgctagtagtaattaactccttaatctgatcttacgtcgatgggaatgcttaaaggcatgcttaaagtttcatgatttgcaaaaattcatgagatgttggttcgacgccgatcacgatcactccgatatttcttagatgttactaagccatgaaatggcgagacagcggggggctcctagctagcgcgtgcgtgtcgctagcgagcactcccctcttaagtcttaactacctctattagtaatatacttaacactaatgatagtaattaggaaagattctggagatttttttttggagatttttttactaacatattgaaaattttttaagttagatttgaaaactttcgatttaagttttaaattctaaagtcaaattttgaaaactttcaactcgagaattgagattcaaaaactttcaagtccagatttgaaaaattgaaaactttcaatttgagatttaaaaattttcaactcgaaatttgaaaactttcaactcgatattcgaaaacttttaagtccagatttgaaaattttgaaaactgtcaacttgagatttgaaaactttcaagtcgagatttaaaaactttcagctcaaaatttaaaaactttcaaactcaaaacatgctaaaagattaaaaaaatattcagaaaaaagtgggtaaaaaagaaaaatatcggtaaaaaaaagacgtgggaggcgtgcgctagcgggccggcactgggccttctgggcctgatacgcgcgtgagagaattagcgattctggagacagcgcgtggtaccccggaacaacagtattatttcggcggaataagttcactttgtgaccctcaaaagtgatcgaaatctaatccatggccctaaatcagaaaaccggatatcttgacccccccccccaaactcttaaaaccggtgcaatttgactccctcggcggttttggagggcggtttcgctgacgtggcgcctacatggcaatattgaccgagtctttgttcctcgtggcacttacgtggcagtagaattaaaaaatatgagtgggacccattagtcattcacacaaaaagaaatatgggcccactgatatgtggggcccacgtggcagtgctttccttcttcctcctccctctctcccttctctctctttctctccccttcttccccttcggccggcgggcgggagggcagtgagaacgagcggcggcgggcggcgaggccggaactgcggcggcaggcgggagggcaggcgagggctgggagcccggaatcctactccccatctccggcgcccgccaccaccaccgcccggaggaggagagcttctcgccggtgctgctactaatccccatacccacctgctcagctcagctcagcttcccagctcggcaactgaggagagggagaaagggaggcaagaagaagaagccgaggagctcggcgaggtgaggaggggagccgaggaggaggctgaggaatgcggctgtcctggcactcatgctctcctccctcatcgcgctctccatcatccgcgccaggttctcccccatcctcctcttcttcctctcgccgccgccgccgccgctgttaattgttttgttggatgctgctatggcgagaggcgagagctgatttggaggttctccttcgcagctagtgatggaggcgaggccctcaagctcgtggccgacgaatccaagctcgtcgtcaccaccaatcacgtcgtcgtcaacaccgaatccggcgactagtcctcgtcgttgtcgtcggcagctggtaattacgagatgtgtttcttggatctgctcgcgcgtgagcggcgcagtgcagcgcattgcttgagctggcttggctgattcgttcttggcgatttcatatccgttctttcgatttggctttagttcaaacaaggactagaggagaagaaaaaaaggaaaaggaatcgaagcatccataatttatttcttgaatttttttctcccggcgagttgctatcctggttcataatttatttcttgggctttctggagttttgcgctaaagaatggcgtggattcggctgcgagattccgcgaccagatctaattaaactgattctcctcgtgatgctgcagcggaggaggtcgccgctccggcgaagcccaccgggcggcggcgatggggccaagccggtgtgctacgagacgagccgccgctccgacacatgcgaggccgccggcgacgtgcgcgtggtggggagcagtcagataatgatgccgtgcgcgttcgtcgccgcccgccgccgctcgctctcgttgccctcccgcccgccggccgaaggggaagaaggggagagaaagaaagagaagggagagagggaggaggaagaacgaagcaaatgtcagtgggcccacatttattttttttgaatgactaatggttccatatatattttttaattctactgtcacataagtgccatgtcaacgccacatggaacgaagaccaatatcgccacgtagacgccacgttaacaaaaccgtcgaggtggttaaattacaccggttttaggagtttgggggtcgagatatccggttttgtggtttagggttcgatcacatttgagggtcatgaagtgaacttattcctatttcggcgagcatatgcggggcctactcgaacttttccatgtctcttttatttcctcctgacgggcccggccattccattttgggccttcttcgtctgatcaagcccaacgattcttcccggcagatccgctcagttcgtcggccccatacgggaacagaaccggggtgccggaattggaaaaagtacaccgaaggtccctcaacttatcatcgggattaacaaacgtcctcaaaccacaaaaacaaatatgcgagatcccttaactatacaaaaccggtcacccgagttgcttcagtggttttgtccccgggtttggcctacgtagcgcgtgagacccacgtgggccccatatgtcagcgtgccacgtcatcactatctctctctttcccttcgtccttactctctgtctcactttacctctctctaagctggcgacaggcgacgcggtggcggcggcgacgtgggaacaggcctcccatcccgacaaccaacgcctcactcttcttcacctacgacgaggccacgcacccactcac

SEQ ID NO: 16682 - DNA, 3869 bp, Oryza sativa
agaagctccgccagatgagcgcggaagggcaggcgtggatgggcgttgccaagagccacgaggctgtcgccgccggcctccgcgcgatgctcgactagctcctccagtccccctatgccgtcgccgccaccgcgggggagggcgacgccgaggatgcgcagtcgtgctgcttcgagaccccaggcggcggcgccgccgccactgccaccgacgcggtgtccggggcgacgtcgtgcaaggcctgccgtgtcacggaggcgtccgtgctgccgcctgtgcctgtgcggcgcctgcgaggccgccgttgacgcttgccccgtttgcgccgccaccaagatcgcctccgtccatgtcctcctttcctgaagtcactcacatgtgccacaccagctactgcatggagtaggagatttcgatagcgcaacagctgtggccagaccgaaaccaggcatccgtcagccaactccggtgtcaagcaagctaacaacaatcatcctgtcccaagttacatggaaattcatgctagggaagccacagttctgtgcatcagcgatctccgggccatgcgagttttgtcggtggaaacaacagtgttcggtgcggtgaattgaatggttgattgcctatctcatcttccgcaggtaccattgcttcgaatatttggcagcccggataggcatgcacgccgtcccgtctccccgtcggccgctgctcgtcggttgtcctccccatcagctgcctcccgtcctggcaccccttctccccgccgatcctcgcctgtcgacgacgtcccggcgccgctccccatccgccggccaccgcagctccgcgcctccgcttcgccggccgccgcgcgctcacacgctgcctccgccgtccgccgctcaacccccctcgccgtccggtcgtctgctccctacccgtcggccagcctgcaagagaagagtgcgagagagaggggggaggaagggagagaagaagaggggaaaggggaattgacgtggcaagcccacatgtgggtcccacgcgccacgtaggctaaaacagggtcaaaaccactaaaggatctcgggtgactggttttgtatagttaagggacacctcatatctggttttgcggtttgaggatgtttttgtatccgatgacaagttgagggaccttcggtgtactttttccgccggaattccccggggtgcctcagccctcatgcctaggcccaggcacggcacggcacggtacgccagcctgtgggtcatgccggcacggctcatttgccactaccgtgcttgggccggcgcttcagatgatgggccggcacgaaaccttgtgggtcagcccgcaaaatttgatgggccagcatgggtcaactaaagtcggtaagtccaaaaccttaaagcatgttcacactgccgagtactgaccatctcccttcccatccacgttcggccacttcctcctttctcaagctctctctcctctcctcgcagtcgcagcgcagtagtctctagggttttagcgggcggttgtcctccacccgctcgccgcgtggccgccgccttctccccgcgccaccgccgatggacgtcgactccgacccagccgccgcgggcaagcccacccagatggacctcgaggaccaggcatgccgccgccgccgccgcccgactcctccccacggggattctaccttcagtttttgattgtgactgttttttttttgcccctgatgatggaccctgtgcagactgacgcgaaggggaaggggaagagcgaggagctcgcggactccatcgggagcctctccatcggcccggagcgcaccaatttcaagaagaagccggtgatcatcatcgtcatcggcatggccggtacatcgatttcgcatgctgattggttcatcctttgatgtttagtggcaaccaacctgtcatacaatgagctcttgttgagtaattttgggattgggagctcaggcctcaagggtctcggtttatgtgatgtagggacggggaagacaacttttatgcaccgactggtatgccacacccaggcttcaaacatgaggggttatgtgctcaaccttgaccctgcggtgatgacgctgccgtttggggccaacatagatatccgtgataccgttcggtacaaggaggtgatgaaggagtatggtcttggccccaatggcggtatcctcacctctctcaacctattctccaccaagtttgacgaggtgtgcttttcgatcatcatatatttcatctccgtatgtgtttagatcaagtggttgttaggattgggttacttgaatgcacactatcaggaagtacttcaataccaagttaggcaatacttaggcaatttaatcacttcaatggtagtttgtatgcaacgatagttagttagggagcaacagaaatggacagtgaagagttcagcgataagtttcgacagttcaatttcattaatagtttctaaatagttcaagatttcacatatacacgcgtaatattcaattagaagtgttattgtcatgcagcacatagagattcccaaataaacttgcctagattgagtcctgttcccttaaaagatacaatgtaatgaatgctaatttaatttggtttataggaagattatcgtgcatgtatgctactaattggttctgcataggtaacttttcaattcttacctggagatgcttgcacagtgtctaattatggttctaatagctgtatggaatgtgtgtagggaaacactaaataatggtcatttctcaacaaactagcttattgatactgttggatggtcaacataatataaaattataatgtttaacaaatatgtcaataatgatataaaataaacataagggtagaaaatatgcccctagcccgtgcagatgcacgggttgatgactagtctagtaaatttgttaaaggaatgcagtctgcttatcatgttgatgggataatatttccacaattccatgtaaagtggttcagaaagcgagcttgctttttgcttactgcagtgtacagataaatttggttgacacatgatgcaattctgctaatgatcatatgtaacacctaataattgtctttacaggttatatctgttattgaaagacgagccgaccagctggattatgtcctggtggacacgccagggcagattgaaatcttcacttggtcggcttcaggagctatcataacagaagcttttgcatcgacatttccaacagttgtcgcatatgttgttgacacccccagatcaacgagccctgttactttcatgagcaacatgctttatgcctgcagtattctgtacaagacccgcttaccgatgattctgacatttaataaggttgatgttgccaagcatgagtttgctcttgaggtatgtttgccatctatgaatatctaattcctttgttgttgattctggacaccataagtgttgcatttcagtaatgcggtatcggcattatgcaacgactctctttggtatttaatcaagttgaaactgttgcacttgattgatatttgctcaaatttgattgggcctgttagttaattgtcttatctgtttttttccctacatcttctgtaaccagagattatgttgtttattttatcagtggatggaagactttgaggcgtttcagaccgccttggattctgactcatcatactcctctacattacccgaagcctctctcttgtcctggatgagttttacaaaaatctgcggtctgttggagtatctgccgtatctggcgctggagtcaattcattttttgaagctattgaagcaagtgccaaagaatacatggagaattacaggtgttttaacttgcgatgtagtg

SEQ ID NO: 16683 - DNA, 593 bp, Oryza sativa
ccgtgcgcgtggagatgagggctccggcgacgacctcgacggaggaggggtggacgaggtggacctcggccgcgcgaagctaacggcggcgacggcgtgagacggcggcgagcctatcggcggctagcggcggccggagtagcaaaagcggcggcggcgggtggttgcacggcgcggaggcgttggggagctcgggagaggtcggcgcaatggggaaaaagcgagagggggtgccggtgatgcttaaataggggatgggggaaccggacgtggccgggagcggcgggattctaccgccgacgtgggggagtggggaggagacaaagccgggattcggttttcgaatcccggccatctcgggcgcgggcgccagcgggagagggaggggaacgggcccggggaatgcggcgcacgcgcgggcgtggtccacgtggcccgggagagacgtaggcgtgggctcggcgtccgttccgccggtggcggcgcgagcgggatcggcgggaggagggaaacgggtccgacaggtgggccccacctgtcggcgaccccgagagggaggaggcgggcggccggctgtcgggcctgggcctcgg

SEQ ID NO: 16684 - DNA, 1397 bp, Oryza sativa
ttttaatagattttttgagataatggaattttacatcccggcctttgctcaaaaagagctacagccaattattacattatagcaatctagaaaagagcgtagttcagctaaataggacaccccaaacaaaaacagaggaaaccaagtcaaaataaggagaacacatttattgaagtctatttgtgaacctccatccataattggcaaataattgcataaccattgactccaacttgcggcatgcaatctttaggaactccccatcatcctcacacctttgtagctgtgcccaaaaccggagctagtgcattgccctgaaaattacctgcatatatgaaatagatggtgatttattaaaaaccaaatcatttttactcaaccatagagcccaacaaatggcagaagctctaaccagtatcagtttactctttttcttatcaaccccccatagccacccatccaatatattagatatattaggtggaagattaaaacccaaaaaaactaaactgctctccatatgaattttgcataatgaccatttatgaaaaaatggtgaatagtttcattttttaatacaaaagcaccatcttaagctaccattccaattcgttttggcaaaataaccttgggttaacacactccctaagcaagtaccacataaagttcttatttttaaggggattcttaaattccaagtagatttgtttctctcaatataacagttgttaattaaagctagatacattgaccttactgagaacctatcattctgatgataattccatctaaaacagtcagaagaaagaatttaattgaatatgtccaatagaagccccacaattcatgccaatatacaagattttgaccaataaaagcttttttaaaagaaccattaaggggaccagatcccataccagtggcaatagtggatgatttacttcggattatagcatataaagatggaattttatccttgaaagccaagttaccaagccatttatcttcccaaaatctaatttgttccccatcattcacaatccaagagcctatatctaaaaaagtacttttgactttcataagccctgaccaaaaaagggaatcaccttgtttcttgtccacttgggttatagacttgttataaagatatttccttttcaataagttctgccaaacccctttctcatttattagcttgtacaaccacttactcaaaagacatttattttgtaattccaaattatgaatcccaccgttaaattttttttatcacgcgtttgatcattcgtcttattaaaaaaattacgtatttataatttattttgctgagggttgttttatcactcaaagtacttaaagcatgatttatatcatatatatttttgaataagacgaat

SEQ ID NO: 16685 - DNA, 4496 bp, Oryza sativa
tctcccttacattaaaaaatcaatctagctttaaacatgatatatctgagtaatataattttagacagagatatatttaaatttataatagtattaagttatgtcatatttaatactattgttttttttacgaaagagattgcctaggaatacgagtagtagtactagtttggttgacagggcacccgatggatggagacatacacccatgcgcctgcctggatcctgtcgacgcagtcgctcgcacatgcagaggaggatttcccggagggaagaaacgacagcatagctagagagcattactagatgattttgattgaaaatacaggaaacatgcacgagaaaaggtgaaaaggccggccggctcagctcaggctgcgcgctgggcttctacagatatgtgtgcatttctctggcccagttttgttttgcatgttctcggcacgaatttctgccggatgaaacttattactatgtagtacttctattatcctataatataaaacacaaccacttttttctcatgttttataatatataagacgtgtatgcatacatacttaactaacagctctgatcttgtaaaattaatttgttttaaatcctataccatcaaaaccctcaatcacattgttcgcattattgaggtgatccaaccgagaaagtgattaaattatttcatgttctttgtattaggagtgttactgcgagtaagataggcctgatgtaggtggaggtacaagttgtcacatcatatttttacttatgtgaaggagagagaaaaagtgggctacaaattttagccaattgcagcacaagctccaataaactatgggtgtgtttggataataggaaatagggagtgggattgggattggaaaatgaatgaagggttagaattaaatggaagagggagaatgaatggttatgatttaagtatgtcttttggttggtgggaaattatttccctatcctattagccaaacactgactatgtgagagagatagatggattagatattagtgatacaatatatatatctacaactaattagagcaaaatcaataatatagttaactactggcttcaaaaatctaaatatcatatatagccaacataatagtacactcatataatcgttagttggagatatatactgcatcattaatatatcattcacccatctctctcacatagtttattggaactcacgctgaagctggctataaatctatagtccgctttgtttctctctcatttccttacctatccacataaatacaaatgtgatgtggcaacttatacaatatgcttatggcatcttattgtacttgctcttattgtatgagtggactattagattatctataaataatatttcaatttttggagctagtagttaatcgttatattattaaactccttcaaggagtaacactactacaaaagccctcatagggaccgaccttatagatttatagataaataatgtaggttttaaataaaccgacacctatgagcattttcccacctccgcacgataaaaaaaagttaaaattggcacctttaaacattataggtgtcggttttattaaaaaaaccggcacctacactgtaggtgtcggttttttgtttagaaccgacacctataatataaatataggtgtcggttctatttaaaaaccggcacctatatttaaaaaaaccgagccggctcttcttgaccacccacagtgccagcctcatcttaatccatccatccacctctgacctccctccctctctctcgctcgctcgcccctcctctcccattgcgcagcgacggtgacagagtagtggcggcggccgacggagaagaatggcgcggcggtcctctctcggcctgggggccctcccccgttctctcctcctccagggtggctcgacagtggagaaggccgaccgacgcgggcgaagagacggtgcggtggtggagaaggttggccggcgtggcggctgacagctggaggaggctcacccctctcggctgcctctcctcgcggtggcgatagcgcgaaggctggcgcggcgaggtggcggcgacggcagtggtggtggagtaggcctggatctcgccagcatcctctctcccgggggacctcgcctcccttcccttcttctcctctagcatggcgtggggtggcggccgccgcggcgaggtggcggcctttctcccaggggacctccccccttgataacaatccggccccggcgaggtggcggcctctctcctaggggacctccccccttgataacaatccggccccggcaaggtggcggcctctctcccaggggacctccccccttgataacaatccgtcccaggtgaggttggccgaggcccaataacttaaggttgcccggaccccaacagttcataggcacacccactcggggaaaggcccaatctccagttcataggcacacccactcggggaaaggcccaatctccctaaaagactagtccggtaggggaagggtggctctcccttttaaggtggcttcctcctcccaagctaagcaaggtgggattattcagaggctcacacggtcgccgcccgaattttgcatctttgccagcgggtaatagtggaggatgtcctcatcatcctccagcgcgacgttgggtggcggcgcggaggcgggcatggctaggtggagactcacccctctcggcttcctctcctcgtggcggtgacgtcgtggaggccggcgcgaaggttggcacggcgtggaggccgggcgaggtggtggtggcggcggtggagaaggccggcagtgtaggtgccatcgtttttttaatttttttgatagtataggtgtcggttttataaccggcaccaataagattgagataaaggtgccgaccaataggttccggcttagaaaccggcacctatagccagttcccaaccggcacctataggggtttctgtactcgggagtactacttcttactattgatccactggacacggaagccctttttctcgccagatcctttgtaaatttcaggcggggtatagtgtaaacatggacaatttgaaaaaagaaactatacacatcgacgagttctttcgggctattattgtcagattttcccaagtcagggctttgtttcaggctatttgttagtagtatcattagtactggctaactagcttgtttgctggtgtcaagtataaagacctcgtttgttaaattaatatacggtaggagttcatattttctgcggttttgagatacgctgatacgggagtatatcaggaagggaccctgtacacatgaggctatgtatgcagcctttgaaattgggatcttagcttagacagatttgaactcatgactgatcttagagtgttactcaggccactgtaaccagtcggctatatgttctttcacagaacgttggattatgctgagatctattttgggtgagatatggatcgttccccaaactgaactaatcaggaagcacgtgaatttatatatggtggttaaccgcaacgaggctacttcagtaccttttgatatgcatgattacgaagaaatgctgctgggatatctcgctgactgattcgttgttttttcgaacacgcaagaaccttacatgttaatattacgagaaaattcttttgtacaactataatctactgtaacgggtatggaaggtttacacggggagaaaaggagatcaacagctagctaagctagatagaaccaaaccctgaacaagcaaaatcgcatggaaaagaaaagaaaaaactaaatgactatatatgccaagaagaactccagaaggactcagcttcgctttcacccagagcctcccctcctgcacgacgtgatcaataaccgtatccacttgggagaggaccccatcaaaaacgcgagcggtcctctctaaccagagattccaggtaatgagaaggatcaggaagccgaatcctcttctaaggtgatcaggcagctatcgacgagtgcactcccactagacttagagtgtgaactatcggcggggcaaggagaaggaagagagcaaataaatacaccttcaagaaggaggatgacgcctatgggtgtcacagcgtcattggcactagtaaaaaaacatgtgcggctttcagccagttccccctctttttcaactacactaaagccgccacaagtccataacggtgccgagacaaagcagaaaagggttatcattgctgattttgccacttccgacaagcagcttcgacttcgtcccaacacgccaccacacaacctcgccgtggaagccctctgcaaaacaccttttgtagtgtaaaaaggaatatatactttgtagttctaatcaatagatatatacctcctagtagtaatggtatgcacctctcaaagactaacgaaaaactcaagagcggatacaaaggtgaatttccaattctatttctacttctggctacatcct

SEQ ID NO: 16686 - DNA, 1135 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacgcggcctgca

SEQ ID NO: 16687 - DNA, 1373 bp, Oryza sativa
agggcctaagtgtgacatacaagtgcaacaagattttatacacataagtacataacacacttatacaagatttttccctgggggagaaaatgcaaccaaattttataaaacagagcataagacattagataaggacagcaataaaattaagctgacatttcatacttgacataagctcttcaaatttctaaaaacttaaaaacaaaatatctgtaatgcatgaagggcagtagtacatactctttaatgcatccagaacgagaaacgggctgagctccttcaaggaagtgaagctcatcctacaaaaggagctttgtgttagaccaatattgttctctcatgtgctagatgcaaacccatgaatttcctccttgagctagaaacaaacccacaaaagtttttctacctgttgaagtaaaatagactatgcacttaacatgagagaaatgacaaaagaaaattttgataattcagtactgcaggctgagtgaccatgcaccacaatggaaaataaaaactaaacttttgaatggagctggattctttcatgttaaaagacacagttgcagaaataaaaagtaaataaaggttgttacttgtaccacatctgcagttaaaacttaaaacccattaatcaaagcctggagtaattgaccagtacgaacggtcccataaaggttcctgctttactgtgtaagtgtcctttgatgttgcacaaaagcgagatcgggtaccaaagcagggactgaccttgcaagaaacgataaaaagatgtctaaagcgcatttgattactactacaaagaagttctctgatatctgaagagcttctgaaatctctgctccttaaaagcacagcacagtgtcaagaacaacacattcttccctccctcgttaaacacaaaatctagcaacatcaaaagcctcaaaccatggtggcagcccataacaccaacacggcaccacccatcgtgcaaagccctcatggccatgccgtctgcacgtccagtgtcgacgaagcaatggcggagatagacacgtccactgctatggctctccctgacaaggccactcaggtcagttgtccatgcccacgctcttcttttctccaacgaggagcccaaccaaacaacgacaaaggtagtacagccatggcgccacgcccaaagagggccaagcttgtctcgccagcctcggattgatggcgccgtgattcacctccgcctagaaacagtactacaagtactagaatagcactagctaccgcaattaacaacgccattactgtacacttcacagcatcctacttgcagtagcgggtagctccgtactcgcccgcttgggttttgaaaaatgcgcggcgaatcggatctc

SEQ ID NO: 16688 - DNA, 523 bp, Oryza sativa
gatgtactcaaaggcctgagatggaggcctccactgcatccgaaattattgtatgcagtagcacaatcaaccagctgctgctcagaaagagagacaggcttccagtggcctgagtatatgctgcctcaagagaaccagtggtgctgccagaataagttaaaggtcactcaaatgatctgattataggaccccccccccccacccgtgactttccttttttctactttgtctgctataattgaaatgaagcaccttctctacaacggtcacactatataaagttataatcgaaagtaacattccaggaacattttcaacataggtttgtcaattggtatgtgaagcatatttgccactatacttgtggagtaccaagaatatatgccaaatggacgaaaagtaacagaataaattcatgaaagacatatgataattgaattgtatgcttatttgagagtagtgacagatacctctccgtccaaaaaaaaaagtccaattctaacgataaatctggacacctatt

SEQ ID NO: 16689 - DNA, 12083 bp, Oryza sativa
cagattttattccacttaagatacaaattttacatcagttttcatcaacatgttttttaaacggttgaatgatatattttatgaaaatcttttctatataaaaagttgcttgaaatattaaataaattaaccatgtgtcaattggtttcgttatttttcatgccctaacattgggccggttcattttgatgacattttcaaccttatcaaattttggtaatgttgtcaaaaagtggctacatttagggcttgtttggttctttaccctaccaattcattggtagtaccaaagtctaggcaaattttggcactaccaaaatattggtagggccaattatttagctaacatttggattgctatcaatttaaagccaaattcttatagcatagtgaagaaacttctagactatgaccaaatattttaggggcactatcaaatatttggtctcaatccaaactaacacacaaactattcaatttgccaataaattggtagggtatgtttttggcatcaaaccaaaacggcccctagtttgctgccaaattttgataactatataaaaaatcctgccaaaattttgacaagttaccaaaattttggcattatcaaaatttggtaaggttttttttttcatcaaagtgaacatacccgtcatcttcatcttcattaaaaacaaatggtgcctggctgcgttcttggttatacattttacgttcaattggctgttgggtaggcttttcgattccacgtcaaataaaataaaaacattagcacatacttaatcgagtattcatgattgctaactgaaaaatgttatttaatttacaagtagccgttccaagttaccgtttaaaactcagccttttgccgtaggctttaatatggtactgtatctttgtcccgtgaataatttacttcctccgtttcacgatgtaaaactttctagcattgactatatttatttagatgttaataaatctagacatatgcatatgtttagattcattaacatctatatgtatatggacaatgctagaaagtcttgcactgtgaaacggagggagtatatatatactgattcaagtttgctcttttactccctccgtactaaaatataagagatttacgtgatgagaaaactatatgtatgttccttttagtgacttggtttgatcaaattgcactaaaaattttgcttcttttaatctataccttctatatatatatttggtacccactagcaaatattacaagctaacacttaatatagaggtattccacagcatcgcctattaaccagtactgacggagcgtggggcttctcaccgggagaccgcgcaggcccccctttgccggttcggccgggggcgctaagtgaggttcttcgccctcgatctgaggaacgtcagcgagagagaaagtgcacaagacacgggcgacgtagacaggttcgggccgctgagaagcgtaacaccctactcctgtgttctggtggatctgtgcgtgaaggaataccgagagccccccgcgagagggagagttcaggctctcgaaccccctccttttaggcctgggcctcctttttatctgtcaggggtcaccacaggggcctctagctgcctaagaagggaaacatgctttttacaatgagggctagtctacagccggaagtgacctctgacaagcagagcacgcgcctcctgccccgctcgcctgcttttccggtggacgcccatttcaaccttcatttaatggccagcgacttccttgtcatacttgcgctgaagcctggaatggatctgaccgggactgacataccaactccaggagttagcacgccggctccggctagggacaagagccagaaagctcttatcattccgacgggacggggcgaggcgtgtgacaggccgcctgttgccacctaacccgcgatctgaccgatctgtgaccggtcacacaccgcgactggtcacggaccggataagcgtgcgctgcgccgcattgaatgcagcgtggtgcgctcgtccaacctgctataaatgcggttaggtgagccccgctgtgctcacctaacccacacatgtggcgccaaaaccgcagggggtcggggcgccccagccctcggggccgaaacgggggcgccccagccctcggggccgaaacgggagcggtccgacccctcggggagacagagggaggggtggccacgtcatcctcgggcccgacccccccgagggggtcaggccacgtgggtgaccgcggctatccaagcctctagtcacgatacccccagccccatgtcaccgacaagtactattctagagtataatattgtagtgtttaacatgtaaatatgtcaaatcatctttctcacatcattttcacaatatttcaatattcattatttatataatatttaacatatattcatctatgcgtttcgcagcaaagcacttggtatcacctagtttaaatataagaaggcctataagattttcttttaaaaactacgattatgcacgactgttttttttatgacgaacttatatcatgtgttgtgtgtgacgtacatacatatgtaatttcaggtatgactactgcttcatgcggtacaagaacgccaacttcattggacaggtggacacgagggtggacgccagcgtaagaattaggaaagaagaaaacatggacaaccctaagacgttccaaaaggtggtggcgaagacgatggacaaataccccaggcggtggcgaccgcggggagtgccgcattgggaagggtgaaggaaaaatacatgacgtttgtgaacatctacgggctgtcgcagtgcacgcgggatctagcaccgctggcatgtgcccaatgcctgtcgacggcagtgtccgacttcggcgacatctgcaacgccgcggagggatgtcagatcgaatacagcacctgttgggtgcgctacgagatttaccccttctattttccgctcaagactgacgggcgagccaccactgacatgacgaagtacaccaaggtcgttgtgcactgataattaagtttacaactagttatgtaaaggattatgttgtaacgcgtagcaatatacatataattaatttgtgggtgagatcttatatgacctctttgccacgatttgaaatggttctagagttaagtaaaaaaaagttctagaggacgaggtctcttataattctttgatttttcttgcacattgtctacctcccgtgtttgagtgtctcctctcctaagaccccaaccactactacacatcgatgtcttgctaacttcatgggtttttgttcaacaaaaaacaaaaacctcatgggttttaactgtgactctgaggccgtggatattcgacctgcccgttagtaaaaccgtgctctgggcccaaacatacaggcttcacacctgtgagccagcttgtcatcccgaatcgccgtgagacggtgagagtgagagggggaataagatcactttgactcccttaactgaccatcgaatctaaatcgtatccctcaactgcaatatcagaaatcttgacccccgaacttgcaaaaccggtgcaatttgactctcctggtagtttagggcggtttcactgccgtggcgcacacgtggtagtgttgacctggtttttgttccacgtggcattgacatgacgcttatatggcattaaaataaaaaaatatatgcgggacccatttgtcattcacacaaaaataaaattgtgggacccacagacatgtgggaccgacatgtcatcttctctctcactacccttcttcctcatctctcccttatctctctctctctctccccttgacatgagtcggcgacggcggcgagcgggtgccggagtggtggcagcggtgggcggtggacctcgggcgacgagcgtgggagcagctcctccctgaaatgggcggtggacctcaggcgacgtgcgacggaatgcgtcgggggagatgggagaacgctcctcgtcccagctctgtgtcgtgggcagtgagttgggtggcggccgcagcgtcgacggcgaggtgggcggtggccgcggtggaaagagagcgatagctcgctgttaacagtgaaatttggtaatcggcaaagacgtcatcggcttagaatcattatcggctgcagcatctcggaatcagccgatgggagttatcaagtcgccaatagtcggattcctgctatattcggttaaggaaatcaatctactaaaggaagcttatccctaagtgaccgagtttaaagaggatgcggtatgtcagtttatctattaattaggaatagtttgttagtttccttttatctttaggaaagtgtgtttagtgtccgataaggactttatcttttcctttttagtttctttcttgtccgacaaggacttgtatcaacccatgggtataaatatgtacacccggggtctatgtaatctatctctatgaccaatacaattcggcgcatcgccaccttttaccttttctactttattttatcgcccagtgggacttggcacccgacgtggggctgcatcgtcttcgatctccggcgaagggataagtccaatgttccgtcggtccaggcaattgtatcgtctacgttggtgtcgttcaaggctgcatcagtacattcgacctcttggattactctgctttggataatatatttgcctacctatttatcatatgtctctgttaatctagtcttagcatatcaatttagctctatcggctgcttcccgttttagggtttctgccggtatcggctaaatcgcgttgctagattagattagcttagacatctaccaccctgaaaactcagtcaacggcttgattgtctagatattatgtttctttttatacttagtgctgcatcagttaagtttgatctactaagtcgtgcttagaaccataatctctagcctgcttcttgattgccaataagggtttcatcggggtttcagtcggtgagttatctagacgttgcatcagctcataaggattgcatatacatataagttggatttagccgatgacaacaaaggcttcactgtttaatctagtcttgtggatttcatgacatcggacctccagccgatgtgtgctttgaccttcggatcgatgtttatttatcatatcattatttgctgattggtttatactggactatattattgttatattttattatcggtagccgattgcctttataccattatctacattggacgtatagccgattgcttaaaccctatcgctatcagctggtatcggcatcggctattatcggcatcggcttgtcagctgatcggctgttttgatctactatttgcatatcttgtcagttgcaggatcaaactgactggcacgcccgcatctcaacaacctttggacctgcactggagctaagcagatctcccaggctagtgtgttcgattttttcgtcaacactcgcgccccccaatgcgcgtggcgaactggcctcgagcgctccggcgtcgacctgaaaatgatgcgtaacgacggctgaagctcctcctcctcctcagacacgggccccctccccaaccacgtccgtcgcgagaccacccccttcttcctcttggactagccgccggccgcgcccgtggcgacctcgcgaaggctgaggaagttggcggcaggagcagggggctcggtggccactagggcggcggggttctcgcgctcctcctcctcctcctcatcctcggtgcactcggtgtcctccgccgtgcacattccttcgtgccaccgctccctgctcgctccctccccgccgcggccgccccgcgccatcatcgctggaatcatcccgctcgtcgctgttgtgccctcaccgccacacccttgctgagcgctgccaccgccgaacctgaatccctgctactgcagcagcggaggcggcagaggcgacgcgaagactgtcggctgccgctccgtccatcgcccaccgtcgccgccgccgatccggacgccactccccacgcacgaagagaaagagggagagatagagaagggaggaggaagaagggataagagagggtggcatgtgggacccacatgtcagtgggttccacaatttttttttggtgtgaatgacaaatgggtcccgcatatatattttttattttaatgccacataagcaccacgtcaatgccacgtggaacaaagaccaggtcaacactgccacgtgtgagtcatgtcagcgaaaccgccctccaaaaccaccaaaggagtcaaattgcaccggttttgcaagttcgggggtcaagattactgatattgcggttgagggatacgatttagattcggtggtcagttgagggagttaaagtgatcttgttccagtgagagggaaatcacatgggctgctcaccgtgtgatgatctcatcaggataaggcccaggataagttactcggaatgctcgtcttgaatgcaatatattgggaggccatggaagtgaatttttgtcccttgaagggacatcttctcgttttatacatgtcgttaaaaaagttatcaaaaaaataaaaaaaattattaagatagatcaatatatgatatatcttgccgcaaacatgcgagttaaaattcgacttatacaattcgaaacaaaaataacaaatttgaccgtgaattacgcgttcaattcatagtcaaatttgttatttttttgtatttgtataagttgaatttgaattttcatgtttatgaagtgacatatcatatattgatatatcgtactaatttttttaaaactttttatgactttttaagtgacacgaggggatatcccgatttgagttttccaggaggccatgcagaatcgcagatacacatataaaaagaaggaaacaatgaaaacgcacagacatggttaaaaatgcataataaatgaatcaaacaacaacaataacaataataaataataaataaataacacaatttttcatactaggaaatctggtatacggatgaattggactgtactatatatatatatatatatatatatatatatatatatatatatatatatatatatatatatatatatatatatatatatatatatatatatatgtatgtataggatcaggatgtgttcctgccgaccggccggttgatcgacccatgcatggacagaactgatcaccacacgcatatactctgtcctgcgtgtaaaccagctagcatgaatgtcatatgcacatgcgcgcgcgcgcgacgccgcgacgcccgatcactcctcggagagcttctcgagcagcatccgcatgagcttcacctgcacctgcaggtcctcgatgtggctcgccgcgtcctggaacagctcgccgagcccgcacggctcgcggcggcagggcaccagcctcctcagctcccgaacctgcttcaccagcctagggtcctccaccacgccgcccctctcgctcccaccggccatggaccgtgccgccgccgccgccgccttgccgctatgccgccctttcatcctccgatcctcctcctcctcctgatcggctctgctcacagcttcttcagttcttctcttctctctcgcccagcagcgagctaacgaagcaggagcgcagcagccagcgaggacgggagaggccggccgcatcactcttgcgcagtagcaatgagtgcgcgcatatatagccgcaatctttgtttggatatatgcacggattgatacgatagaacgtgcaggcgttagctgatcgatcgatcgatcgatgatgatgatgatcaatcatggcgttgccggtgcgcctccatatgcgcatgtccgtggccgtcaccgcgaaccacctacaaaaggatacgagcgcggcttattctaatggcgccgttgctgcggttggccagacacccgccgattctaatagtgatcctagctaggcaagcaacgttctactactagtatattgcttcgcgccgcacacactcgatctctccatcgatcgatccgtcggccgcgcccggcgccttcgcagaaactaagcagctcagctggccggacggacgacggacggctggcttgcacttgcatgtcagtatgctgcatgcatatgcatgcatccgcttggtgtagctaggcttgtagcgtagtgtatagctaggtagccaccagttttaattcattcgctcggcgttgcaacgagaggggaggtctctgcacatgcacccacatgattcgggctatgcgcgccacgccgggccaacaaaccgaacacacaccaactcaggcatatgaatgcaggcattcattcatgcatggtgcgtcaatcgctcgcctttgtgcctaactagcgaagcgagcgatccgtacgtggcgcccgttcgtcgctgggaacaccctggattattcgcccgcctactgcacctttctgttccttgcaccgatcgcgagtatattttagcacgttaggaaggaaggcttgggatgggctccttgggatgggctcctaatcaggtagccctcatgacaccgtcattccagctcagtctgcgtgtactgatcatgtagtgcagttttagagcgagctagctaggtctcttcttgttgcaacgagagaaagagaaagggaggtggtttatattagctggccaattaactttgctgtgcattattggacgacgtctgtgctcaccttccggcaaactctaaacatactgctaatataagtgaagtttcgaagtcatcatgttatgttcggaaaaggcaaccggttgttgagttgatcataataatttgggccctgatttttagctgattctcaactgaccaaaggccatccagaagcatcggcagggcagacattagtatttcgcattccgaatgcaagaggataaagaaaacactacttcatttggtgccggttgagaaacctccatatatagatgtcagatatcccaacaggcgccatggaggtagtattgatgaggatgacttaaaggtgggtgctggtttaagaaccgatacctttgagttatatggtttgcaaataaaaaaaagccagctcggctcaattcgagccgaaccgatgcttcaaagcaaaaaaaaaaataaatcaaaaaatctaacaaaaaaaatacaagacacataaaagaatcaacatttcatagatcacataatcaaatattcacatcagagaatcaacaagtttgtggaggaagataacaaaatcaaatattcacatcaaagaatcaacaaatttgcggcggaggagccccagcggtccgccgtggcaacgtcacggggtagcaggagcgccttgaggagcagtggcgacgagcgaggcgaggacggcgacggccccgtatggccggtcctggggttttggggccctaggacaaaaacttatatagaggcccctatatatatatatataaacataactaatatatgtatatttatatagtcttataaacacacaacattcgatgtgataaaattatctatatataacattttaaaaaaagaaataaatagcagtaccgagctgagaagacgaccggcgaacgatcgacacgagcgtggctactggtgaaccgtgattctccgacttgctgtttccgtttgtgagacaccgagaagtcgagaagtcaccgagagcgcaggagcaacgagcggcgtgatgtgatcaaggcgacatggcgagtggcgtgatgtgatcgaggcgaagcgactggagtcagatgaagagatcgaggcgaagcgactggagtcagatgaagatcgcttcggctttgctaaaataggcctgacgatggactaaaatttattttctgtattggactattcagttgtctagcttaatatagacctatgacccatggactagaattatccaatacgtagtatatatactatatgtgtataggggccccctagattttgggggccttgggcggccgcacggcctgagccccctccccccaagggccggccctgtggccccgtgacgcaagaggcatggttgacggtgacgggcgccggcactcctcctgctccctcacacgacaaggacgacggcaccgcgttggctcggccacatcggcattgtgctttcccttgtgagggcgctgcagcgtcagcgtgcagcgaggggggcgaggatggcaacggcgccgtggcgcaggaggtgtggttgacggtgacgggcgccggcactctcccactcccccacccaatgaggacaacatcgccgtggggtgcccctacgtcggctcaaccccgtcggcaccacgcttccccttgcggctccgttggccctggaggcagaagggaggaggcggcatggtgaattacgactagtgatttagggaggagaagagacgagaagggaggagaggtgagggaggtggtggcttgggaaagaggaaggaaagggagaggagcacgggctggacgagaaaggaaaagaaggaagaaaagagaataagaagaaagcgaagagactgaagagacaaggacaggaggacgggagataggtatctgttgtattaaaaaccagcacttttaccttgtataaaggtgtcgttttttaatagaaattgacacctttctttgacagaaaagataggtgccggtaccatttaaaaaccgacacctatttataaaaaaggtgtcgatttttgccattggcacccttgcgagtgtgcgtgcgtgtggaaaaaacattataaatgtcggtttagctattccaaccctatagtgccgtctcctttatggctttcttagtcgtcaaatgacatatgaacattatatatacataactgttaaccttaaatgaagaacacattaaggtggatttatgtcgtatcctctaccattttaatccatgttatgatttatattacccttcttcttcgatccagctccaacgagatgacgatgtctccgacgagatggcgacggtctgatcagtttgagtttgtggttagggttaggatgagagggattgcgaaagaggaaagaatattgttggccttaattagagggatgtcaatcagagatggtggcgtggtagtgggagaggcgcgcgataccaaagccatgggagatggatgccaacgatgggctaggtaggcaacgggatgagggatgtcgttcggtgcggataccaatcttcaaaggaacaaattattcattgatgtcactcgaattacaaaacttctagttatgtacctaatacagaagaacattcagtttaattggtatttaccgggtatttttgcttaagccgaatttgagttcacagctgagcgtggtgttgcgccacgcattctcttctagtgtgctctatgcctctagttaacatataagcttataagtttcaccgcgttagctagtactaggcttttgtttgtcaagcttgtattagagagacatactcatggtgtatgtaataatgtgtgacaacgaaacgggcatatgtagacaaaggctttgcccaatgaaattattggtaaggagctttaaatcactagagaagtatggttcaattttcagtagcatcggaaaaaaaatccaaaaaggaactcccatcatacagcacatcggctttgcaagaaagccaatggacgaaacaaattaaagtctgacaattaacatctccgattgaaagatatattgcaaattctttgctggataatactccatataagaatgttttctaagggtcagcgttatacgggtattcccaaattacgcttctgttcaatgtatcatattttttttctagctatagtatacattatccttgtactacgagagatggctctttgtgcttccctacaagaaaccagtgatcaagtagcttatgattatgctccaatgatgcccccttgcatgtacatacgcgtgcgaacttgacaatgtctacgtaaacaaacagctgcagagttatataatacctagattctcattgctaggataaggatgtgggtgggtgatcatctcgttgcaacgaaaatatagtttagttagtataagagctcaaagaggcagcatctgtag

SEQ ID NO: 16690 - DNA, 3466 bp, Oryza sativa
  unsure (1)..(3466): unsure at all n locations
cgaaccttcttncttttttgatgtgggatcttattttagtggtactaaggatcatcatgatcaggctctcagaacaattctcatgttgcttctcttgattcgttgttttctggcacttgttttgttaggatctattgcactgcatggtaatcgaaactacgtattgtagtaaactatgtaaagataaaacaagcatattaaatatgtaacaatatcttctcaataggtaagactttagttcgtgcacaaatctgtcaactatgagatcatgccgtccatgagccacgacaaccaacttggtactgtattcaatgctatctctatttttgtttacatgagtttgaccaatttctgggattaaaaaaatactcgccacgataaccatgacatcctccaatgttcatttcttaattttttttatctgcaactgaaaattcttaaagggagcttgacccaaagaaatccttactactattttaagattttaccttaaggcacatgtcgaaccttcttcctttttggattgttgatcctattttagtgttactagggatcatcatgatcaggctctcagatcaattctcatgttgctcctcttgattcgttgttttctggcacttgttttgttaggatctattgcattgcatggtaaacgcaactacatattgtagtaaactatgtaaagataaaactaacatagtaaatatgtaacaatatcttctcaataagtaagactttagttcgtgcacagaaccgtcaactatgagatcatgccgtccaagccacgacaaccaacttggtattgtattcaatgctatctccgtttttgtttacatgagtttgaccaatttccagattaaaaaatactcgccacgacggttacgaatgtgactatctctcttttgcccttcgtgcgtccataagaaagcaaaagtaccacacacgctaggggcattctggtcatgttagacaaaacaactgcatttttcatcagattttttttctttgcacctgaaaaatttcaaataagggactttgacccccacacaaaaacatgtctttgcccttttccttaggttggaagacaagccgagctttctcctttttaaaaaattgcttctcccttctgtacatatccactatcaggcccttccaaagttccaattccattttcaaataatttagaaccggaaccaccggactgaaaggccagggccactctgtgtctgtctcactgttcgaactcgagaagagaagagaggagacactggccgtggcaggcatcgtagtacaagaggacgacgcagcgccctgacccacctaccccaccaccacacattccattcccatttccattagccccaccccaacccaggcccgcgccgaagcgaagcggagaccagatcaccaagagaagtgcgacacacacaccttctcgccatcgttttcaccccctcccttataaatactcctaccgcccgcctcgcctcgtctcgtctcctttcgtttttttttcctccactcctccgcctcttcttccgccgccgcgacgcgccgttgataggtctacgacgatgtcgccgccgacgaacggcgccatctcgctcgcgttcccgcccatggggccgctgccggcggacgcgctgatctacccgttcgacggcctctcctacgacgacttcgtcctccctgtcgccgccgcaccgcagcatccgctccccgtcgccgtcgccgaccccgcgcccctcctcctcctgccgccgccgtcctcctgcacctgcaacggcgccagcagcggcatgggcgccgttgcgccgcgcacgttggctctgggcgccaccaccgacggcagcgtgatgacccccaccagctggggcagcgacggcggcggcggcggctcctcctccgcgcgggccgtgcgctcgccgtcgccggtgctgccgctggtgcagggcaccggccagaggacctcctgctaccgcggcgtgaccaggtaatactactcctactaccactataccacgcgcgtagagatagactagagagagtgataataataagtgcatggttagggagtgtgattaacgactaatcgccacgtgatttttcacacgcgctaatcacgaggaccgcacgtgtggcgcaggcacaggtggacggggcgatacgaggcgcacctgtgggacaacacgtgccggcgagaaggccagaagcgcaagggccgccaaggtaatttactaattaaaattaccgctaatcaccattagtccattaccctttctgtaccgtcatttttctgtcaccgatcgaggaggcctcgccggcggggaggggtatcgacggcggcgaggggacggtgatgagttcgccgtgatgggatgggatgggatggggtgccggcgccgtttcggggggagatcgagagacgggtcgcgtcggccatcgtgtgcatcaagttgaggtgacattagcatctccgttagactcgcaacagttcccggattctctgcggtgccgggccccggtgggtcacccctctttgaccgtgcaaccgtaggtagggggtattgtagccgctgcctagtatacctctgtgttctgtctactactagtagtatctcttttttttttaatctttcttgtggccatttctctgatgcaatagatcggctagagcctaaagcgatttagcaaggcgatttatgttggttaatcttgtaggcgtggagattaactggtcccgtggttggtagagtgacgtcgtgtatctgtatgacagctttgccatggcaggactgctgctgtggtgcatgcagcttttgcttttttcctggttttagtagtagttcatgggtgatgtactgcatgtttagatggttttatttgggtcagtttctttcttccttctattgcaagtctttcttttctccttttttgttttcttctgcattacacacggcgagagtttttgtttctgaaaaatttattacgagtcgcaactttgcaacgctaccagggttgtgtaggggacagctaaggtgtgaccaaaagtggttttggaacgcacgtttgaattttattttatttttgctttgccagttacgactccagtagagttgtttctactgtccgtccttgttgattggcatttggcaacaaacttttgtactttactcgatacgcttgcagagttgcacaggtagacatgcgtgctactggtgtctacgacgtcatgggctcatggcctcgagccaaagcagttccagactactgctgaaatagcaaagcggtctaaagttgcgtcgatcgatagtggagatgtgattattggccatggcggcaattccgcaatagagagtgtccacgatcttgtatgatatggctgcatttcatatatcaatgcctactatatgagacacccagaaatcagaattccacggatcaatttactgttggatatatagct

SEQ ID NO: 16691 - DNA, 1148 bp, Oryza sativa
tttctactgtccgtccttgttgattggcatttggcaacaaacttttgtactttactcgatacgcttgcagagttgcacaggtagacatgcgtgctactggtgtctacgacgtcatgggctcatggcctcgagccaaagcagttccagactactgctgaaatagcaaagcggtctaaagttgcgtcgatcgatagtggagatgtgattattggccatggcggcaattccgcaatagagagtgtccacgatcttgtatgatatggctgcatttcatatattaatgcctactatatgagacacccagaaatcagaattccacggatcaatttactgttggatatatagctacatgtaatggtatattttactgtcagatggtacatatatgctgggatatcagtacaaaaaaatctatcggttgatccgatcatccgagattagctactctaaaatcacgtgcatagtgcaaaatgcaatttcatcaagtgaacattgcatattctgctgtttggttgtgaactgcattatgtaataagtaatacgtattacacaaataactccttacacatgctgatgcattcatatgtgcagattctatcgttagatttgagccacccttgcctcttttgcatcgtgcaagcaaaactccagttctgaggagaaaaatcattgcatgcaattaaagattccatacatataattgcatttgggaaataatatatattaacaggatgaatcacgtgaatagaaatgttgggggcattctttgttgtgtggagagatacattgctttcgagttatgtaagctagcatcctcttgttgctgtccttttattttggaagatatagttatcttaatttttgaaaaagaaaaaaagaatcatgccttataagttatatgttgataaaggaggagagtttgtgtgagatatgtacaatggggttttggggatcccgtaaacctggggggaaaatgttatcttaatttgcatttgatgtaaatgacatgctattttttttttctgaaccagtgcagtggttccttttttttttttaagaaaggactaccagtggttccatgatagtgatactatgacatgctgcttctttgcattcagtgagtataattttgttaggatatctcaatg

SEQ ID NO: 16692 - DNA, 1666 bp, Oryza sativa
  unsure (1)..(1666): unsure at all n locations
ttagtggagccggaagcatatgatctagctagttgtgcaaatggagcgtgcaagtcagagatagtgattaggagctcataactcattgacgaattcagtcgtcgagcgcccggcctcctgcaaatttgtcaatttttaaacgttctcactgtcaatcgattcaatttcctcctgtgcctcgtgctgatttttttttcaattaaatgttgtcactgttgattcatttcctcttcttccaaatgatctgagctgtactgctgtgcctagtggttacagtgacctgagtagcaccctaagatcccgagttcaaatctctataggagcgaatttcagatttaattatttgagggctaagtagtcctgagtttaaatcttcatatgaacgaatttcagattgggttatttgagatctaagttatctgtttgctagaaaaaatgatctgatcagcaggaaaccactgtgctgtactgctgtgactggtaaatttcacgagtgacggatcatttggcaaaaactgaaaccaactgatgaaggattacgcgagttctgaagatagaatgacgcaatgatcgatcgcgccgccatacaaggagaacacgaaactgatgaccttcacaaaacgcatactttagcaacctatggactggactttcacggtcaatctttgtccggtctgaactctgaagcagcagtattaggttaggtgagacgaaaacgacggaaacctctgcgtctcacacgccgtaaaaactcaaacggatacgtggatcgtgaaagggattggtaaggttttcgattaatcttaccataccaagcatggacggcggattcagtcattcagagattggatgcaattcttttgcttctgaattttattattaatttttttggacgccttcacctgcaaatagaagaagttcagacttcagagcatggggagaaaaatgttcttgcacatgggaaatgagatagttatgcgttgagctttaaatttatgactgatgggcaagttttttcttgcgattaatgaaatcatttaagttcaatttggagaatgtgatacgtttgcttaaatgatgcttatggatgaacggaagaaacgagtgatgataagttaatatatgtatggaaatgggggtatctgaattataaggtaagtatggttgtaagtgactaaantgatagtgtaacttatctgtaaggacatggattgtaagtatggtatatgatctagtacagggggttgatttacaggatcggaagttcgcaactgatggttgtgatgcatcaaacgggcttgggccatacaggtcgcaacagtagttgggcggaaattcattggcccacataggtgtcctcgctagcccgctctgctcggccgatggntacggccctgtcgccttcgttcggtataataggtgggccgcagcacaaggaattgagagaggatttccgttcttttgtgggcccaatcctgcagttagtcttacatgggccgtgaattgggatgtgggtaggctaggccgaccaaccgacccagccgacaaagtatggggcaaaagcccaaagctgcatgggttaacctacaaaatttagggttaattcgatcatgccataaatatgtcatttcagataaatgatattataattcatcattcgtagctg

SEQ ID NO: 16693 - DNA, 631 bp, Oryza sativa
gtggcgaccaccaccttcgggcactccgggatgggcgggtccaccgggttctgcgacgtggagcacgggctggccatggccctgacggtgaacaagatgtcgctgggcggcgtgacgcggcgcgtggtccggctggtgtgccaggagctgggcgtgccggtgcccgacgagttctccgtcgccggcgacaagggccccgacatggtgctcaacctcgcgccgccggagtagcaccaacctgccaggccactactactgacatttcatcatacactttgatacatatacacatgtagctaggtaagagtaaactcatgatgatataacaaaatgaggggaaaaattaatgttctttccgggtatacgtattagtacaatatagtagtacaaatttatgccatttggatgtggcttcgtcatatatactccaaattatacatgtatacaagatttttgtttcatttttcctgtttacatttgcaactgtgaggtgcccagtgatgccatgttggaaaattcgaatatgctgttgtaaatgatttgagattccagattagaacccgtgagtctgccacagatgtctgaatctagatgaggatgaactcagcgcttgcaaaacctgaaagataat

SEQ ID NO: 16694 - DNA, 733 bp, Oryza sativa
atcatgtgtaaattgcgaatagaaagagtcactaaattttggtctgaggacgggctgggttaattcccaactttttttattactttcaatttttctattacattaaaatttttatacacacaaacttccaacttttccgtcacatcgttacgatttcaatcaaacttctaatttttgcgtgaactaagggctggtttagtttccaactttttcttcaaacttccaacttttccattacatcaaaactttcctagacacataaacttccaacttttccatcacatcgtttcaatttcaatcaaacttccaattttagcgtgaactaaacacaccctacatccatcacatgaataaaatcacttatattttagactgaagtagtactattaaattatgagatgaaccgcagaagtaacaatctttcactgtgagatgtggccggcggatccacaacttcagttgtagcgccagtacagcctaggcatcgcatttccggggtgtaggtgaggtatactaaaaacgggggagctccaaacaaggagtactttgctcatgcagcgagcgagtgatccgatgctagtggccatcattagggcagtactacatgcaggccataaccacggtggtactaccaatctagcatactcctatgcattgagctatagcacaggcaagcaagcatgcacgttcctcaggggcatccagtgatgagccactaacactaacatggagc

SEQ ID NO: 16695 - DNA, 6687 bp, Oryza sativa
  unsure (1)..(6687): unsure at all n locations
aatcatttgtgccctttgctcctcaaataatgccggattcctcccctcgaagacgtacgtgcttatcctgtcgatcgatcacatgtcgttttctttgagtgaaacaaacatgttttttacgtacgttagtacgtaccccggttcggtccaaataaaactatggatttaccccggttcggtctaaataaaattcctacgagattctgtggatttagattattaccgctcaacacgtccttatctctgtctgtccaaattaaacacgtgcagtgccatgcagtaaaaacttgttaaacaggttggaattaacgggagtatatggtcattaatttgattgtccgggtaaaaatgatgcgtgcatgcatggctgtgtccttgcagatgctcgcccccgttttatgaggcggctgcccaaccttttaatggccgccaaaagtcaaatgctcgtctcggtaagcgtaaactaagctgaaagcaagccgcgttgtaggtagccgtcgcgattcgactgttttttaagccgtcagctagcgtgctctgccaggccgggccttgttttaaatttgaaagcctatctacttaggctgcatgcttgcttgtttgcttccgtgttagcacgtactaagccgctgctaacctctaattagagtcttagactgtgtatttactagtggcactgctagtacaaaagtactaccagtgctgtgcacttgcgttgcaaacagggggacagcttgatccacagcttagctgaggcagaggcgatggtaaatgcatggtgctccttcaatttgttttgctccatcgtcacacactcgcagtgaatcagggataggctgttgtaatcaattatggtatctccttgcagtgtcgtctgatgttgtaaccaaccgacggcacagatcaaagcaccaatagaaaaccctgcgccttttccctatggcctgcggctctgcatgtgctcccaccgggtgtatcggttgactgcagcagatatatatcaatccacgggcctgtgccgatcgaacgcagagacgagacgagacgagacgcagggtacgtgcctaatcaggcacggggctgacgcacgcatcactcgctcaccgccagttcaacagttgacaaattgcgtgcgtatcgtgcgtccaagccaacgcagatgtgtgcatgcaatgagggatcaaacgtacactcgattggttggtaggatcagagagacgcaggcaggcaggcaggtgaagagagatcgatggccaaattccctcctggacgatgcccccacatacgccatgataacgcccgcacagtaactagatagtagtagtagtacccagtaataattcagcatgcatgctgcaggaacacatgagccaagtaaaggcaaggcaaacgcactgtcatttcgtccccagccgagcttaatgtaagacagtgaagagaaagagatggggtcagatgcttgcagctatatgtgctttggttggttcgctgtacgtacgagcgagagcgatcaatcgcacacgacgaggacggaccggcgcttgtgttcagtgctcgtctcgtgtagtcgtgtgtgggggcgcgcgcgcgcgcgcgcagcgcgggtttacagctgcatcgatcgaccgagtgcatgcgcctgcagcgatcgagcgcaaacgcggaaacgcgcatgtgagcacgcgcgaggacggagggtgcatggcagcgagcgagcggacgctagctgcgccgcgccactgcacggcgcgcgggccgggtcaggtcgtgcagccgcggccgtacgtgcagcgggacagggggggggggggggggtgggacgagccgtgctgaatgaaaggctggcgcgtgtcgcgctccaattttgcgaacgcgcgagtacgtgctccctgctgtaaatggttccaaagcaatcgacccggacctgatcaagtctacaatgcgttaccattgcccactttttggagatgtgaaagtcgtgcttttgtgcatgtcactgtctagctaggattcatgagaattgagaactgatgcactgtttattactacttcgtatgtataagagaaagctcaagcttggtggaatatttgtgttttctgtagtgaaaaaaaacagatggatatattttacacgaacacatctagagaccgtgaaaatcagaagaaacaagaacttgaggacgcggacgcccgagtcgcctccgctcaggcgactcgggcggcgacccaagccaccgccaccgccgttcttcccccctctcctctacctcgccgccgcctgagcaaacggccagcaaagccagcagcttgctaggatggcagcggcggggctcgtggcggcggccaccctagatccggcgtgggcggatctgagggtggaggccggtcggagtggcgccgtcgtcgaggccggaggcgtgcagggcgtgcaggcgacggcagcaggtggacgtggtggtgacacgcggcgcaggggcacggggttggcggcggcaggcggaggcgaagactggtggcagggtgtgggccgcggtggtgaaggcggcggcggcggagtctgcgacctcgggcatcaccggatccgcgtcggccatcgccggatctggagccaggtgcgggagaggaggcggggtggcggcggggatgcagtggcggcggcaggcgacggggatgcaggcggcagcgggagcagaggaggcgtggctccggtgatggtggcgcgtggaggagcgtggaggcgaggccggcgcggcccgtggagatgcggccggcggcatggaggccagttcggtggcgtggcggaggcgggggtctggtgctgcgacaggaggcggttgcgggaggccctttgtcggcgcggtggcagcctccaactcccaccggcgtcttggcggcgatgcagtgaggctgtgggcatttgtggcgacggtggctagccgagtttcgatgaccggtcccttggccgccttggccggttctggtcggtgcagcagatgagtgtgggtgacggtaggttgcctcgagggttgactgcttgtgagacgtcgtggactatcgtgtggccgtcgatgtgagggtgcttgtgggtaatgtgcagacgctggctaaagccttgccgtgcctttggccggttcgatgacgacgacgccgttggcaccgtttcccttcttgaaggcgttgtcatgacgctctcccatttgccccacaaatctccgggtgtaaaccttgctccagcttcggacgagcggcggtggcgttacacgtcgtgttctccggacgagcggcggtggcgttacacgtcgtgttctccttgggggcgtcgcttcggagaagttcctttacatcgatgatattgatagtctcttcggttcaaaagctttctttccttggtgttcggcgaggcctaagcctcttgggtccacttcgttctgtggtgggcgacacactcttcggttgcttatgcggataaagttggagctgctcgctgttggggtgctgcgacgcttggcaacgatgacgtgttgtagtctctttcaaagagttggtgctggctatgtgaaggaagtggctctttggtggcttggctgatgtccattgtggatgtcggagctgctttcgctttggcggctttcgtggcttcagtgtcgctgcggtggtgaagtcggcgctgctgggtcgcttgggcggctagctcggtaacgataacacctcttctgtgatgtcggagctgttgtgccccttttgtgcttagcatggcaacgatgtcctgcatttgggctccactgttgttgttagttgtgtagttaggtcccatgctttcttctgtctgttgggtttcagccggttctccataattaaccgtgtagctgtatggttttctggcctgatttctcttataaactgggtcattgtctcttgtttatacagtttctccctctcttaatataaaacaagcaatgttggcttaggttttttttttaaaaaaaacatctagagaccgtacgcgcaatgcatgcatgggaactggaagtggaccagcatgcagctggtctaccataaaaccgaaagtacatgctcgtgcatatgcatgctactcgagggcttgcaagttgaagcttgcaaaagcagatatcttttccccatctgaaataaaaggaggacaggcacacatgcatccgctctcgatcgatctgttgcatttcaccaccccctgacgttttaatgccttagccttcctcctgcacgtaacgttcgtacgtaccccgcgctgcgcgaacgtacgtacgtacggcgcaccaaaatcctcgcgatcctgggacatccgggacgctcgcggcctgcgttgttgacgaggccgccgggtgggcgagacgtccgcggggaaagcgggtgtctcccgcggaggggcagctcgagcggtaccgcgcgccgagcaggttggcgggttaggcaggcacgggcacgagccgtggccatgatgcgcgcggaggcaggggcgggggcgtggcgtgcgcacggcagcgcagtgcggtgccgggggggggggggggggggggttgtttttnnaaaatacttgccaaatgccaaaaccggtggctgtgggaacagcacgcgctgacgcggcccggcggtcagcccatgttccgtcagattctgccccgatctgggtgtagtttagcctggttctttcgtggtctctggcttctccacccgttcagtgcggtgcgggtgggtggtgcgcctgtaacgacctgtttaccagtgcagatttttgggggtctgcatcatgcacgtatactggtatcgtcgttgttgtgcaggatatattgggatttgggaacaacttactattgctctcatcggatggcctaaacagtcagagagtaagctaaattttaaatttttaaacttaattttaaaattgattttgagatatttttaatatagttttttttcagcattgacttttaagtcatcaagaacatatatatgaaagttttacctataaatttatttttattccctaataaaccgttttggcttattagggaaaaaaccaaacgattggggcttatactttttttagccatgtgaatgaggcaatctagcgagccgtctgcacggttaaacaagcaaagggtgttttcccatgacaaatctcgttataagaaaaacgctaatctcgtttgagttagctacgatttttgtaggcgaatatattgattgtattgaggttcggggaaacagaaggaaagattcccagtcagagtcagtttaagtaatcctatatctgcatggtatatacggtcatctttggagtttcttgacctgactcgaattgggactctcgcaactcctttttcttcaaggaaacaaacaatgcgacactcccattaacctaacccaatgcaaatgaaccatacaacacctggctgcagcctacttgcaatgcttcaacctaatctacccctgccctataaacaagccagtcaggcgcccaagcgaaatatacgcatgctgctggccctccatgaggccaatctggccaacaaatactggagtttcatcagtgcccatttacagggcagcctctggtccgcgtctgcacacgagataaaggggaggcggagtggagcacgagctcagtatctacagggcgcggcaacaccgcctgcctgcctccctccaaggcttccgaccccaggagccaggcagagggggaccgggccaccgccggcagatgccatgaaaccatgtggatcaacaggtcgttcgaacagagctcactgtgcttgacaaacgtttgcaggacggctcactcgatcaccagccgtccgtccgcttctggggctctcaatggacggccccgatttcggttgagcatggggaggcgcgcactcaagatcccgtctcaactagctggtcaggctagaaaaaagacatcctctcttcgaaagagcggcaacacgaaaaaatgcaaaggttttgtccgggtgatacagcccgtgactaatgggtgatcaggttctcacgttatctaatgataccaccaatcccaacagcaaacagcactgtactgtactgctgatggagcagcgcgcatgatggccagaagcagtattcgctggctttgcaaatggcagccatggtgctgttcaaacacatggcagcgctaggacctaaaccatggatactgaaggggacgtaacattaacaatctgtcaactggtcatctctcatctctgtgtgtcccactaagattaataggccttgatctcagtcttctcggctggattccaatcagacctaaatctgtcatcttaatcatttggcagatgcatttgcagattatgaaaaggtagtatgagccaatactggtagtagaagacgcaaaggcaaacaagatgtgtcgtctagtgcctcgtatcatctgaatccagaatcgcagaagctccggcgataacttttggccagcgcagaatcgcccctcaatgtgcatcatatgaagacttaaatgggataccatgctctccaactggcccatgagttatcacattccaacgatgcaatctgatccccattctccattgacatctttacaggcgaacaacggtttgcgtcaaaaaaacaggggaacaacggtaagataaactgatagagatattataccaataaaaatcatagccg

SEQ ID NO: 16696 - DNA, 5858 bp, Oryza sativa
agaatacattattataatggacgcggtgtccactggcaaataaccacatttagagagtgtttttccctaaaagtaagtttgtgcggtgtcctatagctaaaaccataaaatcgtgatgtcctgtagcaaaatttgcctacaatttattgttctgaaataaacaatactatcctaataacaaacaattaaccatgattatgctacattcgtcactctagtcacgtcttcgtgagacctcgagtagctgccggcaatcgctttatcttctaacattacacctttgttctttgtgtccactaccttgagcattttgcttaacccaacaatctcttcttgaaagacactcaactatcacctcaaagcatataggtagatgaaacactcaaagccaacttgttcgttacataaaattatttgagatgaaaggatttacagttccaagggtgtcctgtaattaaaatgtaaatcagtcaacagtcaaaaggttcatatctcttcaataattatagaaactaaaactatgcaaaatggcaagtaacttcatgagcattaaacgttgtagatatcttgtaggatcatttgcattgtcagatctctttagtcctggatcacattcaaaacaatgtaactctagggggaaaaaaggtaggatgctgagcaatatgaaattttcacttgaaaaaacagattatattgtacatgtgacagtattcatatattggtactataataataagataagataatagaggcttaaataaaccgtcaattgtaaaggagctgacagcacggacatgttttaaacccaacaggtgggatgagccaggtgcggttcatgccataggagcaaatgagtgatgacacataggagagcctggcatacaacgtaagtactccctcgatccaaatgtgttagacctattacttttgtcaccaagaccaaggagaaattaactcatgctgcatataacaaagaaaaatgagtgtataatacagcctatttagtgatgagaaggcagggagctagctagctacctttggtttgaatgactcagcctatttaccgctctctttgactggtcaagctattggaaatgaaacatgtctttagattgagcagagaactctatgcattcgaagctctcctagaaattaaatagacacctcatgttgaaatgggagcatatatgagttgagcttctgagtgatgagaagtattaatcctatagtggttatgcacaagaaaatttcttttaggagtgtgcattgctttttttgacaagatgtagatgttttaacagccggttttcagttttaagattctttaattccatctgatgttcttactttgtcttgcaggtgactgaacgtagcgtttacttgacggtgtttaggagaacctagtcatgcctggtgtttctttccaggtgattaaaacggaaatgaaattgtcaatatcatatcagtaggggtggctgattgctagtctgtaaatcgactcttctctgggtcaatctcgtatgctcatgtcggcaatgtatgccacgattctataaaacttgatattgaacttctgtttcctacagctgcaatgcccaaagttcatcgcaaattcttggcgagagaaggaaagctaaaaatctgttcggttgtagttccatataaccttagccggaagaggaccctctgactttcttccttctgactttgagtcactgatacgtgagtttattgggtagagggtccacatatcaatgatataagttaaatataagtaggttagagcatctctaacagtctatccaaatttgactgtccaaatgtctatttggccaactctccatttaatttagcaagtcaaattgtcttttactccaacagccactctattcgtcctctatattttgagtttattacaattgggctcacatgtcagtctctacacctccttctccctcatctttctcccattctctccaaaccccccttccctctctcatctgccgccgccgccccatccccatccccaccgccgctcgggctgtgtccccatccgccgccgccgctgctcaggctccacccgtcggtgccgctcttggcggcaaatccgtgcgcacgcaaggcaggctcgaggcgacggcgagggaaggccacaatggcggcgctagggcggctgacactgggaggacgacggcggcggcgctgtgagggcgacaacgacgacggagccgggaggacgacgacgtcggcactgggcagatggtggggcaggcagggagggagctctcttcgccggcacagggagggagctctcttcgccggcggaggggtggcgcggatgggcggcgtcggcggagagaatgctacgggcggcactggatttgggaggaggagagaggctacaggagggagagagaatagaggtggggcccacgatttagccagcgcgagcgactttggccagccaggctgttggagtgcaaatttgagccaaaattgctataatataacttggaaagtgggataaggaggctgttaaagatgctcttagcggatctcaatctaccttagcagattgggaaagaaccaccactccaccagtaggcagtagcagaagaattatctgcgagtttgttttctacaagaagaataaacaaaacctgcagggcggcgatggtttatcttctcttctctgcatagaagggagtggttcccccacccacgtaactgctactagaaaattgatcgttcgccctgtccttccagggaaaaaaaacgaacagtttctctagaaaaaccagccaatgttttttagaaactactccctctgtttcacaatgtaagtcattctaacattttctatattcataataataataatgttaatgaatatatatatatatatatatatatatatatatagattcattaacatcaatataaatacattgtgaaacggagagagtaaaaactaactgcctacttaaaaacacggcaaaccggtttgtttttataccattagatgacatgggtaatttgctagttactgaagaagtattactactgcatgaaaactatcgtgcatcgtatggtacaaatgcaaacttaaacatagtagactagccaacttgagggtttgtttgtcacaactctagttttagctccatctcttagagcatctccaacagcttctctaaaatagactctccaaacatccatatagccagctacccatttgatttagcaagttaaagttgttgctcgcttcaacagcctccctatctaccctctccattacaagtctataaccaatgggacccatatgtcagtctctataaccttcttcctcctcttccaccccattttccccactcatacataaaccttcctcctcctactggacttgcctctgatgctgcggcgacgggtgtgcgggacgggcttcagcgagcagcggcgaggcgacaggcagcggcgagcggaggccgcggttgcaacgagcagaggcggcgcgctgcgccaagcggatgccggcggctgcggcgagcggcgggggggggggggggggggggcacgcctagcggaggccgcggttgcgacgagcggaggcggcgcgctatgccgagcggatgccgacggttgcggcgagcggcggggcgggccacgccgagcggaggccgcggttgcgacctgcagaggcggccgaatgaagacttctccttctcatcaccgtcccagcagttccaccactcgcacggcgtgccgatgcagcagcagcagcgagcgtcgtccacgcctatggggacgccgccgacgccgccgctgtcgacttcgtccaccgcggcgggcgctgggcacgacctgttcgaggcggcggagggcagtgctaaagagagagagagtgaggctactcggagggacggcggtgctgcaacggatggcaacgctgctactcctcgccgttgcatcggaagaggtagcggggagagcatttggccagccttggggatgtggttgtggctggctagatttagctagttggggggagtgtttggctaaccatatagcttagccagtgggatggagatgctgttggaggctattttttctctgctatggctaaaatttggcttggagagtcacttacccattctcttggagatgctcttataaaggagactagctagcttcactcagttgagctgggtgcctgggtaaagctctcacaaaatgaactaaagaggtggagctagatttaggctgctccactacttcactctagatttaacttttgaaactaaatttagaagttgtaactctaataaataggtattttaagaaccagttggtcagtagtcagcttctgagaatatgaaaaagctgaattttctaccttctgagtttctagttcattttataggttctaagaatcggaacgataggttgaactgtttaaaaaaacttctaattctggtgaaaaatctcccttagggcacccgcaatggttatctataagctttctataaaagatccatgtcagcatattttcctacttggaagagattaaatgaaaagagagagagtaaaactatctactaacttggagatagtctatagataaaaagaggcaattgatgagagagctatagatacctatgtagacatactattgaggtggtttactattaatcagtctattgctgagatgtacatgttttataaagagcacattactttaccgttgcgggtgctcttgcgcggccctcgaattcgcaattcgctcggcaggatttcaacattgcggcctactgcttctgcagcccatgatccacacacacactccacagcccacagcccactccatcctctctcccccaattccccatccgctgctcatcagtcgcacgtaccacaccagcatcctcgcacggtcgcgacccctcccgcacctcaccaggtagagagagagacgacggcggtggtggcgggatgttcctgcggcggatcctgagcggcgggggaggggtggcggcgctgcgggcggcgcgcgccgtgaaggagacgacggggatcgtggggctggaggtggtgcccaacgcgcgggaggtgctcgtcggcctctacacccgcaccctcaaggagatcgaggccgtccccaaggacgagggctaccgcaaggccgtcgagtccttcacccgccaccgcctccagatctgccaggaggaggacgactggaagcgcatcgaggaccgcatcggctgcggccaggtcgaggagctcatcgaggaggcccaggacgagctcaagctcatcgccaagatgatcggtccgcatttctccccctcccctacgccccatctccattcctgtcgcttatttagttacttcttgtattaattccttattcctcctactgatctgtcgacaagaatcagggtagttgatgtgtagatgtggccactggctacccatttctttgattcaaccagttatttgatccgatatacaactgatccgtggacaataacatcgtagcgattggtatttgattttcttttggctccctttaatagcactggtagggcaaattatcagcgttgacagtatggtgtttgccagtttgttgattggggagggggggggatggaatgctttttaggttgtctgctgtgctgcctattagtaaaatgccttaattatttttcagcgcttatttaaggatcatggatgttccattttaccttttggtcactaacctaagattttttgtgaactgactggtgcttgtaacttaaccagagtgtgttcattgccatattcaccatactgttgctttgtgtatgtctggtggagtgcca

SEQ ID NO: 16697 - DNA, 317 bp, Oryza sativa
gagtgaaattgctgctatattcttaccgttgtagataatatcctacatgtgaatatgtgatgttcatcgattttttttctcttgtcaggtgtcgaatctcgccttgcggcactgacagtcgacatggaggagctcgagaagctgtcaggattcagaccagccagacgtcccacaggagctgctcagcaatgtcccccagatggccaccggcctacctgtcctcttcaacacgctcaacatccgccgcgccatcctccccgctgccaatggccactgctcggcgcgcgctctggctcgatactacgccgcgctggggg

SEQ ID NO: 16698 - DNA, 8405 bp, Oryza sativa
ttacacattttgataaaacatacaatctcaataaaaagacctctagaaaatcagctaaattaataattaacatcataaagcatatcacttacccaagcttaagaagtcctgcgacagtgctggcactaatgtcaaaatcaacctttggctggataataaaatttccttcccttataggctaccattaaatgaacaaaggaaaaacgtagcctgtcattgactgtctcatgaaaacacaaagataaatggtatgcaaaaggtaaactaacctctcgtattaacagtgcaaatcttccttcacatattcggaccctaatacactcgccttctgtcagctgtccactcaacggtatgccaggaagtcttagatacacatcagtaaaattctggacacagctgcaggctttactagcatcgagtactttcaatatgtcttgataagatacctattcatgaaacaaaaatagataaataatcaccaacgtaataataagatgaacaatataaagctcaaacttacctgttttttactttttagtacgaaaagtgagctttcaggagagagcacagggtcaaagtcattttgaatcttaagctgcaaagcacgtggagaaggaacattgcgtgagtccaaacaagttactaaatacatgataatggaaagccataaatgataaatatatatcaaataggtcaaattcatgtttcttgtaccaacatgagcatcgataagatgtggttctatgtattgctgaaatagcggaaacacggtagtcataatttcactctgagaaatagaaaagcctgcacgattcttgtctctctgtattcttgcaataagatgagaatgtactccaccaacctactagacagaatgcagtaaatttccagggagatatttatgatgtaaaaaaaaatcaaactagataaacagttttttcaagatttgaataaaatcttacaacttttttttgagggtaaaaaatcttacaactgcaatccataaatccagtgatttccttatagcaggatgcaaagcatagacaccttcgaagattacctagtagtccaaaagagtaagataagaaacaatgttatcactgaaatttgaggttgattggttcaaaatacccaaaataaaggttaatatcaaatcaaattttatatgtgtattcgctacatcaaatctaattgattttttttcttgtacagcactcacagtcaagtataacagctatcaaccacatcatatagtttccagtacagaataagtagaagaattaaaataactaactacaataccctgtttttacaattttatgttatcttcaatagagttgcttactacaaaaagaaagatgccctcactaattcttgatttgaagaagccgtttgaagttttaaacatgtacctcactctgatattctgtttgctacgtatagaatattttgcatatggaattcatttaacaccgcgattcaacataagatattattatcgcatatttaggaaaaggtcacaacaccaaaacaacattattcaccaaacaggtggaattccattgactatatgccactatttttagttggcactagattttccctcccagttcttcatttttttttctcgaaaatgcttcatttcattaagaagcagaaatacgtacaacaaagcggtccacgaagaaggaaccctctagaaagaaaaaggcatcacaaaaagcgacgcgcaacagattactcctaggagcagctaaccaaccaaaggaagtgaccgatacaggaactcattgagaaccctggcacaagccgtacaccaaagaacactctttcttgctattgcttgcaagacaaccacggcgctgggcatggccttattgaagacaatcattctggtgcttccgaatttcccatgccactaggataatcaaggagttcaatcctttcttcgtctccttgaccaccttggactaccaactagagaagcgggttgccgaaggttggggaaggcattatggaccatcataagctaatcatgaaatgaccagtgagaccccatatctgagagtggccacaggacacctaatcacactttgaagatcttctgcccaccagagacaatgaaaaatatagtgcctgtagcaccatacaagtgaacaaaggcggatgctcgccttacagcaccaaagagagtgacttggtgtgaatcagagaacgccgccaccggcacatagtataatagaccagtccaggccagaggttaaactggaaaaagccggaaccaacaaccttagtggttcggttgactgtaagaattgttcacgcaattgaaccaaaagaaacagacgttttccgatggaattccagcaacttattgagaacacacaggccgcagttctcttggagtccagctaagatatggccgttgggtctagaaacgcctcttgctaaggctcaagagcacagtgttccaaatatatgcgaaaaaatggttttcccacttgtttcaatggccatctaaactactacgctgatgtgttcaaaggaaatatgcatacaacataaacatccagtcctgcagtatccagctgactggcaaagcaggtcagccggtccgccctttttctattatgcaccagcatcctgctcaaacggcgtgctctgatattctgacttctgttgaacccaataaatgatctcagagctaaattgatgtttccaagtagcccaagaactccatcacaagattctgctttcgcacaccttgattgtgtacattctcatggagtcatggtgatccctagtgaggtcaaaagtgattgaggaaggctgatagagtattaggacaccataagaggagaggtatggtttcaatagacagtgaaggagatgatgagttgggaggagaaaggggacagaaaaatggacagtccaagtaacatagtatgtattacatcatgtgggattacagcttcttaagcaacaacgaatattgtagtataaaaataacccccctccatatgtgacatggtagttaccaaaccaagaatattacccagaaatgaaaaatactgggtcccttctgaaccataacaaaatgtatgtcaatgaaaatatgaaagagaaagatggttatgtattttaccactccacattcctcagagacttgaagctcctcgaatttctttcttttgcacttctcaaagtcaaagcaaggaacttctgctttgtgattctttctgatctccataatgttctgcggggcgataagagaatcgtcatttaacaggcactatagaacccaaccatatgattccagaaaagaaaaggcagcatgcaaaatgctgtggagtaagaataattttatcaccactattgaatgcttaatataaccaatacatatttctggcaaattaatgtcacataataattttctgtctctgttgaattaaaatcagttttgtaaatacaagaattatctggtaatgtggttgttcaccaccagattttgaaccctaaattcaagtgatctcgtatagatagaaacatggttcaagaaggcgctaggtgctagagggtcagcagagctggtgcctagtgcctagcgggcacctaggacataccaatcatagaatccaagaaattatcaagcatattacatagagaaaaatagcaacacaatagcgcccaaagtaggttagcctcctaatgcactatctaatgcctaatcgtggcagctaccaagtgcctaggcggcgccttgcatcgacttttagaacaagatagaaatttggaagcatgcttgaaatatttaagattctagtagttatgcacaggaatttgtaattcacatgataatacagaaaaggaatcaatataaaaaggaatcaccttagtaagcaaacctatatccaatgagctatactcatcatatttataatccctaacttgttcaggcttataataactctccaagcttataacttcacaaccaattatattggccatcttctgagctaaacttgtcttgcctgatccactagggccacctacaaataaacagtgtatcaacttaaacagcgacagcatagtcagtaaatgtaatttgctgggtgtgtgggtcatatcatttttgcacaagtttaacagaattattattacagaatcaatctattccatacaatataaaattcttagaagaattcttgtattcacatacatggactagtaaaaaaacagatggggcgcaaataatcgctcagtaatctgccagaaggcccatttatgtttattgtctgctttagcacacattttcacaatagatggttgttcgccataaataagggacaattgcttatatttagaagccgaactaccaaattgaccctactttttcaggtttgctcatttgaccctgtttttcaaaagcgaagccaccatctgaccctgtttttactagtccgttagggtttcagttagaaaaagaaaaaaaaataattttactcgcatgaactgaccaaaatacccctcatcccaacctttatcccacattggcgtggctggccggcgcgtggagggaccaggagcaggtgagcagcggtgctggcaagcaaagagagggacggcagtgggcgccagcgtatggaggagcagcggcggcggcttctgccgcacagagagaggaagggaggggcagcgccggcgcgcggacaggcggcggcgcctgttcgcggaggagcagcgcgccggcttttgccgcgctgagggagggacggctccagcacgtggcaggaggagcagcggagctggcgccggctgttgccgcgtggagggaggagggatgggcggcgacggctgctgccgtgtggagggaggaagggagggagggccagctccggcgcgcggaaggaggagcggcgacgccggcgcacagagggaagaggagcagcggcgcgggcgcgtgtagaggcggtggtggcgatgcgtggataagcagcggatggtgcggcgctgatggggaaacgcgcgggccggcgcttgctgtgtggatggagtgcgtggccgtgtggacggaagcgtgcaacgcttgcctggctcagccggaggcacaggtcctgcgtgaggcgctcatgtggcccacatccttgctcgctcttgctctacccacacctcctctctataccttgttctactagatctggaagttgctttgctcttgttttgctgatctgattgaataatctctcttgttttacatgtattaatttcacacttttttttttttttgctttggggtcgacacaaatttgagcttcgtgatttgcttggggcaattgttggatgtgaaatagcatatatgcttttctttcttcagcgtgcaattggatggataatatatttccaaagttttattaaaattcagtcatctttgcttaagttatcaaatctaactcaaattcacacacaatttgtcaattccaagtcaaatttattaaaactttcatcacatacaccgagtacacaaaactaagccaaataaataaaaactcagagagtatactcaaaatgagcaggggtataaacggcatttggcccctaagttaacaccgttaggttggcctgatagaatagggtcatagctaatgttcatttttgaaaagcggggtcaaataagcaaagttgagaaaatagtcaaactggtagttagctttcaaaacagcgtcaaacgtgcaattgccccataacttaaatatattacaaaaaaggcatgacatgtagccccagcaactggtacaacaaacccacagagaattgtaatacaagttaatcctaaaataacaggtgtataggaatagattaggcacaacctatcaggcactcttttttgcacagcaagcataccattatagcacattaaaaactggatcatgtgaaatttggagatatagatgctctgatatcactttaatgaaactggtagtcattgcaagtgagacttgtcacaagggatatctggtgcagatgtctgactaaatgattttaagttgccccagcaaagtagagtgagttgttttagttatttatcattcacagcaagcagatgcttggtcttagtaaacacaaaactactgctactttattaacggtaaagatgttattaccaatcccaacaatgacaggaaatcctttgttctccaacaatgcctgaaagacaacaattaatggaatatgttacagatcagtaatgcgtaactgtgatgaaaaaaatagaatgtggtttcatttacctgaattgcttgaactgataggagaagacccctatctaagtcataggagtctggcagtggagctaactggatgttacttcctgaagaagaatctgcaaaagtgtaagaatatattcaatggattttctacagaaaaaataataaataaatatggtttccaatgtactccgtaataggcatggttgggattagggcacttgcgcctatttctagttgtgtatccctggacccaagtggcagcggtgccattgaggcagccacgccacaagggcaggagagaaggggaagactaaatactcttgtttattacttgcttgatgagtaaaatacaaaccccgtcatatagatgtgttagcttgaccattaagaaacctatccctagtattaagaaaataactaacttataagtctaaccttatctctaataagaccacctgacatgaactatccacgcacgaaaattaaccaagtaggtactattaatgcacagtaccaccagccctagagaggcagaccactctatgggccctaatgggctgcacatgatatccaatgacaagagaaaatgccctttgttttagcattaaagaacagaatatgcaaggcaaaaatcataaatgaaagcacaagtttaaaaccttgattgaactgccattttcccataacaggctcctggtcaaactttttgggtggagacctcgtccatggttgtgcaaagtcatcaaaatttgcaacattttcggtcgaaacacgaattggctttggtgcaacaatttttttttcttgactttcagtcagtaatttccttgagattggtggtggcgtattaagtcgtgggacccctgacaaccaacatgaaacttattagtggatagaaattattgaaaataaaaaacatgaaaacaaaaatgttgcacctttgctctctaggatcatttcaaggtatgacttcgtaatccatggcccctttataccgagctttctagcttctgctgcaacaatctaaattatgcaagccagttacatattcattttttttccaaagttcaatgacaacaaacatcaaaataaacctaaaggttgcaacatagaagttttatcgagaacagaacaagatcatttggaattcataaacatattattcacttcaaaagataagggtagaaaatttacatagctataacttatcaaccaagatcaatataaattatgcatcagtcaatttcactgcaaatacataactcaactgaattaaaaaaaaaaccatttcaaactccaatttcaaaattttcttggtaaaactccagcaacctacataactccattgtatgttaatgaattgaatgaattgaagacaattcttctaatcaatgtcgcaaaagggtgatctgatacacctcagtctgcaatatgctttatatgaaaaggtgaaaataaaatgaggaacactgatccgttagtgcacattcaatagaagccagaagtaaccaaagttgtttatgaaaacttcatccacatccttggaaatcaacagtttgcatcattgcaatagcaaaacaatatcttttggtacaatagaaaagtgtgcatatgcatattacaatgacgaggagatagagtgaacaattacaggaactggagacaacgttcagttaacttagaaactaaatttaacagtttaaatattgcagagtaaactaaagtacaagacagagaactgggtcatcataaaaatttgactcttgccacaacatataggtaaatatgtgctatccgaaagtgtataccttcctacttggaccttttagcaccagaaatgtttcatttagggtgtcaatagtctctgctgcaattaataactgatctctgctgacagatgtgcatgtacgtttgaagctaacaacaacactatatcctaaggccaacaatcctcccagagttgtacgtccaacctgagacaaattcaaatatatgaagcaggtcagaaacttaaacctgtcagtattgtactttttgtgtagcacaaggttacctccatcccaaaatgtacctatttctagatatgcacctgtccaagtgaatagctagaaatagcaacattttgggacggaggtactg

SEQ ID NO: 16699 - DNA, 18276 bp, Oryza sativa
acttcgtgcacaccaactagcaaatgtcacgaaaaattctacaaaaaattaaagtccactcttttttagtcagaagatcactttagctaagtagtccttcatcaaaattgcatatctggcacttgcaaacatatcctatgcacgtaagcttaccgtgcacacttcatgcacaccaattagcaaatatcatgaaagattctataaaaaaaatggacatttactcatattagtattacacatatctacgaagtctcatattcaaattcattatattttagtcgttaccaaaaagtgaaaaatatgatagtttcaagggtaaaaatctgtctgaattttatcttttttattacggctaaaatataatgaagttgaagataaaatttcatatgtaggtgtaatactattctaagtatgtgtacaattttttgtagaatttttcgtgacatttgctagttggtgtgtatgggaagtttgtgtggatattatatgttcccctggcattttagggtcaatctttcatgttgaaagctaaagaaaaggtactccccctctttttaaaaggatagacaattgagagaatagggcgataacgatagacataggaaccgaaataggtcccctttttcattcatccaattaggtcagaatggatcagggaacccggctctgagaaaaacacagtaagagcgcccaaccctctgaaatatagcattctctctctgctcgggaatttaaattttatgccaaaatttaaattctaaaagagtagcttgaagtgactggacctggttcgaggccagttcatgccttcctggctgaaactaagcagggaatacattttcttctgcaattacgttgaaaaagacataagacataattgggttcctgatcgaagctacagtggaacgatgacatatccttcctcccaaagaatatatacacatttcatgatgtttgtttcaacttacaatcaatagtgttcccgcgtatctaatctaacccaggaggggtctgtattataacagtaatcttgcaggcttatctttttttttcagtaaattttagcatctccacggaaaatatggtggtcaggtggatgcagttacaagtgctggaatttcacagctaccgttggtcagtgatgaatatctaggcggcaataatgaatccatatcagcaaaatgtccctcctcgatgtatgcctccttacctattggtgcgtcaaggacagagtttggtatcgcgtcaagagtctcctctaagaaggattcaagtgtctgcacaaatgaagtttatgacttaagctatcatttaagggacatttgaagggaaaaagaaaataatgcaggtgtcagtatgcatgtagaataattaattttcatatacgctgacgacatattcacatttcacaatgaaccaattttgcatgattttgggaaaggtccttttacaccttaagagcatgtgccttcatgctttgcatgccatccaaatagtcatgaaaattttgaatgaagttaaaggcacaaattgtcaagtcataagtgaaacaaaatatagctatgaattgctcatgctatgcaagggtggagtcattcttctgtttcttcatatacacatctgagtttcaaattgaaatgttctgaaatgataaattaaatttaatatttgaatatttttcaattatttaattgatatttgagaggtttggagattacggggcacatgccctcaaggtgtaaaaatccagatccatgattgtgcacctcatactgattttctcattttcaggtagcttaaaacataactggctagcatataaaatgatgaccaacaacattcagataattaagttagaaaaaaaaaactagttaagtgtttgagatgattacttgaccacttggagattgaacagcttcctcattttcatttactagatcaaaattaaccttacaagtattcataaaaccaagtctcacaataattcatttgagtatagtataggcatctttcttctgttgtatttgttggaagaagtaatgtggcatgacaaaggatagacttttttttttataacttaccttgcaatgacgcagtgtagagtcagccttgcgtttccaaaggccattgccaggttccgagtggaataaatttaacaatggctgtcaaaatcaagcgattttctcagtaactgaaagcacatatttgcataagctcataaattttacaaaaggactgataaaggtcaatatagtaattgcattaaatctagtttccagatcaatacacagaatgcagaactcgcaactgttagaccacaattaagcagctcagaataccaggagaaacagatgaaactgtttgatcagtgcatttccttttcttcaatgaactctattttctatttagtgtgctataattatcttttataactcatatcttaggcttttaggcataaagtagaatccctatctatacgcaaacaaaagtaacagttcttgagtaattcagaaagctatgatcaacacaatggtgcatacgtcacagataattacattataaggtgaaacaagtacataaatgccctgctacatcacatcataaagctaacaataggttgttttcattaaatgtaagtgcaacccacaccttgacaagttgtctcacgtttggtctgctggggccatattggcccattattgaatcaccataaacctggtagctctcaaggatctaaaacaaggagttcagttaatacttataaaagaaatagttgatagctgaaaacaaaaccatcctttgatgctaaacctggcgacgagaagagcgtcttgtcggcatcccatagacttcactgtccacatgccccagcatgttccatggactgaacatttattccataccaaaattaaaattacaactaaatactgtttcaggttttcagcaacaaaaggaaacatattctagttacttagtttgcatgtttgaaagcatcaaagaatttagagacacaaaggcttctaattatgaccatacttattatatgcagcccggccaaccataactcgatgtgcaccttgtcttatggatgcagtgacctgcaaatgaatataactgatgttcaataaaaatgacttgactcaggcatattatatctgattgcaacaagagctacttctctgcatgaatgtctagtactaagtacagagagaacaaatatattctttttgcattcatgaaacaaaattgtttttttattgccaaggaaaattgtatcattaacatcagtttgacctaatttgaactgatggactcgctacgcaatttgttcattaaaatagcaacttccaggaattgcattatcaaaactacataactagagtaagatactcacttgatcaatagtagttatacctccatttagagtaaactgcacatctgggaagtcccgcaataaagcaaagtagtattcatatctgcaaaaaaaatgttgaggccggggatgaaaattcagatgagaactagtcagttactggtgataaccaggaaataaaatctgttctgcagaccttaaatttaattcaacagattaggaagcaatttggactataggattgtgtttgtgcccctcatgctctacacgtagtatctacatcatttggaatcttacccaaagttaacaattgaaagttgaaactctacttaatgcatattcttgtttatggaaatggttatcctctttagagattttttttggcgccactccataaattttgttagaacttcaatggttactctcattgagaagaggatagcacccgagatgaggcaattttctggttttcttcattcacaaaacacaaagccatacctacccgagggaggttggatacatatatatatagccatagctcgctgctagcctattgctgcaccctcctagtctaaaattcgaaatttgaatgggatgctgtcctagagggcatccaaactgaataaagcataaaggaggcataaaggagatgctaactgctgttgtcctactaaccgcagctgtcctagcaactgaaaaatatgctaaaggagtagatgctgtcctgaaaaggtgaaactacccaaaagcaaaaagaagaatcacgaccaagtgttagaatttcaatggttactctcattgagaagaggatggcactcgagatggggcaattttctggttttcttcattcacaaaacacaaaagccataccttcccgagggaggttggatacatatatatatagccatagctggctggatggctgcaagctaattgctgcccacactagtctaaaatttgaacgcgatgctgtcctagagagcatccaaactgaataaagcataaaggtgatggtcctagatgctgtcctagagatgctaaaagcaaaaccgaaatatgctaaaagcaaaactgaaaggatgctgtcctaaaagggaaaaacaacctaaaagcaagagagggaccacaaggaccaaagaccacgaggcttattccatcattctccccctaagtcttgtgcgtcgtcttgtgggaaagttgggtcatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttcgtggaagacggggttctttgccatcctcgttgtagtcgacgtcgccgtaccggactgcctcccacatgtgccacacctgcagcctcaccctcatcaccgcggcccactcgatgtagttggttttggtgagggtaggccacccaccgccgggaccaaagtccctgaccaccgtctggacgccatggtgaccatgacgccggtcaggggagggagagccgcgctgcctgcgagggccgcgcgcgggctccgggctgccgccggcacgcccgcgcccgtctgggttcccgtcggcgagcgcgcggtcccttgggtcgccgccaccgccgtggaggtgggctgctgcccaccgctctgcccgctcccgtgcccctcctcttgccagctcctcaagctccctgtcggcggtgatgtcgccggcaatggagccgttgatgctgctgcgcaaggtctcaacctctacctccgccgcacgtgccgcatcttccgccgcctccgcctccacctccgccctgactgctgccaactccgctgccgccagtctggccgccctcgctgctgctgtagcggtctgagccgttgctcgcctgcgctcttctgctgcggcaagctcggcatcctgctgacgccgagtgctcgaggcgaccgaacgccgagaccgaacgtcggacatggcgcgcctccgggaggctgctgcgtggagaaggggaaggagaaggggaaggaggagcagccggtgctgctgctgctggctaagagctcaaccgagcttgggaagcagtggagcaggagatatttagcctacaggaaagtgtggctctgataccagatgttagaatttcaatggttactctcattgagaagaggatggcactcgagatggggcaattttctggtttcttcattcacaaaacacaaaagccataccttcccgagagaggttgaatacatatatatagccatagctggctggatggctgcaagctaattgctgcccacactagtctaaaatttgaacgtgatgctgtcctagagagcatccaaactgaataaagcagaaaggtgatggtcctagatgctgtcctagagatgctaaaagcaaaaccgaaagatgctaaaagcaaaactgaaaggatactgtcctaaaagggaaaaacaacctaaaagcaagagagggaccacaaggaccaaaaaccacaaggcttattccatcaccaaggaccacaaagacttatccatcattctccctctaagtcttgtgcgtcgtcttgtggggaagttgagccatcccgatcctgaagcagagctcgaggaacttaatcctcccaagaggcttggtgagcaggtccgcaagctggtccttggtgttgatgtagctcgccttgatgctcccttcctccaagtagcttcggatgaagtggtacctcacccagatgtgcttgctccattcgtgaaaaacggggttctttgccagggccagagcggacttgctatccaccctgagctccaccgctccagtatctctgccgaggagatcactaagcagtcgagcaagccagagcgcctgggtcgaagcggcggaggccgccatgtactcggcctcgcagctggacagggccaccacctgctgcttgactgactgccagctaacgaggcactcgccgaggaagaagagaatcccgctcgtgctcttgctggtgtcgatgtcaccggcgtggttgctgttgctgtactcgacgaagtgtgccttgccaggacacctcgggtagtagagaccgtggtcgagagtccccgcaacgtagcggatgatcctcttcacagcctgctagtgctccattgtcggtcgttgcatgaaccgactgacgtagccgacggagaaggccaagtccagccgtgtgggtgaggtagcgaaggcttcccacaagacgccggtactgtgtagcatccacttcctccgtcgtgctatcacggctcagcttcagtctctcctccattggagtgagagctgggttgcaatcggtgagcctagccagctcaacgacgcgcttggcgtaggcggtctgtcgaagcgtgatcccggagtcgtcctggtgcacctcaatccccaggtagaaagagagaggcccctgatcactcatatggaaggtggccttcatctcctccctgaacgccgcgacctccgcatccttggtgccggtgatcaccaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcctggcggctggtgcacgtagacctcctccttcaagtcgccgtttagaaacgccgacttgacgtccatgtgatggacgcccagccttcctgagcagccagcgcaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgaggaaggtcagcaagctcccaggtgcggttctcctgaactgcgtccatctccgactgcatcgcggcacgccatgccacgtgtttctcggcctctgcgaaagaccgaggctcaccgtcgtcgcacgcaaggtgcaactgcgcctccaggtcgggaggcaccagtcccggcaccggctggtcgccgagaagatcctccatcgtacggtaccgtagctgctcgccgtcgtggtacgcgtcgatgcgctccccgtcgtgggagagcggagtagcgaactccaccgggttgcgctcaacactagctggcgtcggagtagacgtgctcggaggagtggctgttggtgctggagcgcgtggggtcaccggctgtggtggtgtaggcgaggagctcgtcgtagtcgaagtcgtggcccgagagtgtgttggtgtcggagtcggtggaggctcggggactggggtagacacgctcggtgaagaagagttgcctactcccccagctccctcgaagtggacgtactcgacggtgaagtcgtcgtacttcggagtcgaaccatcgtccaccgccttgtcccatacccaccctcgcccttcgtcgaacactacatcgcgcgctgtgcgcacacgctgtgtctccgagttgaggatgcgataggccttcgagccctccgcgtagccgatgaacacccctggggtgctcctgtcgtcgagcttgccgatgtggccaagctccttgacgaacgcaaggcagccgaagacccgcaggtgggagacccccggcttgcgctcatgccaagcctcgtacggtgtcctgccatcgagggccttcgtaggcgagcggttgaggatgtagacggccgtcaccaccacctctccccagaatatggccggcatccccctctgcttgaggagagcccgagccatccctacaaccgtctggttgcgccgcttgacaccgttctgttgcgggctgtacggcgcggtgtactggcgctgaatgccctcatcagcgcagtacgacgcaaattcagccgccgtgaattcgccgccgttgtcggtgcgcagcacgcgcagcttgcggccgcactccacctctgcagcagcctgcgcgcgccggatggcgtccgcagcctctgccttgctgccgaggaccatcacccacatgtagcgggagaggtcgtcgacgagcagcaggaagtaacgtcgtcctcctggtgtggccggtgtcactgggccacacaagtccccgtgcacgagctcgagctgctccttggctcggaaactcgtctgctggggaaaggggagccgcctctgcttcgttaggacgcagacgtcgcagagctgctccacgtggtcaaggcacggcaggcctcgcaccatctccttggcgctgagccactttagggcctcaaagtggaggtgcccgaaacgctcgtgccactgccacgcctcgtcgtcccgacgagcggcgaggcaaactggttgtgcgacctgcgcgctgaggatgtagagtcgattagtgcctctggttaccttggcaagaaggcgacggcggcgatcccaaatcgtcatgactccgtgctcgaccaacacgcgtgagccgttctcatccagctgtcccacgctgatgatagagttcctcaacacggggatgtagtagactccggtgagcagcctgtgctcaccggactttgcggtgaaggtgacggagccgacgcccttgatctccatgccggaggcatccccaaacttgatggagcctcggacgctagagtcaagctcggtgaagaactcccgccggccagtcatgtgatgggtggcgccggtgtcgaggtaccacccatcagccttgtcgttgctggagctgttgccgaggaaggcgtgtaccttcggctcatcgaggtggaggaaagccgttgcggccggtgccgctggagatagctcgatgccgcgtcgtggctgtcgacagtctttggcccaatggccaagcttgccacagttgcggcaagcgtcgtctcgtgccggcttgtggttgccggcggcgccgccctgggcgcctctgcgagcaccaccctcggcgcgtcttcgcgcccaccgcagttggacgcctccgcgcgccttgcacggcttgcggccgcctgtcgagggagaggactcccccttcctcccgtcaccctggctggcctcccactgctcccgagtgagatggagcttcccgccaatggtgataggccccgagagaggctgtggctcatcgccgtccacgaccttgaggcgacctaacgcctcctcgatcgacatcgtggagaggtccagcagagactcgatcgagcgagcgatctgcctgtacttctctgggacgcaacgaaagagcttctcgacagctctctcctcgtcgtaggtgtcgtcgccgtactgcaccatcttctgcaaaagagtgttgagacggagggcaaagtcatcaacatcctcacctggcttgaaggccaggttctcccactccttgcggagtgcctgcagtgtggacttgcgggcgcggtcgctgccgatacgtgccacagcgatggcatcccaggcctccttggcagtccacttatgggaaagcgagaactgcatctcgagcgggactgcagcgatgagggcatccagtgcccgccgatcctcatcgtagtcaacgtcgccgtaccggactgcctcccacatgtgccgcacctggagcctcaccctcatcaccgcggcccgctcgatgtagttggttttggtgagggtaggccacccaccgccgagaccaaagtcccttaccaccgtctggacgccgtggtgaccatggcaccggtcaggggagggagagccgcgctgcctgcgagggccgcgcgcgggctccgggctgccgccggcacgcccgcgcccatctgggttcccgtcggcgggtgcgcggtcccttgggccgccgccgccgctctgcccgttcccgtgcccttcctcttgccagctcctcaagctccctgtcggcggtgatgtcgccggcgatggagccgttgatgctgctgcgcaaggtctcaacctctacctccgccgcacgtgccgcatcttccgccgcctctgcttccgcctccgacctggctgctgccaactccgctgccgccagtctggccgccctcgctgctgctgcagcggtctgagccgttgctcgcctgcgctcttctgctgcggcgagctcggtgtcctgctgacgccgagtgctcgaggcgaccgaacgccgagaccgaacgtcggacatggcacacctccggggggctgctgcgtggagagggggaagggaaaggggaaggaggagcagccggtgttgctgctgctgctgctgctagctgagagctcaaccgagcttgggaaggggtggaacaagagatgtttagcctacaggaaagtgtggctttgataccagatgttagaacttcaatggttactctcattgagaagaggatggcactcgagatggggcaattttctggttttcttcattcacaaaacacaaagccatacctacccgagggaggttggatacatatatatatagccatagctggctgctagcctattgctgcaccctcctagtctaaaattcgaaatttgaatgggatgctgtcctagagggcatccaaactgaataaagcataaaggaggcataaaggagatgctaactgctgctgtcctactaaccgcagctgtcctagcaactgaaaaatacgctaaagaagtagatgctgtcctgaaaaggtgaaactacccaaaagcaaaaagaagaatcacgaccaaggaccacgaagacttatccatcaaatttgaataatattttacacaaagaaaatcatgggcgtgacatactttaaaggaggaacgttccgattttctgcaggactgaggccacttagcaatgccttccgggcatgaataatgaaatgcctagttggtgattttgaaacaaccttatctacaaattcacctgggaaagaaaaaaaaagtcaatgtacctaacagtgagaaagatacgtagtttgttgcaatatggcactgtatcagcacatgaggttaaattaaccctcaaacaatactcctatgataattaaataccatgcaatacaagaactaattaaacatcatatgaaaaatttatctagagtaacatgaatgagaatcattaaaagtatgcacctacagcatgacatagaatttgaactgggtaatataaataaaaaaaagatatgttacaaattcctaacaaaaggaactatgtcgtgtgacatgttaaaaagaaatgggccatatccatatatcataacaagaagaaaacaattaaattgagcaacttattcttagacttgatttcccattattcagttacctaattatttcagcttgatgtgtgcagaagggataatctctaaataaatgtaaaaggatgttgttatcatacaaaaaggttgatcacatgtcaaatatatacatcaccaattaactggcaaccatagttaaacattgcaatttaataggagtccaatgctttgaagataatcctcagccaactcagggggaaaggggaatttttcaaatttagccaaacagccatgggtgattatttttggccctaaaaaaagataaactgcagtaaatgtcatcatgccaccatttcatctacaagcagatttacatacagtagattaatttggaataagtcatgataaatatatgcagagaactagagactctccactgatgttagaagctttcaactattcttttgatttgagaagatatgagattttttttatgctctgatgctgttgaaaacttgaaatgtaaggagtaattgcaccagtggtacattttaggggtcagttaatactaatccaagattttaaccgtccagcatcactatgcacaagagatactactgtttttttctttcttcaatttgaccttaagggcacaaccaccgccagaagagtacaaatacactgaccagtaaccaataacaactacagctaggtaacctggttcttgtaaaacaaccagataacaccagcaagtgatttacttatatttagcttatggtataggttaacatattttgataatatgagacattaaagcatgccgcaacccattgttgattgatccttttcggtgtaaaagtgcatctgatagagtgtacttatttgacatgatttccatggctcatatctgggaagcctaaggaaatttaaaggaacatgagaggtctctgaagaaagctcacaaagttcttcgtaggagtcacgatcatcaacaccaattctgcacttaacgctgactgggacattacaattggcagcaatagctgacatagcatcccctacaaacttcagataattgaatcaatatttactaagggtggagaaagaacaaattgatgctacctgatggtttactgcaatgaattcataaagcaaacctctggatcaaacattaagcgagcaccgaagcaaccatgaccagcaactttgccactggggcagccacagctgatacaaaacgtttggagtaaattatatgtaataaaagaaatgtcatacatgattagatgagattgagtgacgcttttttactttaggttgatctcatcgtacgaataagcatttgccagttcagttgccttcgctaagttatccagattacttccaccaatttgcaacacaataggatgctgttcagcaggaaacgctaaaaatctatcctgcatattgtgacgacaaaagaataagatttatcaattctgtgtagcagtgtcatgtgcacataatgtgaaccatatgtcgtagacacgtttcacagttgccttcattgcaccaaaagtagaatttaagaaacaatgattgaagacatagtgacaaatatacaaaacaagccagcactgatggtgccaagttgagttgaagtggttcccccatattaagctgccagtgccgccaagaaagctcatcgcaacttgataacatacaaaagaaaaaacatgtgggcaatacattgctggttatcccgataaggcagtaagttgattctttttttcattaaactgcaatatttatgtgaaaaaaagagctgattagctaaaacaatggatatccttcgcatatgcctagattgagacagcagaggagatgaactatatctgacaaaaggaatcagtggaatgccgctgtatgattaggttccaagttgtgatatatgaaagcgcaccatgggctaatggaactattaagatgaacattatactataagactctgatgagtgtacttaaagagtcaccagatatagcttgaagagaatggaaaacttatgcaatgcgcacgggaaagtttttcatggaacacctgtggcattgttattgacatgaatgaaagtgggccaatcgtaaacgaattcagtttgctgctgactccaatcaaatcactaccagattcacatcgcacagtaattcagaatcgtggtaaaaccacaggttgcttcactgctgatcagttgcagggtttcctcctccgtagcaaggatttgcatttctctcatctacgtttcacccggttttaatcatgaagaagtgaagggcggaagggcatatagctcaccaagttatctttctgatgcacgatggtctccgcgaccaccatctccgtgtagagccacgcgtgcttcgagatcagccgcgcgagcgtccggtagtggttgtccgtccagtccatcatcggcgccacgctgcaggagaagagggggaaaaccacgaaatcaatcagctatccatgagcagcaccgccatccccgcccgtctccattgcctaaaacacggaataattccgctccccgctcacctgaacagcggaggaaggtgcccgccacctccagtcgcggaggagctcgccgcgcgagcgcgggcgcgacacgggcccacgccgcgagcgcgctgcggcggcaggagcgaggcgccgcggatgctgccgggcgcggccagcggagggcgcagggagtgcctcgccaccgccgcagccgacctcaccgcgatggccatgcgagctgagctctttctctctcccgcatacggccgccgccacctccgccgccgctgccgccgcctctccttgggaagggtacgggccgctgcgggtgaggaggagaacgtgtggcgagtggtgtcctgaccgcccgatctgtggccaacggtcgtgattgcgtcttgcaatacgactacacgagtccgatccggattacaaacggcttcaatctaccctttcctcctcttacacgggcacgttttttaaaaaaagctgctatataccggtatcccgttgaaaaacaggatgattctaaaaccaacacggtatcgtcaccgcgcgcgtcaacaaaaacagaaagaatcgtatcgtaccagtgctcgccgcgccacctgaacacatcccaccgaatcctcctcggaatcgccggcgcgagctcctcagcaaggcatgcgattcctcgccggcgcaaggcgagctcctcggcaacccgacgaatcctcctcgaaatcgcgcgcctccgcgcacgattcctcgccggcgcgagctcctccgcatccccaagattgatcctcggaatcgcgcgcctcctttgttgatttcgccggcgcacacgccgtctaccgatttcctctgcaatccggtgctctgctcctacctcctcgaccgattctgctccagctatgcgctgcaagctcaacatcagcccgcgtaagaattctaaagccagttctctgttatctctattttatgcatgcaatgtatgtgttttgatgttttgttgctattttgtgtgatttcttttgatgcccaggagaataaaaaaaagtgatgccccctcgagtgaatctcctttgtgtgcactttctgctagtgtgtctgtagctagcgagtcagttgtgacaacaatagtagataagttagtgttggatgagttaagtgctgaaatagagatgttaaaggaggcccttgttagagctagatgttaaagagtgcagtcaccatgatccaatgttcagaagagcaatcagagctagtccagtcgatcctgtgttgcagagtcgagctgttcccaatcacctacctcgggctcccgctccccctctgaaagcttacgaagcacgatgtccaaccgctccttgaccggtttgtcaagaaattcgccgggtggaagccaaagtttctctccgccggtgaccggctgaccttgatcaagacagtcctacttgctttgccagtgcattacatgtctgtacttgagctcccacagtgggcaatcaaagaaataaataggaagtgccggggatttctatgaaaagggcaggaagaggtgaatggcggacactgcttggttgcctggaaagcggtctgcatgccacatgaaaatggcgggctgggaatcaagaacatcaattatttcggcaaggacttcgtctcaagtggttggcaaaaagggggaacaacaggacaggccgtgtgtcaaggttatggataccatatacctaatagtagttgactaaatctcggcaggacccaccacataccatgtcttatacgaaaacaaccttcggatataggaggaattccgcataaggaatgatgaatagagttctacatggaaacgacaaggactacttggattgtatccatattggtttccctagttctacttagacaaggggacacctatgggtataaatacagggccccctaggaggagaggggacacggaacaatagatcaagacacaagatcaacataaaagccaacatgcaagacaagacgccggatatcgaattcagagataagcatggctagtcccttacggtatctacggatattatcaggagagatatagcgctgtctttgatctcgccggatgcggattcgaggaggaaggctaccctgttgtcgactacaagtcagcacttcagaccgccaagtcgacaacagttagataggctactccaaatattgtacttgtgtgatccagatgaataaagagcaacaccggcttcggccaatgggatgtagggctattacctgtaagataaggggcctgaacctatataaaaatcctcgtccccatctcttttacttcaatctcgcatatatcctagtaccaacgattcccatactatgcaaataccggaatcgcgacataaaacgtcgacaccgtgaacaacagttccaatagatcagtcgaaagacttgcaagacctctacctcgcaggaacgagacaagtgttgggtgatgggaagaacaccaaattttggctggcggactggttgctggtgaggagcataaagttgagattccccttgatcttcagccacgtcgagcgctcgggcttgacggtggcatgagggcttctgaaccataggtgggtacgagacatcaagggggcaccctccaatcgtgcaattggggaatactttcagatttgggacgtggtctagggggtgcaacttcaagatggggaggaagatgagacaatctggaagtgggcaccaaatgaaaaatacactccctactcggcctacagcatgttcttcatggcaaacacggtggcgcgatgtggtactctgatttggtaaacaagagcgccgtcaaaggtgaaattatttatgtggttggccgaaaaagggcgatgcctcacggcggataatctaagtaagcgtggctggccgaaccagcaggtttgccaactttgcttggtggttgatgaagattatgaacacctatttgtgtcttgcacctacacgaccagggtgtggagaatgatcaagggctggattggggttggcttcctgctgccatatgagtcaggcttggacttgggcgaatggtggttagcgatgcggcaaaaatttcggaacaactacatggatgccattgatagccttgtgctgcttatttgttggatggtttggaaggaaagaaatgcgcgtgtgtttcagaaccagcggcgctcagccggtttcctgtttggttcaatcaaagaggaggtggcgatttggaaggaagctggggttttcagaaatataggagagaggttgctccggtgacaacttccattactttgacggcttctagttgaagttaaaactttgtatatttgtatatattcttcaatcgtaagtataaatttagttggcctatcttggctggcccggcgaaaaaaaaagagctagatgtgacccagatgatatggaagtggatagaacagatggtatgcatgacttgtccctgtgtggtacaaaaattgatggaatgtacataaaaggactgcttaatctccaatatttgtcaaaagattgcttgtgtgtttgcatactatcgttgaacttttgtattagaaaaatgatcaaaagatgtacactgagtgtcctggctgttggtggaggtagtttttcacacacaatttgttatgtgattgctaaaaattttcacacaagtagcacatgattcatgtggttttcacagatgatactctgttaggatcatgtgatacgctagtaggatcacatgatactcttgaggatcacatggtactcttgtaggatcatgtgatatctttgtagcatcacatggttctcctcaaaaaagtatcattaagtgatacatgtgaggtatcacatatgatcctacttaggtatcatgtcttctaacatgatccctatgggtttcacagatggtacttaatggtgtgatactttacaggtatcacacatgatcctactcaaaaagtatcattaagtgtgatacatgtga

SEQ ID NO: 16700 - DNA, 26951 bp, Oryza sativa
catgatccctatgggtttcacagatggtacttaatggggggatactttacaagtatcacacatgattctactcaaaaagtatcattaagtgggatacatgtgaggtatcacccatgatcctacttagggatcttgtcttctaacataatcctacttgggtatcatgtatcctacttagggatcatgtcttctaacatgatcctacttaggtatcatgtcttctaacatgatccctatgagtttcacgaatgctacttaatggtgtgatactttacaggtatcacatatgatcctaataaaaaaagtatcattaagtgtaatacatgtgaggtatcacacatgatcctacttagatatcatgtcttctaacatgatcctacttaggtatcatgtgtgatacatgtgaggtatcacacatgatcccacttaggtatcatgttttctaacataatccctatgggtttcacagatgatacttagtaggatgatgtgatactttacaggtatcacacatgattctacttgggtatcatctctggtaacatgatccttgtgaggtttcagagatgatactttagtaggatggtgtgatacttgtgaagtatcacacatgatcctacctaggaaaatcgtcgatcatgatacctgggtaggtaggatcatgcgttgctcagcgcgtgtctatcgccatcacacatgagactcgagtctgatcctgtacacggtgcgaggtatcagagtcctctctcgcgtcgtatcctgtgggctcatgtggtactgcagctccgtctgttgaggcgcacggacatcgactatatctgatccacgcaaaaggtctacccagtataatccacttctttaccaacatatatgtacatgaaaacagtagccacatacagagttcatatcatttgattattgtgcccctcgcaatcttccagttcaagacaaaaacagtagccacataaacaattctgaaacttgacttgttacatatgttggttgggggagaggaagggagggggctaaaaaatggcctaagcacgcatccgacactgcttgaaccgaatgagcatagaaatgacgttttggatgtaagtcattgaagcgatggtacaacaaccttttgcatagctccctatgatattctttcatgtagtcctgcatggatgacaagaatgagcagtgtgagatttgtcaagtgggggttaagctgagcccttgttcaaccttgaagagcaccttttcttctttgaaacatgcatgaaatcggattcgcttgaagcaggtggcaatgctatttcaactctgtgcacatgtgtgaaaggacaaagaaaatatcatttcaatggtgattcttcttagattgaaccaaagtatcaaatcattttaaaacagaaaactcccagccagccactgagatctacaaacatcaacaggaaaaaaaaatccaaatcatctgcatctatgactcagctgcatctgccatctctgtcgccacgcgctgccctctatgacaaaaaggataacaattgacaagcaaagcatacccggaactagaagccagcaaccgactgatgcggatttctctgattttgtttacacttcagttcacctaaaaaagtcctaagcagtaagctactagttgaatggagatttctctgtttcaagacagtgtgtacttgttaacgacaaaattgctccaagcaatatttgccttcccatcaatatacaactagaagcatttttagcgatctattccaattcgaacattttgctgcaagtatcatatcaagtatcatatgattcagcacacacacacccctcacctctggtacaaacatccccagtgaatgaacaaaaatgcatagaaaaaagagagagtattagcttactttgatttcaatttggatgtgatatgacgagccccatccacaggttggggattcaacaaaccctagaaaatacaaaaatgaagagatgttaaaatcgaaatcaggaaatcgatgaaaaaggagtgataacaatccggcccaggtggggttggccgaggcccaataacttaagattggctggaccccaacagttcataggcacacccactcggggaaaggcccaatctccctaaaagactagtccaataggggaagggtgactctcccttttaaggtggcttcctcctctcaagctaagcaaggtgggattattctggccggaccccaacagttcataagcacacccactcggggaaaggcccaatctccctaaaagactagtccaataggggaagggtgactctctcttttaaggtggcttcttcctcccaagctaagcaaggtgggattattcagaggctcacacggtcgctgcccgactttagcgtctttgctagcgggtaatagtagagaatgtcctcatcattcccacccccttaacaagggcccaactctgataccaaatgataataatccggcccaggtggggttggccgaggcctaataacttaaggttgcccggaccccaacagttcataggcgcactcactcgggaaaatgcccaatctccctaaaagactagtctaataagggaagggtggctctcccttttaaggtggattcctcctcccaagctaagcaaggtgggattattcagaggctcacacggtcgccgcccgactttagcgtctttgccagtgggtaatagtggaggatgtcctcatcaaggaggaatgagagaaaggggtatcatgcgcaccagctccgccgcagacgccgccgccgcagccgccatcaacatgcttacgtcactctctctcattggcacagctgacctcgtgcgcaccggcgtcgctgaagaggaggagcagcaagcaggctccgccgccgccgccgcagccttgggagctgtaggtgtctcaatgcttctcgagggtgtgtatctgatccgtgagggtgtgtgtttgatccatgggaaattgtcctgtccgggaccgatcccaaacggtatatcggtaagtagcatttctgtttttaaaatgactagcaaaaatgtttggtatgtttcaacatgtgaagataattttcatgattcataaaaactctgctaatttaaataacaaaccgagaaaagatgaacaaaacaatggcaaaacaaagttaactcagttgtgctcgcttcctgtgtcatcacacgaaaaatctcttatgtacacatttccttagcctcacaaatcgatcgggtggctattatataagttgacgcatgtgtattttgctatagatgagtgaaagtttgattattcaattagtgaaagttttttacctatagataaaaagcatttgcaaagtaacaaacttgttgtagacacaccttaatgataatttaaaaaaaatatttatgaggaaagaaatttggtagagaaggataataaaaacagaaaatgaggagattagatgtaggtaaaatacaaagtatgtaactgtacggacaaaatcccttattttatactagtataaagtggaaagtacgatgtgtggtggatttttaagttggattcttgtcctagccaagggctttaacgggcacacgtgttgatgagcatgtatcacacaatctctttgattgtgtttggaaaatgggataaagagagtgggaaatggatattatttccagttttgatatttcccttgtttggataggttgggaatgggatatgcaatcatgctggattgagggtaatattgccaggtgaaattaccaaattgccctcgccattttgacccttctataatctgttgattcatctaccacagctcatagcatcaaatctgagggtgctctttggtgtaagcagctggcagcaatccaccgagatcctcgcgtgggacgaaggctctcgaagatggtgaggtgcatgtatatattatgtgatcgttggctgcatttgaatgttataccacttattgtagggaggggtattttggtcatttctctagaaacttccatttcccatccatcaaaccaaacatgggatatgactttctttcatataatctcccacctcaatctaccagcatatcattttcttttcccaataggtataacccaatatccaaatggagcctttatcggcagaagcgttttcctttgttactgctaatattctactttggatcagtgaaaaacaatttcggtaacctcgggcaagtcattatctcagctgaaacttttgttttttcttttctttttctttgaatttgatcaaaatttattcaaatctagtcaaattgtcttaaaaatttaaataattttgatccaataagtcttcaaaatcccaaaaatttgggaatttcgatgctaccgacatggccgaatttttgagcaaaactgaaaatgaaaaccttgcttcagataagagagacagaattgaattggcttgaagatggaaaaatgaaaacctcgcagtttaggccgacggaaaccgtacattttgggctttggaaggaaattgtgtgtggcctgttaggcaaatagaagggtgcaatttttcatatttgacctagagaatgtaaatgaagaggaggggaaaagatgactccgtgtctttgtaaaaagaaacccatcactctaagcaataaaatgggaggcaactacacgtcaggcgcccgatccggggtgggaaaatcgggcgcccacgtcatgttgacgtcagcatgacgtcagcaagatgtatgcgcgcaaaactattttaaactatttttttattttaaattatttatccaaatcatgatccaattgcactattaaattcgttgcaattaaatctttaaaacaagactacacatggatatattccgacgaaaacttttttagcttattattgaattatttttaaatgttgcacgttgttgcaccaagtatattgaaattgttttaaatcgaaaatatttcaatcatttaaatcgggcgccgtttcaccttatataaaaataatgtttcatcaaatagcgaaataatgtttcagttcactacaacatttgatccatacataatgaaacattataagtacactaggtgaaatattttttgtggaaaaaaatgaaatgaattcggtttccataatatgtgggtgatttgttgcaaaagaatgtttcaatccactgcagcattagatctatacatagtgaaacattgtagtacactagatgaaacattttttgtggaaacaaactgaaacgaattctcttaatagatggtttctaaaatatgtgggtgatatattgcaacggcgtgtgtgctagggtgtgtggtgggggcggcacctgagctagaggcttgcagcgcgcgagctggaggcgcgatagaggcgcccgatttttcctgctgattctccaataaaattgcaataactacttataatttgcagcgcactatataggaaagaccactcttttgagtattaaatcaatatttattaatctgaaccatgagcagttaaactatctgattacatgttgttattactagtagaatgcatgtgcgttgtaacatgcgaaaataatttttacgatcgataaaaactctgctaatttaaacgataaactgaaacaagagaaacaaaataaagacaaaacaaaatcagaaattatatatagtattgaactaggttgtgttcgctgcatgcgtcattgtgtacacgtttctatagcctcacaaatcgatcggatgactatttcaaaagttgacgtatgtgtattccgttatacgtcattgatcaaatattaaaattttgattattcaattagtaaatgtttttacatgtaggtgaaaaacatttgcaaagaaacaaactttcccacatacacatccgtgtcagctctttgctgctgtggtcgatgaataagatggagaaaaggagccgctgtcgtcatcccttccttccttgaccggcgacgtggtcgggtccagtggcggcggagcaggaggcttgatgatgaagagtcatgtccacagatccaacacatcgtctcaacgcccaacgttgcatcctctcaggatccgatcgaccaccctgatccacagcgccgtggatccctgcatgtgccgtcaacggccgctgccgcatcagcctctcttgggaggaaacatgtggggagaaaagaacttgccggtgattgctcgaacctcggatacgactgaccacccgatccgaggatcgatccgacgcgcatcgcgagtccgacccccaacgacaataaataataaccacgttaattaaagactcgtctcgactcgataatctatgtgtttagtttaacgttaaaattagaagtttgactaaaattaaaagtttgaagaaaaaagttggaagtttataaaagtttgaagtttatgtatgcaggaaagatttgatatgatggataaattaaaagtttaaagaaaaagttgtgacctaaactagggcaataccaaataccagagttacgtctccagccgacgccgacgccgatccatcctcccctcaccgcgcccttcttcgcctgcacaaagggagaagctacgtctaatcccctaattcgccggtgtccgatggattgcagcggtgggatggaaaagcgaccagccagccagttcaataagtcacaatcgccgcggggagcttgcgcctccaccgaaccagcgagaacccaggcgaaacgctcccgccccacgccagccggcggcaatgagcaggcggtggcggtggtggtgcccaggcgctcgctaccaagctctatcaaccacaatagcaaaactggcacaagggactggacgaacctcggggacgggccggccggcaagatcgcggagctcaccctcgccaacgacgtcgccgattacgtccgcttccgtgccgtgtgccgcccgtggcggctctcctcctcgctgcacccgcgcccgcaagatggtggcctagacagccgcttcctccctcgtcactggatcatgctcgacaaggcccaccacaataagggcaccactgccgccgccacccaccgccgccaccgctttctcaacgtctccaccggcgggtgcatccacacggacgacatcccggagctcgccgaccacacgatgctggcgctcacgccggagggcctcctgctgctgctccacgagcccagcctccgcctccacctcctgaacccgctcacccgccaccgcaccgacctcccgccggtgacagcgctcctgacaccggagtggcgccgacgagcgagctggcgtttgggcgcccatggcgtgggtcttcgcgtgaacgccgccggttttgtcgtcgaggatgcctccacagtagtggcagtcgatttctccgatcccacggtgcgcgccattgccaagcctggcgacgagagctggaccgtcatcgacgacaggctcaacacgatagattggattatcacatatggtagagtacatataggcacatgccttccatatctagcaaccgatttatagaaacaatatcggagaagattaaggaaggatggcaagggataaacacaatctaacaccccccgcagtcggaacgtcgtgggaacggacattcagactggaccgaaactccaagaagatggcactgggcaaccctttggtgaagatgtcggcaaactgtgacgtagtaggtacatgtagcactcgaacagatccggcagcgacgcgatcgcgaacgaaatgtagatcgatctccacatgcttagtacgctgatgttgcaccgggttagaagagagatagacagcactaacattgtcacagtaaaccaatgtggatcggctcggaggggtatggagctcatgaagaagctgtcgaagccaccaccgcgttggccacgacacgatattctgcctcggcactggagcgcgatacaataagctgacgtttggaggaccaggagaccaagttgtcgccaaggaacacagcataacccgaggtggatttcctggtgtccggacaacctgcccaatcagcatcagagtatgcactcaagtcaacagtggaggagcggcggatgtgaagaccataatcaaccgtgccatggacataacgcaagatgcgtttgagagcagcaagatgaggctcccgtggatcgtgcatgtgaagacagacctgctggacagcataagagatatctggcctggtgaaaatcaggtactggagggcgccagcaagactccgatagttcgtgggatcatgaactggggcaccatcagcggcagagagcttggcgttggtgtcaacaggggtagcacatggcttgcaatctgtcatgccagcacgctccagaaccttgaggcagtactggcgttgactgagatgaaggccagaggactgccgagaaacagagatgcccaagaaatgatgcaagctgccaagatccttcatcgagaactccgactggagagcacggatggtccatcgaagaagtgcatcagaggaggctgtcagaacaatgtcatcaacatagaggagcaaataaaccgtgtctgatcctcgatggtagatgaacaaagatgtatctgattttgcctcaacaaagctgagtgtaaggagaaagctggcaaaccggctggaccatgcccgtggggcctgcttgagaccatagagccgcataggccggcgggaggaaggcttgctgctgggccggcgcgggcgtggtggtgaaggctgtcccgacgaagttgggccgcacgccaaggaggcctagaccggcctggcccggccacatgtggattctccctgtccatgggttgtaggccgtgggccaggcctggttggcccgtggtgcagtctatgcgccagggttgccctgggcgccgccgctgtgtgcttgtccgccgccgccacttgcgccgccgctgccattgctcccgccgccaccaccaccggagccatgaccacggcgtcggttgttgttgcgggagttgttgttggaggtgttggtggaggtcgccgagcgagcggtggtcgaggaagcagcgaggaaggccgtggcagtaacgggcggccggtggcctttcgtcagctcatcgaggagaagctgtgcgcgagccttggcgaacgtcgggaacaggacttgcagaggcaagagggacttgaggttgtcgaatttgtcgttgaggccgccgatgagggtgaggatgagagaccgatccttgacaggttcaccgacgtcggcgaggttgtcggcgaggaccttgagtcaccggcagtagtcgccgatggagaggtcaccctgctgcagatgatggagctcggcggtgaggttgacggcgcgccgctcgccgttgccgaggaactgcagctcgaggtcgcgccagacggagcgtgccgtcgccgtgggaaagagcacctcctgcataagagtagaggagatggagccgtagagccagccgaggacgatgcagtccatctgtgtccagtcggcgtgatcggggcgaggtacgtcggagaagacatgatcggtgagggcgtattttccaagcgcgatgaggaaaaggcctcgccagcgggagtagtttttggcgtcgaggtcgagggtgacggggacgagcgccttcacgttgaggacggcgacggctttgctgtggaggttggcaacggcttcggcgtcaagcgccgccggtggcgcggcggcgtcctgcgtgggggcggccggcgtcgtggtgatgccgagacgggcgagaagcgccaggatctcggggggaagttgcgccgcgggagccggagtggaagccggtggcggcgggatggcggtcgtcgaaggcgcggtcgtcggaggaaccggtggaggcaccgtggaggagtcgtcggaaggagaccgaggataacaggggcgagggccgcccgggccacggtcgcggcacgatcggtggcgtcgccagcgacggcggtggtcagggtgtcgtcgtcctgaccagagggagccttgaaggaggagcggacggcatcggcgatgattttgatggtgtcatcaaggacggcgtcggcagtgagggaggagggaggagaagccatggcggcggcagggtgcgccggccggcggctggggtggagaggaggcggaagcgagaaggaacctaatctgaggacgcccccgtcgatcaaccccaggccaggaacgtcccctcttggccacgtccgtgtgtccagtgccagcgcatgtgccatgctgtatgaccactcccggtccacaccaaccatactcccgtgaaaccgcgagagtcagctctgataccattttgtaacgacccgcctttcccaggctaggcccacttacatctggtagctttcataggtcataagactgtcctcacagaccaacacaagtcttttctacgcactttgtcctcactcatgcgcactcgggaagaattttctggtcggtcacccatccttaaattgctccagaccaagcacgcttaacctcagagttctttagagatcggcttccgaaaaagaagttgcaatttgttgatatgagtattctagtaatcctattaagccctagaccgggatgttacaccctcaccccttacaaagaatctcgtcccgagattcggaacggctagaaagaaaagggcattggtcaactgcagtctatcttattccataactatgataattattctaaggctttaaagaaaactactgctgctttgagactggtggctgagctgtaacacttgaagatgcaactggcactacattggctcctgtgacgacaaagatgtcgatggggtctacttatggaggccaagtcaagtggatcgagggacatgaagatgatggtcgaactaaagtgtccagctgtcaagatggaatgaagtttggatcctagcttagaacctaaaccaccaaattgactttgaagaatagttagtagggtagaacgtttgttgcttgcttgtgtgtaggtaaggttgcattcccatcattggtgtagttcaatgatgagcgtgtaactatattaggttgcttgcttaatcaacttaaacaatataatggtttacacacactagatcaatgttaacatggttaaggtcttgtctttagtgtcacccctctccttctatcttctccaaacctatagcagatggtgaacacttgcgctagtggaagtggaaacaataacaatgatgagaacccaactcttgctcaagttctagctcaacagactcagttaatgaacataatgatgcagcagatgcagaaccagctcaaccaagggaacgacaatcctccaacgccacagaacaagttagctgacttttcttcgtgtgaggccgcctaccttttctagcaccaccaacccagtggaagtaggtgattggctatacactattgagaagaggttggaattgctccagtgcacagatcaggagaaagttgttttcgcttcacatcagttgcatagacctgcttcagaatggtgggatcacttccggatgaacagagcagaaggacaaccaatcacttgggaagagtttactgaaggattcaagaagacacacatacctacaggagtagttgctttgaagaagcgtgagttcaggacattaaagcaaaaggatcgtaccgtgacagagtatcttcatgagttcaaccgtctagcacgttatgttccagaagatgtgcgtactgacaaggaaaggcaggagaagttcttagaaggcctgaaggatgaactatcaattacgttgatttctcatgactatgctgatttccaagagctggttgacaaagcaatttgacttgaagtcaagaagaacaggatggacaaccgtaagagaagactgattgttttcaaggaagcacagggtactagccaaaggcagtgtatcaagcaatcccaagttgatgaatcaagtctaacatctcaagaacagtcgcaacagttgaacatcggtgatgagatcaattcagagactaatgcaagcaatgaagttaacatcaagcaagctactcaatcagtgccagttcagcagaaccagtctcaagaaaataatagtagtggaatggaagggagcagcaggtatgtttcaactgttacaagccatgtcactttgcaagagagtgttcgaagccaaagcatcagcagccgcaaggtcaagtcaacaacattgtcgtcacaggagccaatgcagtgcaagttgcgtcttcaagtgttacagctcaaccaccagtttcaaagcagtagtagttttctttaaagccttagaataattatcagacttatggaataagatagactgcagtttacctatgcccttttctttctagccgttccgaatctcgggacgagattctttgtaaggggggtagatttgtcacagcctgaattttcgtttcaagatttataaattatttaataaattattaatagaatttatattaaatgttcattaatttacaagtgaagtgaaatgtgggaaatcaaatttcctaattataaagcatgggtggatttaatttttattaaattctccatgattaattatactctctgaaattttctcggatttttcggagctcaattattaattttaataatacaaagaacatttcagtaattattcacatattaaattaatcattaatgagctggtttcaatgtttttaaatacttagggtgtccaagtatgttcaagatttttcttggaattatttgaccattggaagtatttttaacaatcgaaagatcatcttattggttaatttatttggaaaagtaataaaatcttcatcctcagcttgggcccttttcagcccattctctcccttcctctcagcccgcagacaagtctgcttttcgtccctctcgctacagtgttgtcttcaacccctagacagagccgactgtctccagcccgtgcacagttgccgccgcctcctccttccaaatccggcctctccgttgctcctttttccaaattagttgtgggaatggaatcctctcaatctcctcttccttttccccaagaaatccccaaaatttctatggaaatcctttccaatttcgcggatcaatctttcctttttccggcgaagatcctaaactttcccgagtttttcccgtcgatttgggcccgaacccgagctcctgtgcctatataaaggaccccctcgtcgtcctctacctatcccctcaagttccatcttccgccgtcgtcggaatcgctctccccgcgctcttcttctctctccaagcgccggcgccgctccagccgcccctagccgtcgcttcggtcgtcgccgtcggtcgccgtctccttcatcagcatcgcgaggtcgtcgccgtcctcgtcccgtcctccgtttccgccgaagatcgccagagcgccgctgacactgtcaacccgaagctcgccgccgcattttgatctccggcgaggccactgctgctccttccgtcgtcgccaagctttgccgtcgcctccattggattcgcagctgcgaagtgaagcccggccacccctccgttgttgccgcacatcgccggaaagtcgtcgccgccgtggacagtacctcgccgcccttcgaagctcgtcgccggccatcttccgtcgctgtccgtcatcgcgtaagtgttggtaaggaccgtcgtctcgtgctcttcctcccggtgccctccgtttgcattattgtgccgtggttcgccggcaaccgctgcccctatgccgttcaccggtgtaggtttttccctagggtcttaatccaacataatctaatccgtgatttgtctagcgttgtcatctccgtgtgttgtagccggaccgtcattgtcgaccctttctctctgatcgctttggttcggtgagacttctatccgttctcttttttcagtggcatattatttctttttaatatatgccatctactaaatataacctaatcttttctgaatgttgctttaatcttttcttaattataaatcatttgtaaattgtttaattaatttggaatagttttttctttaataggtttaattggaattaaatcttataaaattcataagtaatttatatgaaatcggaatgaggccgttcaagtctcataattcatctaaaatcatgatctacatgtttatttactttatatgtattgtttatttggtttttattagtctttttccttgttttatgtgttagcttgtcgtttcgaaggatcgtgagtgcgtcggaagtgttcaagaagattaattgaagaccgaatattgcaaggcaagtcacatagatcccaaacacaattcctttgagcatgttgatcctatatttaaattctctatttatttcaagtatacatctattttcgaatgtcaccgggtggtgtgaacctatttctttgttatggccaatttacattgattatcctatttcttgattacctcggggtataatttgactagttgtatttatatattggttcaactagatacattagatataattgcttagccatgtttagaaacattagcacactattgggataactaatgtttcacatttacttaatgataactaatgttttgctattacttaatgattggttaattaattaatgtgccaactaaaacttgataatggtgggttgtgagcacatgattttgatggtcgtgctcatgacaattaaggaccggttcacgagtttcggttgtgaaacattaaccgtgccaaacacaagccagcataggcaacggctggacactttgtatagcaaggctcattgtggtgtgccagactgagaagtggcggagataagcccacgggggtcgctggggagtctatgcctttggtttttgagggggtgactacgatccaggaaaggtgcgctgctttgagttgagctatgcgaggggtcttgtcacaactacacaaatggtgacatgttcagcatgggcacatgatgatatggtgacatattatggagttgtgtcttgtgggtacagtggtacacctctggccagagtaaaactattcgaatagccgtgcccgcggttatgggcgggtctaacaatgtctttcgtgattagtctcacactactcattaataataatgtggtaattgatggtaattaatttagctcctggtttggaatggtacattcctggtttagagatagatctgtacagccgtgtatagttgttcaggatggttgggcctgtgcagcatgggtgtgcagttcagtgttaattaatattgatgattaattactctactgttttagaattctcaaatgttttgctaaatgctgcttttgcaaatgagctatatattatgccattctttggtatccttgtgcacttgcatatttgttgtgtggcttgctgagtatgtcatatgcccacattgcaataatcaatcgaacctcagttgaagacaagttgcgaaggagaagacgtttggcttgtaccccagttgagctacttgtggtagtggatgtcacgccctgaagtttccccctttttccttgctttaaaaatttgttaaataaatcgtccgaagaaattgtcttaattaacctagagctaaatccctaattaataaaggcatttaataattggaattggcaatgtgggattttccttgagttccacatgtcacaatacattaacaggattgatttttagtgaaattttcagagccttggaaataattttaaccaattaaaaatcaccaaagtgcaattttaaatcccaggaaaaatcctttcccctttttccctttttcgcttttcttttcctctttttccatctttttgggccgtcggcccagtccaccccccctttttctcctacccgcgctcggccttcctcttgttgggtcagcccatgcgcccctccctcctctctctgggacgccgataggtgggccccacctgtcggtcgtctcccacctccggccgttggagccggagctccaaccgctgccgccgaaaccgccgcgccgccgcctcctccgctcctcccgtgcccacgccgcgtcgctcccgcgtcctccccacgtcgccgccctctcccccgcatctcccggcccgcgcgcgcgctcgctaggggcgggattcgaatttgaatccccccattctctctctctccacccccacgtcgccggccaaatcggccacctccccggccacgtccgccccctcccgcacctataaatcgctccccgcgtccccctctctcgtttttcgcactcgctgcgcccttccgtgcttcctatcctcgccgcgccgctcgccccttgcgccgccgcctaccgccgtctccggccacgcgccgccgccactatagccaccaccgcgccgcgcagtcgctgccgtcgcgctcaccgagcccgcccgcacctcggccgccgcttcgttgccgcaaatcaccgccggagctccgattccctcgcgtcgccggtgagctctccattttcatccatctccggccggccactttggccgccgtggtcgctctccctactcctaacccctcacctccccttctctaggtgccgccgccacccgtccgccgtccgtgtcgccggtcgtcgccggccgccaccgcctcctctggtgaggactcccctcctccctccttccctatgtgccgcacgcgccgcagctctctgtgctcgccatcgccttcggccgccgccgccagcctgtgcgccgtccgccgccgcctcccgcaccgccgcttgttgttgccggcgctcgcgcgccgccgccggtcgccatggccgccggtcggcttcgaagccgagccgagccaaccgggcacccttcctctcctcttgtgccgctgcccggtggggcccaccagctggtggaccccccttttagccgctgccggtggggcccgcgtgccgtcgccacctcccccccttttagagccgctgacccatggggcccacttgccggcgccgcccccctccttggctgacgtcagccctgggtattattgcgcaataaattgattaaggactttttctttattagtaaaaacacagttttatcttctaaaattcataagtaattcatccgagctccgtttaagtccattcaagtctcagtaaattcataaaaatgcaaagaatccattaaaaatggttttgtttcctgtttcattagtcttatagcatgttttgcttgtgtactttgtttgtcgcgtagatttcggccgtttcgtcgatccgcggtttctcgaagacgttgctgaggtctcatcagtgcgagagcaacgcaagtcatgcattacaattgatcatattgtacccaatttacaaatatcccgcatttctattaaatgtcgcattcttttacaatgtcatatgggatgggtcctattactcagccatttattgtttaccatatgccattaataacttgggtatcaaaatgattagatgttggtttaggaaatgcttagccatgcttagctccactagtacacaaatggggatcacattattacatagactttgactatgagcatagttttggattggtgccaccgcaatggtgttagttaattaaaatacactgaatggtgggctgtgggtgcatggttttgctggtcgcacccatggcaattaaagaccggttcacgggaaaccctgggagacttaccgtgcttaccacaagcgagagtgggtaactgcttgatctgaagtatagctcgaccctttcctaggcaccggtggcgagggtgggcgtaatggagttgggtcggccagggtgtccggttgtccagctgccagattcaccgcggcgcaagaggggaccgcccactgcccgttgggggtggaggtgaaaccttagcgtggtgtggatggttaggggagggttatgcggagggtcttgtcacgatttccccctttgcagtattatggtgatacttcggggcatggtgacatgtgtggaatcgtgtcttgtgggtacagttgtacatctctggacagagtaaaactattcgaatagccgtgcccgcggttatgggcgatcaaccagattcaccgtgattagtctcacccctagtttagcttaatgaactagtgtagttcaggtggttggttgggcctgttgcaacgtggtgtagcgttggacagtgattggttaatattgattaattactacagttgttttactgctttcaactactgcttttaaatgctagttttatgcaaaagaacccctagcctcctttggttatatcctgcatcatacctcctcttccggtatgacttgctgagtacagtgggtagtactcagtcttgctctcttttcccccacaccagagttgaagttcttctcagttggagctgtctcagaggggttggtttcgtcgctgccgtcaaggtttgcctatggagtggagtcgcccgctgctgaagtcaagcttccaaggctagctcgttttatcttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacagtggagccggagcttcgctagatcgttattccgctgctattttctcttttcatttgtaagtatgtaacgttgtattattgatgaatctgtatattaaattgtcagcttgtgtacctcggctgattcctggacgagggttttatgcacaaattagttcggaaattactagtgaatttctgggcgtgacaagttggtaccataataaatggcgtcgtcgtcgtctccatgtgttgccgccggttcaccgtcgtcatctattcctctccgatcgctttggttcggtgagacgtctatccgtgttccctcggtttagtttttaatctctcgtttgtgtcgtcgagtagccgccgccgtgccacgcttagctgctgccctagcgtcgccactgcactagccgcctagtcgtcgctgtgccgctccctgctacagccgtgctgctgctgctcgtgcgtgacaagtcgctgccgtcccgctaccgtagccaccatctgccgtcgctgtgtgtcgtcgtcgctgtgatgtcgccctaacccgagccgcgtgtctccgccgagtcaccgccgcctggccgagccaagtcgccctagtgccgccgtgtcgcagctgtgtgccgctttaacctagccgccgctttaaccgttgctcggtagtcaagttgtctagccgtaggtgcatccctaaattcctaccggcctatcgtttgccgtaccggggctttaccgtgaatcgtttctagcccaccggtttagccgcagccattgttgagtcgttcgctcgttcgttcgaacgaggtgttacccgtgcttcgttcgtttgtccgtgttgagtcgtcctttagtttagagccgtttagagccgccggttccgttcgccggtttcggttgatcatttgggtaatcccgtgtcacgtagaattgactcgttgagtcggtatctcgtgaggctcgcttgccagatcaatctaagccatccgttgaatcttggtcaactctatgtcaagattaatcttagccctccaaaatcgatataaatatgttctctcttttcagtggcatattatttctttttaatatatatcatctaccaaatataatctaatctatttccagaggttgctttaatgttttatctcagttataaatcatttgtaaatgatttaattaatgtggaatagtctttttctttaataggtttaattggaattaaatcttataaaattcgtaactagttcatatgaaatcggaatgaggccgttcaagtctcataattaatctaaaatcatgatctacatgtttgtttactttatatgtactgtttatttggagtttcttagtctttttccacgttttgcgtgttagcttgtcgtttccatcgtttcgaaagtccgtgagtgcgtcgggagtattcaagaagattaattgaagaccatttattgcaaggcaagttacacagatcccaaacacaattcctttgaacatgttgatcctatatttaaattctctatttatttcaactgtgcatttattttcgaatgtcaccgggtggtgtgaaactatacctttgttatggccactttgcattgattactctgtcctttgataccttgggttacaatttgactagttgagctttatatattggttcagctagatatattagatataattgcttaggcatgcttagaaacagtagcacacgattgggataactaatgtttcactattacctaatgatggatatttaatcatagctcacgatggctaatcgtgattggttaattaattaatgtgccaactaaaacctgataatggtgggttgtgagcacatggttttgttggtcgtgctcatgacaattaaggaccagttcacgagtttcggttgtgaaacattaaccgtgccaaccacaagccagcataggcaacgactttaccttttgtatagcatggttcattgcggggcaccagactgagaagtggcggagataagcccacgggggtcgctggggagtccatgccttgtttataagggggtgattatgatccaggaacggtgcgctgtggtggattgtgttgtgcgaggggtactgtcacaactcctttcagaggtaccgtggtggtattgaggcgcatggtgacatgtcgtggggctgtgtcttgtgggtacagtggtacacctctggccagagtaaaactattcgaatagccgtgcccgcggttatgggcggggtctaacaatgtctttcgtgattagtctcacactactcaccataataaatgatgctatcactggtaataattcatggtatcagattaggttccttctcgcttccacctcctctccaccccagccgccggtcggcgcaccctgccgccgccatggcttctccctcctccctcactgttgacgccgtccttgatgacaccattaaaatcatcgccgacgccgtccgctcctccttcaaggctccctctggttaggacgacgacaccctgaccaccgccgtcgctggcaccgctgccgatcgtgccgcgaccgcggcccgagcggcccttgcccctgttctcctcggtctccttccgacgactccggccgccgatgacgccatctcctccacggtgcctccaccggttccttcgatgactgcgccttcgacgaccgccatcccgccgccgccgacttccactccggctcccgcggcgcaacttccccccgagatcctggcgcttctcgcccgtctcagcatcaccacgacgccggccgcccccacgcaggacgccaccgcgcaaccgccggcgctcgacgccgccgcaccaccgccggcgctcgacgccgaagccgtcgccaacctccacagccaagccgtcgccgtcctcaacgtgaaggcgctcgtccccgtcaccctcgacctcgacgccaacaactactcccgctggcaaggccttttcctcgtcgcgcttggaaaatacgccctcaccgatcatgtcttctccgacgtacctcgccctgatcacgccgactggacacagatggactgcgtcgtcctcagctggctctacggctccatctcctctactcttatgcaggaggtgctctctcccacggcgacggcatgctccgtctggcacagactgcaccacgggtcaaccaggcctggcccacggcctacaacccgtggacaaggagcatccacatgtggccggtccaggcctccttggcgcgcggcctagcttcgccgggacagccttcaccaccacgcccgcgccggcccagcagcaagccttcctcccgccggcctatatggctcttcctaggccggcccagtacactgcaccaagcacggcgcctccaactcttgttgccgctgtgcaatctccattccagtggacggggccctcacagtgggacccacgggccctcgccaacgcgtacaacacggccacattaactactccaccgtccaatgaatggtacatggactcaggtgctacttctcatatgacgtctgacaccggtaccctctccacttcccaaagccccacccgcaatactccctctcatactattgttggcaatagctcccttctccctattacctccgttggtcacgcatatttacattaccccaattcttcctttgtgcttaacaatgttctcatttctcctgagattattaagagccttatttccgcacgccgttttacttgtgataattggtgttccgttgaacttgacccttttggcctctctgtgaaggattacccaaccaagatcgagatcgtcaggtgcaatagttcctgtgctctttatcctctcccggcagatgcgtactcctcggcggcctccactcgtgcctttgtcgcctcctccaccaacaccgacctatggcatcgccaccttggccacctcggtcatgaggccctcacccacttggcgtaggcgtctgttgtcacaccccgaagttttcctcccaagccaaattgtaaattacaaatgaccccaagaaaatgcagaggaaatcaggataaaaccctaagaaaacaatgcaaataataatcggatttgacatgtggaatttttcttgaattctacatgtcgaaattcattaacaggatttttagtggaattttcagagctctagaaataattttaaccaattaaaaatcactaaagtgcaattgttaattccagggaaaatccttttcttctttttcttttccctccctttttcctcctttttcttttcggatgggccgccggcccattcccctccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgtctccgccttctccgggccacgtcgaccacgcccgcgcgtgcgccgcattccccgcgcccgttcccctctctctcccgctcgcgcccgcgcccgagatggctgggattcgaaaaccgaatcccgcctctctctcctccccactcccccacgtcggccgtcgaatcccgccgctcccggccacgtccggttcccccatcccctatttaagcatcgccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgcggccgaggtccacctcgtccacccctcctccgtcgaggttcgtcgccggagccctcatctccacgcgcacgggtgagcgccacctctaccgccgccttcggccatggatcccgatcgccatggtccatctctctctctctaatccctctcttctccttccttagggcacgccgaagctcgtccgctagccgacgccgtcctcccgtggcttgccgtcgccgtccgccatcgccttcctccgcgccggccaccctcggtgaggcatcccctcccttcttttccccttcctctcctcctagagccgctagccgccgcttcgagtcgtcggccgtcgccttcgactgccgccgccgtttcccgtgccgccggtagccgccgtcgtcgcacgcgtgccgtcgccgtttaacccagccggccggtcggctttgatgccgagccgcgccggcggccgcatttaccgcgcgccccggccgcgaggtccccgtcgccgtcggttcggccgccacgtggcgccgccgcccctccttttccccgtgccactgaccagtgggcccgcgcgccgccaccccctttctctctctcccggtcgctgaccggtgggccccgcatgtcggcgccgcgccccctcgctgacgtcagccctggttaatattgcgcaataaattatttaaggatttcttttatagtaataaacacagtgaatcttctaaaattcataactaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccgatccctccgacgctccagtgtacttcgagatagtcgccgaggtccctccagcagcagagcaaggcaagtcatgcttgtcatttgaacatgttgatcctatattgcaaatgctctattgttttctttcaaatattgcattgttttataatattactatgggatggatacctattgttacagccatgcttttggatatcatgctcctttgttagcttgggttataacatgattagactttggactaggaattgcttagccatgcttagttcaactagcacacagtggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgcttaattattacaaccgttttcgcattcaattcctgtttataaatgctagtttttatgcaaatgaaccactctagctcttctttgttaattccctgcatcatacccctattccggtatgacttgctgagtacagtgggtagtactcagtcttgctctacttttcccccaacctcagagctcgagtatgtgtccgatggcgggttctccgaggagtaggcttcgtccgtgccgtcgaggatgcctgtggagtggtgttcccgctgcagttcaagtcaaggcttagctcccgtttcttttgttttccgctgcatttctgtaagacctttataatgtttgtaagacgtggatctgtatgtcaacattgtcgtttgtgtaccccggctggtcctggacgggggttttaatacacattctgcttggaattctattcgggaatttctgggcgtgacatctgtcatcccaccacctaaagtcactacatctttatgtcatgcttctcagttaggtcgtcatgttcgtcttccttttcccactagctctagtcgggccaaggcaaattttgatttagtgcattgtgatttgtggacatcacctattcctagtgtgtctggttttaagtattatcttgtcattcttgatgattgctcacattatgtgtggacctttccacttcgctttaaatccgacacattctccacattatctcatttttttgcctttgtgaagacacagtttgccacgaccattcacagcatccaatgtgacaatggtagggagtttgacaattcctccgcccgctcctttttcctcaccaatggagtctccttgcggatgtcctgccctcacacctccccacagaatggtaaggccgagcgcatgcttcgttccttgaacaacatcacccgctccttgctcttccaagccaaccttcccgctccctactaggtcgaggcccttcacaccaccacacaccttatcaaccgtcatcccaccaaaactcttcaacaccacacccccttttttgccctatatggtgctcacccgtcctactcccacctccgcgtgttcggctataagtgttatcctaacctcttcgccaccgctccccataaactagccccacgatccaccccatgtgtgttcctaggctatccctccaccataaagggtatcggtgtctagaccttaccaccaacaaggtcatcacctcgcgacatgtggtgttcgatgagacatgttgtaacgccccgattttcgttcgggaataaaaatcaattaataatacattttctagaaattaaataaaagttaaaccaatttaatcaagtggaattatagaggaaatttgaaattttcctttaaaaatcattggtcgggaatattttgtaatattctttgcgccctaatgtactctccagaattttccgtgaattttcggagctcgagaaatagttttaatagcacaaagatcattgcatcaattaaaataaaaaaaaacaattaaaatcccacttcctctctttgggcctttttcggcccaagtcttcctaccctcccgcggcccgcgcgccccttttctctccctctcgggccggcctcctccctcggcccgctcggctctctctctccctcaagtctgctttacctccctcgcccgttttcccctctctctccccgacaggtgggacccgaggccccacctgtcatcttcttcc

SEQ ID NO: 16701 - DNA, 11775 bp, Oryza sativa
ccgaccagcgccgttgcctccctcagctccgcaaggacgagaaggacctcggccgccgcccctcttcgcgggaaatccgccggagctcctccttcctcggtcgccgatcgaggccgagcccgtccgccccatcccgagcgacgcccgtcgccggagctccgtcgcgtcgtcttcctgaggagccccgtcgccaccgttccttgccgtcggccgcccctttgccgtcgtgcatctcggtgagcactcccctccctctcccttttcctccccttcgttggccgcttcccgggcgtcctcgcgacgcgctgccgccgccggtggccgtccgaccgggtcgctgccgccgcgctccgcgctccgtgcccgcgccgttgccggtggtgccgggcagccggttgccgcctcccccttgccgccgccgcgccttggctcggccgggccggcttcgtgccgcgcctgtgcccctggctgccgctcccctcggccgcccgatcggctcaggccgatctgggccatccacgtggtggacgcgcacccgaggccacgtgtggaccatgtccaccgtgcgccctccccctttgactcgctgacatgtggggcccgcgtgtcggcgctggccgcccctttgctgatgtcagcgaggtccatttcctctgtaaaaataaataataattgcgcaataaatcgagtttaattctagaaattcatttaaatggctcaaaacttctaaaattcatatctaattcattcgaactccgaattgagccgttcaacttgcaaaattcatctaaaattgagctctacatgtttgtttactttttatgtactgtttgtgtcacgcccagaaattcactagtaatttccgaacttatttgtgcatgaaatcctcgtccaggaatcagccgaggtacacaaactgacaatttaatatacagattcatcaaattaactaaaccgataaatacttacttaagaggcacttagtcctcaccaagaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatatcggctcatttgcaaaagcagcatttagcaaaacatttaagagaagtaaaacagtggagtaattaatcagaaattttaaccaacactgaacagcacacccatgctgcacaggcccaaccattctgaacaaccatacccggctgaacagatctaactccaaaccaggagctaagcaaattattaccagttataacatctataattatggtgagaggtgtgggactaatcacgaaaaacattgctcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatttccgccacttctcagtctggtgctccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacggttgaccatcgtgagctaccattaaatataaccataagtgatagtgaaacattagttatcccaaatatgtgctaatgtttctaagcatggctaagcaatcatagctaatatctagttgaaccaatatatataaagctcaactagtccaattataatcacccaaggtatcaaggaataaagtaatcaagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctatttaaagcccatttaaaaagaattaaataaatttaattcaatttatggacaattttaatatgtagatctttattttaaacaacttttgcaacttgaaccacattaaactgagttaagatgaattagatatgaatttttaaagattaaatcggattaaaacacttaaatcggtttaaattgaattatgacgcaataatgaattatttttgaaaaggaaaaggggattattgcgtcagcggctagggtttcggtggaccgggcgcacgggcggcggttcacgcgaacggacggccgagatcgaaccaatccaaaacggacggccgagatcgatcgggtccacggcggctcacggcggacgactccgatgacgtcagcgatgacgtcaccaccggcggcggcggctcggcggctcgggctcacacgctcgccggcgaacggcggcgcggcggcgcgaacggaaagcaccgggatgaagcggacgacaaggcgaactcaccggtgaccaaaggaacggcggaaaagcaacggacgacgccggcgacgaggaggaagcggcgaagctcttcggcttgacgacggcgacggcgctccggcggtcaacagcgacggcgaagcggcggacggggacggcggcgacttggcgatcccgacggtggccttcccgagtgacgacgacgaccgtagcgacggcggcgcacggctagacgaacggcggcgacggcggcgcaaaagctcccgaggctagggcgctacacacgacggcgggcgaaggcgagggaggcgacgggtagaggagagcttgggggtccttataaaggggctagcgagcggcgacggaggcccacggcgaccggcggcgagaaggaaactttagggtttgggagagagaggaatccgattcgatctcgattccatcgagtttccaaaccgaattgaccggagattccaaaagagaaaaggaagaggagatcgagaagatcatttcccctctaaagatttcaccggagaaggaaagaatcgagcggatttggaaggagaaggcggcggcggcgcgctagggttcgcgggcggcggcggcgacgcgaggaagacggatccgacaagcggggcccacctgtcagcgaccgaacgcgcgcgcgcggctgcggactgggccggctgggccgaggagggagagaagagaggttttgggccggctttcggcccaaagccaaaagaagacttttaaaacctttttcaatttaaattatttcttaaatgcaattccatttattaaaaatacttccttagctcaaataaatcccagaaaaatctaggaattatagaattaagcaaagtatttaatgaaattttatctagcccaattttatattgagatttaacaaattaaaattagatcttctcttataagcttttaaaatcatttctaataattccttttaaacaacaatttataatttaaggatttttaaacaagaaaagctcttaacaattataattagatcattaatgatcaaataattactgaactgttctttgtattattaagagttgagctctgaaaaatccgagaaaatttcagagagttgacttaatcatggagaatttaataaaaattaaatccatccatgctttatatttaggaaattttatttcccacattttacttcacttgtaaattaaagaacatttaacaaaaattctattaataatttattaaataatttataaatcctgaaacgaaaatcaggatgtgacagtttgcttggtttttattagagtttttcctcgttttgcgtgccaacgtgtagttcccgacgtttcggaagatcgcggtcgcaaggataagagttcggaagattgtttgaagaagcaaggcaagtcacacattccccttgagcatgttgatcctaatttacaaatcttttactgtttgcaaataaatatgcatgttttgctaattacacgggatcagggtttacctatctgctcgcttgtgccatgtttacttgatatctatcatttgtcaaccttgggtaataaatcgactagctcatgttacttatttgacccagctagaactatatgcttagcgatgcttatttaccactagctcagttgatgggataattacagtattagacctttttagtatcagagtgagctgcgtgctcgagacatctggccatgcttcatggtcgtaattatccaactaaaatgcgactgaatagtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgagccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaagctattcgaatagccgtgcccgcggttatgggcggtcgaccagattcaccgtgattagtcccatcttaataaatcgacccaatacactgtagttcaggtgggttggttgggcctgttcaacgtggtgtagcgttgatcagtggagtttttaatgttactttaattacccaacagttttactgttttgctcaataaaatgttttacaactgcctttatgcaaatagccacaaacccctccttgtatccctttgcacgtctgcatcgttggtgtggcttgctgagtacggtggttgtactcagtcttgctattattccccctttttcagaagtgtagtgcttctgagctgaagatggagttagaggaccaaggctcagaccccagttgagttttgactgtggagtggagctgaaaccccgctaggatcgcctttttccgctgctgtcgttctgtttcggtgtgaggactaagtgcctcttccgtaagtattttacgctttatttacgtttggaactgtatattacttgtcgttttctgtaccctggctggtcctggacagagatttaatacgcaaaatagtctagaaatttgggttaaatttctgggcgtgacaaagtggtatcagagccaacttgactgtaggttgagccaaatggtcaaaccctaaggacaagttttctgaaaaaccctatttgcaaattgtctcctctcgcccttcgacatttctttatgaaacggtttttcaaaattctcctcccagtccctccaatcctcatagttgttaaacctggaggacaaaccgtcagcttcacgcctattcggaagtcaagtcaagcttcgtgcaaagagtgagaagatcagcccagagtcaagtgaagttttcccggagttttcctaaacccaatctttccctgaagagtagtatcgttagctgctagatcgtgtgttgtttgcttgtgtgtaggggtatggtttgcatcattggtggggatgcgaccatactaggttgtttgcttaagcaacttgaatcataaaatccattcacaacagatcaataggcaagtggtttagtacctcctctctagtaacccctcctatttccccatctctctattgcctgcagcagatggtccgcatgagggacaatttcatcggatcaagaccccgtcagtttcatggggcaactcagtgcaattctaatagtattccacgtcagcctcttgaaggtcagcctcaaccccaagtcatggctaatcaaactcagacagtggaagagttgttacaacagatgcgacgtcggtaccaaatatactagatgcaacagatgcaacgacaatgtcaggagtcacgtcaatgtcacccaccgcaggtgcgagatcagatgccagcccggaacccgaatcagagtcagagtcaggagttcccaatatcggcaccgaagacccctgtcaaaatgctgtccagattcccgaagataacgacagccaagtcaacgtcagaccaaaggaaagtaagtgctacctgttatgactgtggtgagcaaggtcattatgtaaggaactgtccatggaaggtgttcgccaggtcacctgaaaaagacgagaagcagtgcccagggagtaaccaagctccaagtcagtctaccgacaagaaggatggtactttgcagcccaactctggagcgaacaggacagtgatatggaagatggataatggcaggaccatgatcatcaccggttcagaatttactcctgaagacgcagcaaggatacccaagcgtcagagaggaagaaataccttccgaggagcgcgtcagctaacccgtcatctcataaagtacggtccgcccagacccgaagatgatgaatcaggagaacggttttctgctgatgacgatgacgacaacgatgatgataatgatgagaatgatgatgcgacccttgacagtttcagggaaagagagttgaagttcaaagcatgtgctagatgtgggatagtcggacacactgctagtttatgcctccccacatgccgctgtggtgaatatacccattactcagatgcatgccctttaaggaaggtcacatgtttcttgtgtgaaggaacagatcatgtgcctaaggactgtcagttgaatgcggtcatagctaagaccaagaaagaacaagggacaaccgtgcaacccattcgtcaaccaatgacaatcgacaacagcggtcacaatccttctgctcttcctccaactccagctccagtggaagccaaccatggaagaagcaacgtcaccaaggatgttcataagtctctgcttgttcccgtttcagctgccaaagtgcataatcagaagcctgcaccctgggaccaagcaagtcgatcctgtcgcaactgtcgtaagccaggacattgtttcagtgattgccctcttccaagagcagcaaaggcagttcgtcgtgattcacaagttaccagcactgcccatgacaccaatcgacacctaaatgtgcaacctccgccccaacggattatcgtcaagggcaccgtcaaaggtcgcattgttccaccggcaatcgtttcaagcctacaacaccaacgccagcaaggtaagcaatgccaggagaataatagctcgctacagctacaaagaggcagtacactccttcgccagcacccgcggcaagcttcgtcagccccaggtcacccagcagttgtcagctctagcaatgcacctcgtattgctccaatccaaaggcccatcggcaaatcaccgctcggtaaccccgcgagcaagaagttcctacctgctgcagctgtcaagagagttgttactccaccatcgaagatcaacaagcagagcaacattcccggtgagacttcagccagtaggaattaaagaaacaagtcggttaggttcgaataatggaagcaatagcagtcctagccaagccccctacgtttcaagttcagcagcagtctacaagtgtttaaccttatagcacttctctctgtacatagatgtttatggcagttatgtaatgaaaagggaatattgaataaagtttgagtcagtcagtttctcttcttttatgattcatcttgagcatgcaaaagcaagttaaaatgtgaatctgtcggtgtcacaagaaaccaagagtttctcttctaactcatcgcaattctgttgaagctccaaaacctgtttgcgagcaaatagaggaatggttaactagcagattgaaaatggttagacgctcaacacccaacatgatgagatctctttaaaggcagtatcaatggtattcggatgaaaagagtgatggaatatttgaaagtgacatcatataaagaatcttgggaactcctctaaaccttggaagccgttagaggatggtaagcggaaatttacaccctagtggtgcgatcatggatcaattacatttttccttagttcaagacagccagtataagctccaggaatcatctcaatgtttctcagaagttgaaaaagaaattgttccatacctgggtcagaagtatacagagtcaagtccagaaatgtgtagttagcagggtatatggcatagaatcccttttaacgaatcatctttaccgaagataggaaagcgaagtggttatgatcaaaaagcagaaactctcggcagtatcaaagtcaatttccggcagtcgttcagattgtagtatttttgggaaaacaattgcagggcctatagtccgtaaacccaggaagagtcagcaaaggacgatcgacgaagtgtaatgtcatgtcaagagaaggacttttgagtttgatctgttaagtgatcagtgggtatgcaatctatttaggcatacgacaccgaagtcaggctagaagcgggacagttatgccagcagttcaattgttcccagtcaggcgaaatgtatgactactcctgtaaggggggtaggtcgcagagatgagttctggctcacctcgtcgctgtttcagttgaaggagccaattgcaaggtgtcatgcagaattacgccggtcctaggtcacttgatggaattctgagggacaccggtgaggccaggtcaacagcttagcttagagaagcaacagtgaggacagttgcggttcagacgaaagacaggtcaagcaggtttcctggaattacgtgtcactcgagtcagaacccgttcaagcggacgtaggatcaatgagttacaaaggtcagatgcaagcttcaggaacaacttcatcctcttcgagtcagcatggtgaattgtcaggttatcaaaattgctaacctcaacaattcagtccaagataagtaagttccttaagcatccacagccctgtctgggtcagttgaagtagaaccagtcagtccagtcttgcaaagcaaaggaacagaaaagttgaatcaatcagttcagtcgtgcaagtctggacaatcagtcaatcagtcagttcgagacagaaagggggcagtgcagtatgcggatccgtccgatcagtcaaaccgcccgccagctccagctttctttctagccatcccagaatctcgggacgagattcctgtaaggggggtagatttgtaacgccccgattttcgttcgggaataaaaatcaattaataatacattttctagaaattaaataaaagttaaaccaatttaatcaagtggaattatagaggaaatttgaaattttcctttaaaaatcattggccgggaatattttgtaatattctttgcgccctaatgtactctccggaattttccgtgaattttcggagctcgagaaatagttttaatagcacaaagatcattgcatcaattaaaataaaaagaaaaacaattaaaatcccccttcctctctttgggcctttttcggcccaagtcttccttccctcccgcggcccgcgcgccccttttctctccctctcgggccggcctcctccctcggcccgctcggctctctctctccctcaagtctgctttacctccctcgcccgttttcccctctctctcgtcccacctgtcatcttcttccctaacctcccgtcaccccaatggccgtcatggccgccggtttcgccccacgacgccgcggttcccgcgcttcaccccgccccacgagcgcgtggaatcgatcccctccacctcctccacttttcccccactctccccgcgaaaatcggcgccggttaacccctccaccaccccacgtcggcgccccacttcgccggccgattccgccacgtccggcctcgatcccgccttcccgagcccataaaaagcacccccgtgctcccctcgtccatttccccttgtttcccgggcccggcactctctccctcgctcttccccacgccgctcccgcgcgccgccacactccggcgaactccggccgccgtttcccgtcgctagggtcgccgccgccctgctccgccgccaccgccagctttgccgccgcccgggcaagctcggccaccgctccatttcccctctccacctctttagcgccgtagccacgcgaaccacctctctccgccgccgcccccgactccagccgcgtcgcgccgccgcttcggtcgacgccgaccagcgccgttgcctccctcagctccgcaaggacgaggaggacctcggccgccgcccctcttcgccggaaatccgccggagctcctccttcctcggtcgccgatcgaggccgagcccgtccgccccatcccgagcgacgcccgtcgccggagctccgtcacgtcgtcttcctgaggagccccgtcgccaccgttccttgccgtcggccgcccctttgccgtcgtgcatctcggtgagcactcccctccctctcccttttcctccccttcgtcggccgcctcccgggcgtcctcgcgacgcgctgccgccgccggtggccgtccgaccgggtcgacttgcaaaattcatctaaaattgagctctacatgtttgtttactttttatgtactgtttgcttggtttttataagagtttttcctcgttttgcgtgccagcgtgtagttcccgtcgtttcggaagatcgcggtcgcaaggataagagttcggaagattgtttgaagaagcaaggcaagtcacacattccccttgagcatgttgatcctaatttacaaatcttttactgtttgcaaataaatatgcatgttttgctaattacacgggatcagggtttacctatctgctcgcttgtgccatgtttacttgatatctatcatttgtcaaccttgggtaataaatcgactagctcatgttacttatttgacccagctagaactatatgcttagcgatgcttatttaccactagctcagttgatgggataattacagtattagacctttttagtatcagagtgagctgcgtgctcgagacatctggccatgcttcatggtcgtaattatccaactaaaatgcgactgaatagtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgagccctgcgacggcctctgtcg

SEQ ID NO: 16702 - DNA, 10677 bp, Oryza sativa
tggtgtggcttgctgagtacggtggttgtactcagtcttgctattattccccctttttcagaagtgtagtgcttttgatctgaagatggagttagaggaccaaggctcagaccccagttgagttttgcctgtggagtggagctgaagccccgctaggatcgcctttttccgctgctgtcgttctgtttcggtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacacatgttttccttttgctgagatgactaatgatgcagttgctactgacttgaagtttcttgaggatttttcagctcctctccctgcgccgattggcagtcgccgccgccctggtcacactgacccggtggcctgcacgcccacggccctcaccgagcatagccgctctcggccggccgctccaccaactgggccggccactccaccaactgggccggccgctcgcagcttccccgcacaggcttcggtgcgctcaaccactgctgggccgtcgggcccaaccgtcactcctactcggtcggctggtgtgccgaccggaccgcctgcccctcggtcgccctggtcagctggcgcaccgactgggctgtctttacttgcgcctgcctggtcagccggcgtgcccatcgagctggctcccctaccgacgcctgcttcgttggccagcgcgcccaccgagtgagctcccctgctaccaccaccgactggtgctgccacacgcgcccgcagtgcgcgtgtccccggcattcgattgccaacgcagctcggcatctctcccatcatcaatgagcacaccatgacgacacgcggcaagcacggacttcaccaacccgtcaagcgctacaacttgagtgccaccactctctctccagttccgcgcacatatcgtgccgcactggccgaccccaattggcggtccgccatggaggaagagttcactgcgctgcaggccaaccgtacatgggacttggtcccccgcccaaatggcgccaatgtcgtcaccggcaagtggatcttccgctacaagttccagtccgacggcagcctggacaggtacaaggctcgctgggtccttcgcggcttcacgcagcgccccggcatcgacttcgacgagattttcagccctgtcatcaagcctgccacagtccgcactgtcctcagcttggcggtctcccgcgattggccagttcaccagctggatgtgaagaatgccttcctccataggacacttcaggagacagtctactgcactcagcccgccggctttgttgaccccaccaagcccgaccttgtgtgccgtctcaacaagtcgctctatggtctcaagcaggccccacgggcatggtacagccggtttgccagctttctccttacactcggctttgttgaggcaaaatcagatacatctttgttcatctaccgtcgaggctcagacacggtttacttgctcctctatgttgatgacattgttctgacagcctcctctgatgcacttcttcggtggaccatccgtgctctccagtcggagttctcgatgaaggatcttggcagcttgcatcatttcttgggcatctctatttctcggcagtcctctggtcttcatctcagtcaacgccagtactgcctcgaggttctggagcgtgctggcatgacagattgcaagccatgtgctacccctgttgacaccaacgccaagctctctgccgctgatggtgccccagttcgtgatcccacggactatcggagtctttctggcgccctctagtacctgactttcaccaggccagatatctcttatgctgtccagcaggtctgtcttcacatgcacgatccacgggagcctcatcttgctgctctcaaatgcatcttgcgttatgtccgtggcacggttgattatggtcttcacatccgccgctcctccactgttgacttgagtgcatactctgatgctgattggatgagtgcatactctgatgctgattgggcaggttgtccagacaccaggaaatccacctcgggttatggtgtgttccttggcgacaacttggtctcctggtcctccaaacgtcagcttactgtatcgcgctccagtgccgaggcagaatattgtgccgtggccaacgcggtggctgaaacttgctggcttcgacagcttcttcatgagctccatacccctccgagccgatccacattggttttctgtgacaatattagtgctgtctatctctcttctaacccggtgcaacatcagcgtactaagcatgtgaagatcgatctacatttcgttcgcgatcgcgtcgctgcgggatctgttcgagtgctacatgtacctactacgtcacagtttgccgacatcttcaccaaagggttgcccagtgccatcttctcggagtttcggtccagtctgaatgtccgttcccacgacgttccgactgcgggggtgttagattgtgtttatcccttgccatccttccttaatcttctccgatattgtttctataaatcggttgctagatatggaaggcatgtgcctatatgtactctaccatatgtgataatccaatctatcgtgttgagcctatcacacttttatggtatcagagccagaggtctcgagttcaaatcctggctggcgcgcaattaaataaaataattgcagcacactccaatattccacgcttgagacttgagggggtctcgcgtgagggggagtgttggagtgtataaagtgaattgtccgcctttccctatcagcttaggcttctaggtgcaactggctggtgcatgcaacttaatagacgacaacaacaacagcacgtacaacacctcccccgcggctctgccattcgtcagtcgcttctaccgcgccaccgacaggggaataatggagctcgatatcgcttcggatgatcgccggaaaccgccgccgcagatgcggatggcgattgagagttcattgatccattccagccgagcgctgcagagcacccttcacttggtcgacaatggcggggagctgattctggtgcagcggatgctttggccagaccattatgctcatgacgatggtagctacagaacaaagcgcagcaggaagtacgaggcgtggagggtggatttcgatgccgggatcctcgtcccggtaaagggtttcaactggcgcgccctgttcatcagcatgtcccgcgcgatctccgtgtcggcggagaccttaccatttgtcgctgctgataccatctacttcggatactgtggaaacttagaacggtatagccttgcagatggaagcatcgaacgtacacggttggaccgttttgagccgtgtacgatcgtggactgtctctcctattgcatccagggctttggacttatactctgagaagggtgcagtgcaatatcctacctagagaatggaaacaaccagagatgaaagaaaattggcttcgagtctctctattcaagaaacaaaagaaaggtaaaatcgcagtaatttgcaagatcgatcctatagaggaagaccacgcttaatttgaatatcaatgcttattaatctggatcgtgaaacagtttgattacatattgttattataactgataattgttagcttcttaatatgcatgttgttcgttcattatatcccgcaatgaaaatgtcggaaaataatgttacctcaaagcacatcagtacaagttgccgtagcaatgttagagaagaatatgtatgcagtatatcagcgttggattcagtgcaaatataatctgccgcctgctctgcagaaagggccaatatgcagagaagtttgtgtggatatagcggaaaaaaatacaaaagcgattttgctatacatttatcgttgtcaaatgtaatgttaggtcaaagcacatcagtacaagttgccatagtaatgttagagaagaatatgtatgcactatgcagtataccagcgttggatccattcatccagcgcaatataatctaccgcctgctctgcagaaacggccaatatgcagagaactttagtatatcagcattgcagaaacggtgtgaagtttgtgtggatatagcggaaaaaaaatacaaaagcgattttgcacatttgtcgttgtcaaatgtaaatacaacataattctgtaattatattgtaactataatataactttcatataattttaaatcggatttgtttcaaaattttgagaagggaaaaaaatcattgcacacttatgggtgaggggattcggttccacgacaaccgcttcgcggaaataacatgttatcacagaaatttggaaagttatatacaatttcacaaattataattacatgtaattacgctaatattatatcatatttacatctgacaaatttgtttgtcaacaaatatatatagatagtcactacaaacatatagccttaaaaaacttacacgcggctaaggttgtcgagcagacatcatcaccgggtctgatgccgattgcctggtggccttctggttcagccacggcgatgtcgcacgggtggacgcccaccaagagagttggcgacgtcgcatgaaaatatataaacaaaataatttagagtgtgccatatggaaatttgactccaatccaaatttgatttcgcttttcatacacacgacactacatataagatatatgaaaacctttacctgtattgttctatagcttgagcatcccatataatatccttgacgggctaaaccttaactttttcaagttcagttctaatccatcgctggttatactattatggcctcaagaatctgcaccttaatcagaaccaaaatgggacatagagtatgtatcctgaattagaaatagccggcgttactgaatataaaacatattctaatgaagttaaaataaaacaaaagacaccgtgtcatcttttattttgctaaggtatggattaatttgatatcctagccctgtggcttggcaatccggcaaagacgagtttcaactgagtctattatagttttttgagtaaattgcactcacagtgcaacaacttggtaggtgggtgtaatttggtataataatttaaaaaatgagcgttctagtgcaaccacttggcaagaaggtgcaatttagtataagaactttataagtgatcgtataaatacaataacttgtaaggtaggtacgattttgatacaataaattaagaagttgtgacaacttaattatttggagcattttttatataaattcaaaattttaagtacttgacaatatactagcgtggatttgtataaacatatttatatttttatcctaataactaataactctaatagctaataactgaaagtcaattaaactggatgtagaaattattatatttcggttgatatttgagaaggtgaagaaaacaaaaaattcttaaaggtaactgaatgtaaattgtatgtgcaatataattcttaaagattaaattcaatattataaggtaatatccataggattaatgtgtattggcatattgacatcgtgaaaaacctcacctagcatatgcttagctaaattgattcaccaaaatactaaattgtcaagttcttgtactaaaccgcacccacttgtcaagttgttacactcggacgtttaattctcaagttcttgcactgaatcgcacccacctgccaagttgttgtaccgtgggtgcaatttactctagtttttttatgactaagatataagaagataaaaaaacctctacctaattctaaaatttaaaattcaaaatacatttattcgttgtaacatgctgatgtttcatataaatatatttttttagaaatttgttccataccattgaaagttttcaagtttaattttataccatcgaaagttcacgatgcttttttaatggtagtagtaggaagagtaacggtggaaactctaacggtattaaagtgcaacacgaaatttcagtgctatcaaactaaaactggaaacttgtgatgatatggaacactttttcccatttttttcttaattccacaacaaattagaggcatttcactagctggggtaaaaatctagacagacgaagaggtgagattagagcaagtttaataatatagccatctactagctcccaaaattgaaatatcatatatagccaatctaatagccacttatacaatagttagttatagatatatactgcatcattaatatctaatccacccatctctcttacatactatattggaactcgtgctacaattagtcaaccgatagccgatcgactgataggccaatagggtattgttggtggtctcagccgatatagttagaccagatcggctatggacttggtaagatagaacataataaaccctaaacatgtctcatcggctataatatcatttgtttgggtttgataaatagacttcaaacggtatcatgtaaatagccgatagaacaacatttagagcaagaaaaatataatgtaccagctaatactctagtacaaacttatataggcaaatcaatctatataaaaatatcaaactgtgatcggttaatagtttagatagcacagccgataccgatttaccttgatataactatatagagtgatctatctatataagtgataaattacataaaacttggtaaagaagcatgtatattaggtaggatcggctgaaactccaatactatccttaattataattgtttctaggttagtttctagggttcgataaaagactagggatgatgcatcgcaaagtagataaaaaaaactagagtctaaacaatcaagtaaatatttacttttcaggatggtagatgtcttaactaatataatctaataggaatatttagccgataccggcaagaaccctaaagcgagaaccacccgatagagataaatctagatactaagactagattagctaagacatatgatagaagatgatcatgataaaaggattaaaacatctaaagggacataatagccccaatagcacaagccattgagacgtgttacctcttgcgaagcaaagtcgtcgaaaagtaaaaacaaaaagggtggcaatgtgccgaagttgtattagattatctcctatattacatagctatggggttcatatttataccccgagtacaaacttagtccattatggacacgactcaaattttctaaagataaaatacaaacaagaccatatacagtggtctcttaccaaaactaatcacaaccgacttaaactaacctaactaatagatacaattgccttatttaagctctatctctaattggcaatgactgttacctcaatctaggccctgctgagcccaagttatatctatcgtctacttgccatatcggccaagttaagcctttgttctttttccagccgatacgacactcagccgatgtgcagcctgacttggagatcaactcgattccacaccaaatccgtctcgatctttcttcttcctctccaaatcttatgcaaaattctgtcgttaacagttacccttttttttaacatacgcatggatcatatctctccttatcttgccgctgccctttctgacgacactggctcctgctgccactagagaatctcttaccagccacagtggtattgacgaaatatttcgcctctaatgtggaaaaacggaagacttagctgatcctctgcacgaccgtatcatcaatctgcatgttaatatcctaggcgaccctcatgttaggactttcttctttcaaccatgtccctttttttaatttgatccgacaatttcgctaggggaaaaacttatttttgttgtgatgaataatggtttggcagttgatttgatccatgatgagtagtccttgcttctcgtttcgacggcttgtggaggaatcatctccgacaacgacgatgaattttttttggccgcaacgcaaattgtgcatagctattggcactctgtcaatgcaccaaaacatggcggttctatcatgggtcatgaatcgattgatcgcaacagagaagcacacacttgagaggataatcctacctacggtccagttttattcaagcgcggaattgtattaagccaattttttttgatttatcttagctatatgctatgtctctcattagttatacttggtaggaatagaatgaaccgacctctatttctctgcacaatgaatgcaataaaggatcacgatgactattttgtgcagaagagaaatgcagctggtatactagtttaggcaaaaaaaaatgtcaactataccaatacaaaaataaaatctcggtaaagtataggaaactagcatgtaccatttgtctagttgaataaaatatagtttcagtacaattcattaataaaactttagggtgtagattaagaacaaatgattttatcattacttctttttagcacctacctagatcatcacagcaacacttgcactgcatcattcaacaagaaatgactactgtgcatgatgcactacctatatatatatgagtcaacctcaattgaactcaaagggagttagatccatggagagaaagagaaaagaaatgatctattactctgaaattacctaaaaattcagtagcagcacacgtcatcgaggtggccgaagaggcagagactaccgatgatgccaatgaagtggatgatgatggccccgacggcgacttggatgggcgggcaacggtgtcctagatcgacggacggtggcaccctagatggagggtcggcaacgccctagatggacagtcgatggcaacctggttagaggtcggtggcgctatggatgtcgggccgacagtgacctagatggagctgacaacggagctggtgcgaggaggggaaggtgacgtggctcctctcgacctagcgggcgacgaacgaaagagggcgatttgtttcggggaaatagctgtcgcggttggggaaagcatggggagggaaagaaaaattggcgcgaccacacacgatttctgcgattgggagcgcgtcaagttgcccaacatctagttatgattggtgctggttttgggtgtgcgtaaattttaggagccatgtttagagcatcaccaacagttcccccatactcttcccaatatcaaaatttcggtcttttgtgtaaaatttgacctccaacaggatccctactcttcctcccaaaaattgacattcccttctccgcatatctcgttctccacaaatcgggcatccctctccctcccaatttcctccaccgtcgcgatttggtgcgcgctaggggaatcctgcccgtcagaaggtcctcggcgaggtcgtccaccaccgcattgacctgtccagcagccgcaggtgaccccaactccctcgccaacgaccggaaacgtgatgctattcccaagcagccggtggctccatcttccacgcagctggctagacattcgccggtcccgtccatcgccgtaggtgaccccaactcccgcctgctttccatgtcggcttggcacctccctgtcccgtccatcgccgttgtttagagaactgctggcggcggcagcagcggactctcggagtagcctaggagtcggttcccatcgaccacacctaggggcgatctgttgtagctgggtctactgatcgatgttgctgtgctggtgctaatgttgatctgctggcctgccgctgctgcttgttgcttctgctactgtgttgaactgatgctgatcctagaagtagccattgctcgtaatggctggctggctgctgcttactggttatgttggtttgcttgctgctttattggactgagataattttctactaaaatgttgttggtgtgatcgcattgaaatacggatgttgtactaatctaatggttgatgttgtactgagatgttttcttacaagtacaaatttagatggtagtttacaaacattgcaggacaaaatatgtagaagtacagtcgtggcgggggagagcaacgttgtgggatgggaggtgaatgcaatcgtgctgacagcaagtgtcgaggctgatcatgatcactgcgggaggaggaaggaaacatatttctgattgtagttttatagggtctacttttcagtcttagagaattaattataggtcatctcttggagagatgattattttcacaccttaaatttcttttaggattctgaaaaaccaaattttgggatgctgttggtgatgctcttataagtctattggaggcctggttttgatcaaattctcaaaatttatgtttttaggaacctattttggagatgctaccttctgcagccaacagatacgtagacgcagtcgttccggtgtgaccaagccgtaacggtaacattatgcgtccgcctttggtccggtgtgacactgtgaccccgccgtaaccccgtaacggtaatattatgcgaccgccaggtggggggccaaaggtcgttccggtgcgacccaaacccggtggagagtcccacacgccaaagccgcagcagcagccgcaacttgcggcggttccaacttccaagcaagcaaagcaacccaccccct

SEQ ID NO: 16703 - DNA, 1131 bp, Oryza sativa
tcccccacctccgcctccgcctccgccgccgccgcctcctccatcctccagtccctccccctccacgtggtaactccccctccccaaccttctcgatccttcctccattttgctgttctaatccgctgtgctggcttggcttggattccatccccagtccttcgaccgcggcttctacctcctcgtcaaggcgatccaggagctgcgtgagcgcaaggacggcctcgtcgtcaccgtcggcatcggcgggccaaccggctccggcaagaccaggtacgggccgctcccctccttcccgccgcgcgctggttgctgttgctgattggtggtggtggtgttgtgcactttgtgccgggcgcagcctggcggagaaggtggcgtcggtgctggggtgcgtcgtgatcgtctccatggaggactaccgcacggtggccggggccgacgacggcagcgacgttgacgccatcgacttcgacgccctcgctcgtaacctccaggtccgtgcccgcacgttccttcgattttggggattttttttggaggggtggggattggatacgtgcagggtgcttgctttaatggcaggtcactaggtcagaatggcgtgacaaatggtgggcttgaatgctctgttccattgtactactaccattgatagggtgggctagtggttgttgttggagaatagagttgatggatggatacaaatgggggaagtagagttattttcagaaagagaaatgtccagcttcttgtctccgtgccactttatgttctagccctctatacagccggataatttgatcgcagtccatttggtccaaaaccaaaacaacagtttcttcttgataactattgtcaattgatatccctctgttaataattattttttaccaagccaactttacatgacatggtcaaattataaaaaaaaaatgttaaaagatgatcaagtctagtggtttgatactatgtagttgcaaggagtcaaatgatacaggaattgggaaagtggggtaaatgggtgttcctaatctaggaggagcattcaatttgtgcttccattgtgccctctacatctggaggttgcagaacagtttacatgcacaccaattgtattggaatatttat

SEQ ID NO: 16704 - DNA, 2410 bp, Oryza sativa
tgatcatgcggcaggaacgttatttgatgacacactttgtttggatcaacgtgtgtcgctgattttgctccgccttcttcatttgtgcgctgaggacacgctgcataatgaggctctcatagtgatccgcatcttcagccccaatatgctcttcaggtggctcattatctacatggtcagcctcaagcaaagcaagtgtatcctcatcgaaatcactagtagacgagtactcaccatcattttttactaccaaaactcgcttgctagggcactcacgctgcacatgcccaaagcccttgcaacggtggcagcactgaacatctcttgttctgcccgtgaatgccattgaagaagcactcgctgctggctgagcatcctttgtcgtagagcaaactagagggccatattagtgtaatctttgtagtctatgatgtcataaatctcgcggtttaaaccacccaaaaatctagccatagcagcgtcctctgtttcctctaaattacaacgaagcaagcccatttgtaactcctgataatattcctctacactttttgcactctgtctcaattgttgcaacctattcagcaagtcacgtgcatagtaagaaggaacaaatcttgcccgcatgacccatttcaaagcatcccatgtttgtggcatgtaattaggaattttcttgccatgttctatccaccaaaccgaagcaaactaagtgaactcactagtagcagctttaactctattgttctcaggaaattcatggcatgcaaacttttggtcaacagcaatctcccaagaaaggtacgcatcaggatcatatttccatcaaaaggatgtatcttaaatttaattttagaaaaaacatcatcatggttgcatacctcgtgtcggcggtgaccgcccatacctctacgattgttgcatagcggtagacaatcacgagcatctcgctcatcttgatcagtgatgaaccctgagttcctctcgacactcaaggctgttgttggcccgatctttcggtgagttgtgataactacgatttgggagaaacgttgacgatccgactacaaccgtacgagacgttgtgttgcgccttagcgttcaatacacctctccgtggattgttgatcttgccggtgcagatcaaccctattcctgcaagcaaatcgaagaaacaagcaagaacaagataaaagcaatctaatattgcaaataggaatttaatacaaatgataagttggggttccgaagaacaagcagacggacggtctagccgacacgcgcgctgcaagcaagtagcaatggctaaactttaatctatcaaaacccgcgataccctgaaggggtaccaagctatttatagagataggaggaccctagctcgttcgccacctgattggggcgcaccctacatgggccccacttgggccggggtcccagacgaagttacaagcccataggcccattacaggtgtcgcagcaccttgtttctttagttgctgcccactgagatggaatttggtaatgaggcttgatgcattggaaagaggactccgagagctttccatcaagtactcacgggccgaaaacggaggtcgtatggagattcggcggccgtttgaagtcagcagtgtagtaggtggccgaatcggattccagcacttggaggacttgaacttgatatcttgttgttcatccatgatgtgagcaacggatgtatccgtagtagccttagtcacatcattcagtatcaccagtatattcatcctctaaattatcatcgacgtactcaccatcaatgtcatcttcattacgcccaccattgcctctagcattgagataatcaaaatgcctcacaagagcagcaaggctaatgtcaatgcgggcgatcaatgtctccaaccctgtaagcttggtgttggtggtgatctgcgtggactccaattgcccaatcttctcatttgtcacctgcaaatctgcatcaagtccttctgtgtgatgctttgcttgccttgtaaaatattgtatgatgcctttggtgcatggggaatgagacgcaccctcatcatctttatccttggacctgccatggttaataaaacaagagcaacaaaacaacatatgaggtaatttaagccctacggctattgggatgtagcttttgcaaggcgctcactctcagttcactcgaagcctgtctcacaagctcttaccaattcttaccttgcccatagaatgggatggcaacccacaagtctgcaaccatagaacgaggtgtatcggtgccgtagcaacaagacctgtcaagctgtagtcgggtttgtggtggagctggcggtgggctgaaagtaatgcgcaagaaaaaaaatagataaccacgttagccaaagaagttgaataatcactcaag

SEQ ID NO: 16705 - DNA, 51717 bp, Oryza sativa
atgataacaagaaggtggggatgacaacagggatttggggggggggggggggggcaggaatgctcacacaagttcggctcctcttcttcttgttttttgctttctctctctagtgctgaggagagaaatgcgactttttatttttctttttttgatatttttttcacaactcacagcacactggaaccaaccacagaaattcttagctcaaatggacaaattatgaagcatgtagaatttttcaaagttctacccgaaggggtcctgaagcttctcgccttggaaacaaaattttgcaagtggaatttggcgattttaattttgccaaacatagattgatttggcttactagattgaccgataacattggaccattaatatatcttcatagaattaagcatcgttttggatttccacctcaagctatatatacattggctagactggtcaaaatgggagcaacgatagcgcctttcagtcggcacttccttcctaaggggatgcaggactgacaactatactatataggctgacggggcttgtttagcctagtcctacctcgatgaagctggtgattgtgaagttggagttgtggtgttgatagagcgcaatgtacgtaatgatgacatggatccaattaacttgggcttcggtgcaagtcgggttacattcctagttcttcttttcgacgggctaagccgcctgatcataggtgcaacgatgggatgacaatgacggtcattaccaatgtaaaaggaaacaaactcgttatgtgttgagcttgctagtcttgttgtaatagttaattaggtttgctaggtagtaattttggtgtgctcagggttttgaatcgagatatttctcttaattaaccgagcatgtacttaaatgccctatcgtttagtttattcggagaataagccaagcgacatatttttaaaaaaaattgtaaataaaaattttatatatgtattcttacttattaagcaaagactaaaaataaacttcgattaaaaaacctcgcaccggcaattttgacctgaagtccggagggaaaaaaataatagtaaagcatggctacgtggagcctgagggaaaaaaataatagtaaagcacccttaaccatccacccgttgatccatccatgtctctctccacgctatgggcacgcatcatcaattcatcatcatatatccccccatgcctaggaccatcgatcagcgctgcgaccacagccactagcccactactagtagctagatcgatggagcaatcaagagagagacgaatgtgtgatacaaatgctgataataaatcccatttattactggtcatacctcttctccccaactaagcaactaatgcttcaaacattattaatcaacgaccacctgctagcttaattgaccagtttaggggtgtttgatccacgggcgtaaagttttgacacaccacatcgggtattatatagagtgtcgcatggggtatttggacgctaataaaaaaactagttacatagttcgttagtaaacagtgagataaatttattaagcctaaataattcatcattagcaaatatttacttagcacaacatttttaaatcatgaagtaattaggcttaaaagattcacctcgcaaaattagtcgcaatatgtgcaattagttatttttagcatatatttaatacattatgcaagtgttcaaacgttcgatatgacagggtgtaaaaattttgtgtaggaactaaacaaggtcttagagcaagtttaatagtatagccaactactaactccaaatcatctataatcaatttaatagccaatttatataatagttaactacaaatatatacttctacattattaatatcggtcccatatgccatacacacaactactaactccaaatcatctatagtcaatctaatagataattcatacaatagttaactacaaatatatactatatcactaacagtccgtgctgtagctagcacaaatatttacccagcttctcttctctcccatcttttatcttctccgcatgtgcttatagctgatttatagtttgttattgtacctgatcttaggctgaattcgtttggatcttaagagacgacaacttctataattaagttataattagttaagtattagttgttataaatttagcaaataagtctatttgcttttaagaagacttctataaacaaaaaagtttttttaaaaaaaaccacactgtctagaagtttgtttagaagcttacaaaggctccgttcgttcacaggtgataggggagattatcactcgttttccacgcgcacgctttttaaactactaaacggtgcgctttttgtaaaaattttctatagaaaattgcttgaaaaaattatattaatccatttttgaagtttaaaatagttaatactcaattaatcatgcactaatggctcacctcgttttacgtatcttcctaatcatctcaatcctctctccctccaacacagccaaagcgtgctaatgaaaaaagagaaaaattaccacctcaaactctgaagcgacctcagccttctccgatctatgatccattcatccatctgcgtcgctctctcgcatagtacatatatccatccgcttgcaattttgcaaacatgcattgacaggggcacaggactaagcctaattactagctagtgacggattaatcacaactactagtcacagatcaaacacgaagctagagctggtttaatttcgatcagcgacctgcatgcgtgcctgtctcttgaaaaatgatcgacggcgaccggctcccctcatgaactcgatccttgatttcgtgttctagtcagggagacgtacgtgtcaactgcatacggaacagcggtaatgcattaattgcaattaatcacgacaataaataaaccgttgtcggcttaactacagagttaaatggagctagtgtacgtaattaaaaaaatacattaatgaatgtgaatttattttggagattattgttaataaccatcgttttgaaggggcgtttaactatgttgatgtgtttaccataagtaaattttctacacctacaattatttttttttcttcgatccttcatcaaatggttggttttgctttgaaaatacacagcaaagttatttgtgaaaaatgaagaaaatgagaatattttagatgatcgacaaatttggaaaagaatatctggacactagataaatcataagcataaagtaaacatagaatagaagttcttagtcataatttttttaaaaatattttgaattataatatattttcagtgtcacatttcattaggcggccactacaacaaaaacattagataaagtcactttagtaaaaacggtttttaatttgctactaaaatcagaagttccatatcttagagatatcagaggtacttttaaaatcgtctagaatacttttactctagagataatttagaggtactattaagtatgtttatgaaatttttgttgtagaggcgtcagtttggtacgttaaaattcgcctcatatgtaaaggtatttttaaaggtgttttaacataagtagagacacttcttcaagtaccaacgtatgctaagcaattatatataactattgcaagacacacatttataataatgacctgagattaagatgggttaagatggttagtgcattaaaaaaatattactcaagaggtaatgtgtttaaggatttgcaagggataacaattattactcagaagttgccgcacacatgtatctagaaagtgcctctattttcttatatagacattttataaaatacctcttggtttcaagagataattcgctaaaaacacttataagacatcatttaaaatgcatctacacatctttcgccctttcaaaattgctggtagggtacccaacccaattttcaccttctctccatccacctttgcactcctatgaagtcctcacaagtcttcaccagagttttcaatttcaaaattttggaaattgtttggcctacattatttgaaattttgactgattttgaatgaatttgaataaaatttaaccaaattcacaaaaaatgcaaaaaaaaaaaatttgggtgaaatgtgggcttgccatgggggggggcgaaattaccgaaaattcagaaatattggaaattttgaaccgaaatttcgaaaatattggaaatttcaaaccgaaactttaaaccctggtcttcacacatatctacaagtcttccttaactctcctcggcgttcacccatctccaccaattttagcctatcccgttgagtctttgactgtcttcattggtttatacctatcttgctagaaaaactaatatttttagggttaattgaatccacgccattataaattttactgttttgaaatataccattacaatttacctatttggagtcatgccattataatttgataggtatttaaattgtgtcactacttacccttcgatacattgaaattaaattttggactggattgccctttcttcttcctccattcatcccattctctcctggtgcctctcttcgttggttcgtcctatctcttccccactgatgagctcgacgagttccgagcgacccagtggatgcggcagctatggcaaagcaccctagccaggatgagtatgacgacctcgttggtggtcggatgcatggggggttgatctcgttggtggaaattacagctctcgacgagatctacaattttataggtgataactttttcatttgaaatcttttagatattcaaatctatgatttaaatctcagttaggtaggctcaaatggaacgatatgcattttctaacagaattgatgcgtaggtgagttggtaaaggagagcacgcgtgaaataaatagataggatgatagattaatatttgaacttttaatttggtacgtagaactaatgccacatatggagtggtgacaataatttttattataacgatgtgaagtgttgcaatataatttattaccactaaataaaaatagttgcaataacctattaccacgttatttcttaccatggctagcaatgattttaaaattgtggcaacatgtatctattgtcataattttaatattgatgccacgatttttttcgtggcaacaaatgatttttctagtagtgagagttatggcttagaccttttatggcagatctcggtgcgcagactcctttttttatatatttttagagagagaaaattaatatatgatctatttgaagctgctacatgtatgcgaatgatgcataattactttcgcatcggaggagttgctgccgatctgccttatggatggatcgataaatgtttagatttctctgattattttttacgaggagttattgaatatcaacaacttattatacagaatctcatttttttgaacgagttgagggagttggttttattagcggagaagaaactgtaaattgggacttatcaggccccatgttacgagcttccggaatacaatgagagttatgcagctggataaagatgcacatgagcaagaaatgaagtcggccaggaaatctggcggcaccggtggtggtctaccgtggcccggtctccacgcgcgacctcgttacagcgtgcaatcgccggagctgcagcggaagccccgcttcctgcttctgagccctgccaggtggcccgtcgccaccaacgtccatcgtccacggtgcagcagtggaatcactatttatttttttttcccgttccactaccccagctgctatttcagtatttcgctaccacttccaaagcacggatgcctgccattttcttgcgattaagcatctagtaaatgcaatctattccgccactagttaaccccacagcacagaagaattaaagctactgaagtcctcctgggcacaactagctcctccccgggcttccctaagcgattcaccctccacgggggcatgcgtgagctaccacgttcgcatcctccctaacaccggcccctgccacctccacgcgaagcagcagccatctgcaacacaagcgacgagtcgagcagatccgagagagatgggaggaagattggaaggagaatgggatggattaaggaagaagaaatgggtaattttgtccaaaattctctttcaatgtgttgaaggggtaagcagtggtatatttcgaatacttgtcaaattataatcgtatggttttaaatagatgaattataatgatatattttaaaatcatgaaaattataatagcacgaatctaattaaccttttcttattaaggatcagaaagatatggataatacactgatactgtaacatcaattataggatgagtgaaaactggtcaatggtcactcatcttttacaattgctcgaacagaagtaagtcataaaagttcgaatcgaaggaagccgatcaagttcaatgcatacaacgaggttcgatatatgatccgtacgtcaacattaaattaacctccagtttgttagtcttctcatttggacctataattacgactgtttagtaaacccattgaataggatggagatggatggctagtcccgaggacaatgttttcactagatcactgtcacatcctgattttcgttttagaatttataaattatttaataaattattattagaatttatattaaatattcattaatttataagagaagttaaatgcgggaaataaaatttcctaaatataaagcatggatggatttattttttattaaattctccatagttaattatactctctggaattttctcggatttctcggagctcaattcctaattttaatcatacaaagaacatttcagtaattatccacatattaaattaataattaaatggtctgtttttaatattcctaaatactttgagtgtccaagtatgttcaagaattttcttggaattatttgagcattggaagtatttttaacaattcaaagatcatttcagtgattaatttaattggaaaagtaattcaaatccccttttccttttccggctgaaactggaaaagttcaccttcagtcctcggcccattctcccttcctttcagctggctttattcctcctctgaagtccatttcttgtccctccttcaatcgggctggagaaaaagaagcccagtcaaagtctaattcgcgtccctgctacagtgtcgtcttcaagcttggacataacccgtgcagccgccgagccgtgtgtaccgctgccgattcctccgcccgattcgctcgattctctgagccgtttcttgaattagttgaggggaaatattcttcctatcctcctctatcttttcccccaagaattggactttatcccgaagaaatcaacgcggaatcgagctcgattcgagtttatctctccaccaaacccaggttttcccggcgcgattccttgcgttccaagcccgatctctctccccacgctagccatctctctcctcctccggccgccgctccagccggctatagccgtcggctccgccatcaccggtcagcgccgtcgcctccatcgggaccgcatcgaagagaggaagagcggcctccacttccccgaagccgaagacaaccggaaggccattgccgacgtcaaaccgatctgcttcgcctccatccgcgccgtgccgtcgcctcggtcgtccccgacttgtgccgccacctccctcggcatcgcagcaccaaggagaagcccgtccacccctccgttgccgctgctcgtcgccgaaaagccgctgccgtcgtcgatcagtaccttgccgccttcggagtttgtcgccggccgtcttccgtcttcgttcgtcgtcgtgccgcccctcagtgagttccccgcgtcgtgctcgtcgcgttggtgccctccgttctcgccgccgtgacctagatcgccggtgaccgtaatgtcccgagaggccgttgatgacatcatcgatgatgtcataaagcccttttcccttctaaaaataaatcttaaaatcagtttaatcttgtaaaattcataactaattcatatgaactcggaatgaggccgttcgagtctctaaattcatctaaaatcatgatctacatgtttgtttattttttatatactgtttatttggtttttattagttttttctccgttttgcgtgttagcttgctgtttccgtcgttgcgaaggttcgtgagtgcgtcggaagtgttcaagaagattaattgaagaccgattattgcaaggcaagtcacacagatactaaacacaaatcctttgagcatgttgatcctatatttaaattctctatttatttcaactgtgcatttattttcgaatgtcaccgggtggtgtgaacctattcctttgttatggccaatttgcattgattactttattccttgatatcttgggtaacaaattgattagcttgaaccttatatattggtttggttcagctaaaagctataaatatatataattgcttagccatgcttagaaacattagctcattaatgggatgaatcatactacgttattatttatgattatatttaatggtagctcacgatggttaatcgtgttatgataattaattgataattaaaacttgtcaatggtgggttgtgagcacatggttttgaaggtcgtgctcatgacaattaaggaccggttcgcgagctactgttgtgagacattaaccgtaccaaccacaagccagcgtgggcaacggctttaccttttgtacagcatgattcattgcggggcaccagactgagaagcggcgagaagtccgtgggggtcgctggggagtccatgcctatggttatatttatagaggggtgattatgatccaggaatggtgcactgtggtgagttgtgttgtgtagggggtattgtcacagcctctattcgggtactttccagtatcgcgacgcatggtagacatgatgttgaggctgtgtcttgtgggtacagtggtacacctctggccagagtaaaactattcgaatagccgtgcccgcggtcatgggcaggttgagcaatgtttttcgtggttagtctcacacctctcacaataattattgatgctataactggtaataatttgtttagctcctggtttagagttagatctgtacagccgggtatggttattcaggatggttgggcctgtgcagcattggggtgctgtacagtgttggttaaaattgatgattaattactctactgttttactactcttaaatgtttgctaaatgctgcttttgcaaatgagcctatattatgccatcatttggtatccttgtgcacttgcatatttgctgtgtggcttgttgagtatatcatatgctcattcttgcaataatcaatcaacctcagttgaagaaaaaggatccagaaggagaagacgtttggcttatatcccagttgagctgcctgtgggagtggagctgaagccatcgctagaccgttaattccgctgctgttttttttcttctgtaagtatgtaacgttattattatgatggatttgtatattaaattgtcagtttgtgtacctcggctgattcctggacgagggttttatgcacaaataagttcggaaattactagtgaatttccggacgtgacaaccaccttcaactggtaggccaaagtatgaggcctagtggcggagccatctctcgggcaggtcgggcgactgcccgggtttcgccggtaccatctttactatcaatagccattgacatctataaagattaatcgatcaccgaaaaacactattaatcatccggactttgatggcatcgctggcttcgccactgatgaggaccttacattagcatatatagagtgtgcgattgaacttatataggcttttgtggcacttgtggatcatatagttcttgtgtggtcatatgtgttgacttttgtagctttatgttgacttgtattgttttagtctcggtgtgtcctctctagttctgggggttttatatttacacccttggatgctccattgtctggatagaattagggaggcaaatatagatacgatccgagtaaatcttataaatttataatgctcgagtaggactgtttttcttttcttatcggaactctttccttatctacttaagtcctctgccatatgtataaagcttgattccatatagaatttggtatacgacctggtaggcctcgtcaagccatatttagaaccgatacttgcgtacatgcatatacctcaataataattctatatactttctccatttatttttatcgtcgtattttagattggcaccaagaccaatgaaagcacacgtgcttatcatcctattcccaggccaacgggccatgcatgcctcggcccatgcccccacgtcgtactaaaggctttgactccacccacgctcgatcgttcgcatcattgccagcaggcagtgccctagacgaaaattggattgagtattgcccgggctcatattgccaaagcaaaattcgaaaattgaacttcacaggttcattggccctaatggggagggggggttgcagaaagcaggggcgaagctagcatcaagataagggggaagacaagggggtatactatcattgaaaatctagaacattttattacaacactgtatattgtagtctttttaagtgagaaattaggaatttagaggttcatgtgcacccccaaacactgtatagcttcgtcactgatttaaacatgtgagtgtgtttctgttatgcaagaatggttgggggtgtttcgtattacacatagactatttttttaaagttagcttgctaaatataaatccttatattttgttttgggctatttttagtgggagttttattctcattaaataggttactatgtcagcaatgttaatgatgttgtaagaaattaaggaagtaagagatgaaatgagtttcatctggatgaaattatgtctccactgtttttaacactatttatctcttgcatgtactatgtacgaaacaacaaagttgaaacaacgttgtataagatattttaatcatcaattaaataccttattatttatgtgatactcttgaaaacataaaaatgatacattttactggaaatggacttaattatttgcaccgggacggacgaccctgatcatttcaattactcttgatagtaacttttctagcttcactgttgtaatgagagacaggtcaaggagacaatttttcatgtgagaataaattacgcacatggactgcggggacctccagtactagactactagtccactgcggtagcttggttaaaagaaaaaacagcaacatgaagagttgaagaccgttggtaatcgctaagaagaagctagccacgggaaccaagtgtgaactttgccattgttgcattttccttttactagctaaaacaaattatgattatttttttgtaattttatttttgcaaatgtaagataagatagagtcgtttgtgtagagaaattattttataacaataaagcatatagagtagttggtagaaaacatgacagagtacgtagttggtaaataaaaaaaatagcatatttgatgaggtgatggcagatccactgtcagaactattaatatcttttaaagggagtatatatgttcaattgaccggatattctcatttcagatattgtaacgtacattgttatggttcactagcttgtttatgtaaagagaagtatgggcattttggactttacaagaaaaccagattcacttaataaattttgactaacggtgatgacacacaaagatgacttgatataccatatattcagtattttatatatctaggggtgaatatccaactgactcggttcaggtcagctcggtatggctcgttaggataacgagtcagctcggctcaactcgtttggataacgagtcggcctaatgagctagctagaaaccctgttcagctcgagccagctcatttaactcgtgagtgaagacttcaaatcaaaagtctgcagctagaaaatatgcaatctaagtcaatttgcaaatgatctaagtaccaccccaacaaacaaacgcaacatcattcatcagttcagtactttcttggtttgaaccaccgaaggagaacccgaagagagtagaaagtcgagcgacgacggaaaataagagagcacaaagcttcctttcttcttcatcctccatggccatggcaggatgcacggccagcagccgcatgggtgtagtggggcaggcgcgaccttgtgagagtcgtaatcagggccggtcctatgattttgagggccctaggcgaactcatcgtgatgggccctctaagctacatataaaatttattgatatatataaacgctaattttacttgcaaaacgaaaacaagtacatctatatattaaatttaacatgcttgataattatcaagaaataaagtcgactaaaataataatatatttgtaacttggaactaatatcattatttattaacttaatgaagaatagaaccctattccattgcttcctatggaaagatacttcttctgacatttcttgatgtaaaatcatcaagaacggtattaagatcaatagtgtccaagatatccttctctattgagcacatagccaagccatttaatatttcttgcgacatagttgatctcaaatagttcttcaacaactttaattttgagaaacttctttcagctgaagctaccgtcacaggtacggttaagagaattcgattggcaactgaaatatttggatataaatctacatccataacaaacttcagaatctcagacgcggacatcaaagaatctagcaaactcacctgcaacacctttaattcagaataaaaatcattgatctcaacatcggatgacgtactagattactagtattaggtgttggcccctcaccattatgggccccccatcatcatgagcccccggtggtcacctcgctgcatagggccagggccggccctggtcgtaatccgcgaggccgacggcgacgggcaagctgcggtgaggccgcgtcgccatgagctcgcggtaggatggtgggagcgcaagcacgaggtgcagccacgcacgcagccacagcgttgggtggccgctagggttactggtattgattttggagatcgaggaatgaggaggattgctggattgggacaggatcgacccattttctgggttttggtcttttggggttgttctattcaagcctactgaagattggaatgtttaatttggacctaccgagtgttttagttgagcctacttaagactggagtgtactgtcgaaattccgagcgaaatcatcgaaatttcaatcggaaacttaaaaaaaagttaaactaaaattgtttttctttttttaatccattattcttttctttcctactgtaaatttcagtaaatacacgaaatacatcaatttttttaaaaaatttatattccaataggttctacgaatatcatactatttataagatattattcgattttttcttttttatcaattcaaatttaaatttggatgaaactcatcgaaatctcagacgtcttctacttttgagcctcgtcgaaaccttgaatttttgcggaattcaaccggttttcgtcggaattgtgaaccctgccagggtttacgattccgagatggccttctgttttgggctatggtagaatgacggttttcgcaaaatccggtggaaaactgctagattccgaacaaatttcataaactaaaatttgaattcaaattccttgagtttaccgatacgctcgcgaaaaccagtcggcttttatgaaattccgagcgaaatcatcaaaatttcaatcggtaactagaaaaggaggtaaagtgattttttttattttttttaattcattattcttttctttcctactataaatttcagtaaatacacgaaatgaatcatttttttcaaaaagttatatcccagtaggttctatatgcatatcatactttttataagattttatttgattttttctttttttatcaattcaaatttgaatttggatgaaactcatcgaaatctcagacggcttctactttcgagctttgtcgaaacctcaaaatttctcggaattcgactggttttcgtcggaactgtgaaccctgttgccggatccgggcaaggcctgtccgcctgccacatgccctcgctggatccgctcgccgtccgctgtgctctttcgctagatccgcgtggaccaaagcgggggatggccgccgttgtcgtccaccgctgcccgccgtcgtgcgcccagtggccgctgccacccaggaggggagttggggagagagagagaggagagaaagttctctcccgggagagaggaatttgagagagagagagagagaagaggaggtgagacagacaagaggggacaagaatgacttgaaaaatttgaagtgctaagaaggacacgaggaggtaagtcagacatctaggcggacctttaagaggtccgtagtcctattttcgcataaggcttcttaagaggtatgcctgcgaagatagatttttacatgtgggtctcttgaggagctgtatgcgaaaatatgggtcaattttgcagacgcaaacacttatgatctacctccaaagggtgctcagccatgaaaatcatttgcatagtaatgaatttataatgaagggtagttttaccattcttgggaaagtactgggggtaccgtattttttatttaaaattagtatcttcggatacgttgaggtaccaaaatttttttagggcaaagtttaggtagtctgaggtatactttgtctcaaggaccataaattttctctgtaatgaagtcttattttaaaagtaaaaggaaatacattgtccaaagtaaaaaaatgataaatagtggtctaatataaaacttcggtaataaaagctcatttaaagtacatatcacttataaataaaaagaagttattaggttttacttcctaggcccaatgaagaagccaggagccaaggactacacctaaggtactagcatgcacatattcgttaatttactactaccttttttaatatataatgttattaatttttttataaacatttatcattcgtttccttattccttttgcaaatatgaagaaatttaagttaataatgcttaaagaacatttaacgataaatcaagtcacaataaaaataaatgataattacataattttttgaaataagactaagacgaatgttcaaacgtatctaaaaagacaatgacgtcatatattaaaaaaataggaattactatagcaaaaacggatataagtttttgtttttttgctttctttggctaatttaagaacgatctatatgtgattttaagataggccgcaagtcttatgggtattgttcgtttgtcattgcttaaaaaaagtttaaaacacattttgatatttcttatcaaatatagagagattcgatcaaagtagttctagatatattttctgaatattttctaaagatgccaaatggcatatttgcaaacgaaaatcaatttgtgaataaaacttttatatatgtgttcttagcgatctaaaaacaaaggctgaaaaataaacttcgatgaaaaaaacccctaaaatcagctccaaatttaacgttgaaaatttaaattttggctgataagcatatgaatttgccaaacgatgaggcacccaacgaaataacacaaaaataatttggcaattagtctttcccgtgagtactttaatcctagaaaaaggctacgcacgtaattagtgattggacatttttttttattgtacgaaagtgcatacaccgctctcgggagggttcacccgttaaaaaactggtgaagctcactctgtgggtgttttaggttcaccgtgcgcattaccaataccagaaatgcactcgcatgatatattgcaaaatagggtagagtttctgactgctgtaacttattcaaaaataaaaaaattctttaaataatctagttttttgtctaggttttatgaaaatgtagttgtagaattaaaagattaactagaaatttgtttttgcgttcttctgtttctcagaataaaaagcttcaattcgacgtatacttgtgcgtgcaataacagtagtaatagagtacgctataaggccgtaactaaccaagatgatgttaacctctttgctaataaaatactcctacaggcacaagaactcatgatcaagaacctgattggttagcgttctcattgcaatcatcaaatcttttgtcttgtctccatgctgtgacaaacacaggtcgatatatgagagacggagtccaccgattacacatgttgatgcggtgctgaggtggtgaggtcgtaggtgcatgacattatccatcaaaaatcaaatttcagttccacaaatattatacacaaatgaatgggatttcagtaggaatttttagtaaggctaagaatatgccgttagatctgtgtctctgtgagtaagtgttagggagacactctcatggtatgtgtgagtgacaagtgacatccgtatagtggtgtgtcactacgacagaaaatggcatcagtgctttttcgtaacttggtatcggtgtacgaaaatgaatccgacacaaaactcatctctgttggatgttctgtacccggcacccattattacctgtgtatatactgttggaattaatggatgggccttagcccactcgaagattaattctttggaaaatcacgaaaacccacctcatgggatggcatgcatatggagtttagtaccaccttacttattctaggagagggggacctccttaaaagggaggatgccctcctagcaacttgaagcatgtgtggtggagagaagagggggaacacgcgcgcgcttgctcgcctcgcctggcagggcgcagtggagatcgtgcgggcgtcctgatcaagcgacccttctctatataaaccgacccgccgtcttcacgcaacacacgcaaaatcaatctagggtttgcctccaactctgtggcgtcctgatcaagcgacccttctctatataaaccgacccgccgtcttcacgcaacacacgcaaaatcaatctaggatttatcgtgcgggcgtcctgatcaagcgacccttctctatataaaccgacccaccgtcttcacgcaacacacgcaaaatcaatctagggtttgcctccaactctgtggcgtcctgatcaagcgacccttctctatataaaccgacccgccgtcttcacgcaacacacgcaaaatcaatctagggtttgcctccaactctgtggcgtcctgatcaagcgacccttctctatataaaccgacccgccatcttcacgcaacacacgcaaaatcaatctaggatttatcgtgcgggcgtcctgatcaagcgacccttctctatataaaccgacccgccgtcttcacgcaacacacgcaaaatcaatctagggtttgcctccaactctgtggcgtcctgatcaagcgacccttctctatataaaccgacccgccgtcttcacgcaacacacgcaaaatcaatctaggatttgcctcctactctgtgctgcgccgtcgctcgtagattactccatcccgctcgccggcgtgcaccggcgatcgggagagcaggtctccggaacctctgccttcgacgtcctgcaccgggagaaggcgacaataaggtttttgggatcctcttcgctcgcgtgcgcctgcaatcgcgaaaagttcctgccgagcagccggtctttctaccacctcggtacgtgttcaatatgttgcgcatatttgatctgttcatgttttactgcttagtttacatgtgtagatctaatgatgcgttaatactagtatacatctgcaatgccatgatttatttatagaatatattaaatcattatatgcctataatctcaacaatccaaaaaccttattataggcaatgtgattttactatggctagttttgccgatgcactgaggtcggataaattcaccggtgtgcactttaagagatggcagatcagggtcactctgtggctgacagctatgaaatgcttctgggtgagtactagcaaacctgaaggagttcttactgctgaacagcagaagcaattcgaggaagccactactctctttgtgggatgcattcttagtgttcttggcgatcgtctggtcgaggtgtatatgcatatgaccgacgctaaggagctgtaggatgcactgaatactaaattcggtgctactgatgctagcaatgatctgtatatcatggaacaatttcatgactacaagatggctgacaaccgttctgtagtcgaacaggctcatgagatacaaaccatggctaaggaactcgaactccttaagtgtgtcttacccgacaaatttgtggccgggtgcattattgcgaaacttcctccatcttggagaagtttcggtactgcactcaaacacaagagacaggaatactctgttgaggggttgatagcgtctcttgatgttgaggaggaagctcgggaaaaagatgctgcgtctaagggccatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaacctggtcatctggctaggaagtgtccacagcgcaaggggatgaaggcacctgcagggcagacttctaagtctgctaatgtgaccattggcaacactggagatggaagcgggtatggtaatttacgtactgttttttcagttaatcagtctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgtagcatgtcccttctatcgacaggaatcttgttagtggctcccgtctaactagagacggatttaagttggtttttgagtctaataaagtagtcgtgtctaaacatggatattttattggtaaaggttatgagtgcggaggcctgttccgcttttccctttctgatttctgcaataagtctatgaaccatatttgtgccagtgtggatgatgaggctaatgtctggcactcacgtttatgtcatattaattttggcttgatgtctcggctttccaacatgtgtttaattcctaagttttccattgtcaaaggttctaagtgccatagttgtgtgcaatcaaagcaacctcgcaggcctcacaaggctgctgaggagagaaacttggcacctctagaactcctacattcagatctttgtgaaatgaatggggtgttgacaaagggtggaaaatgatatttcatgacgttgattgatgatgctactagattttgctatgtgtacttgttgaaaacgaaagacgaggctctagactattttaaaatttataaggcagaagttaaaaatcaacttgacagaaagataaaaagacttaggtctgatcgtggtggagagtttttctcaaacgagtttgacttattctgtgaggaatatggcattatacatgagaggacgcctccctattctcccgagtctaatgggattgccgaaaggaagaaccgcacactgcctgacttggtgaatgccatgttggacaccgcgggactacctaaggcatggtggggggaggcattgttgacctcgaatcatgtgttaaacagagttcctaacagaaataaggacaaaacaccatatgagatatgtattgggagaaaaccatcactttcttacttgcgcacatgggggtgcttggcgaaagtcaatgtaccaataacaaagaagcgcaaacttggatctaagactgtagactgtgtctttccaggatatgctcaccacagcattgcctatagatttttaatagttaaatccgaggtacctgacatgtatgttggtacaattatggagtctcgtgatgctatcttctttgagagctttttcccaatgaaggatacacatagtagttctagtcaaccttctgaaataattcccagttcaatcacaccaccagaacaaactgaatatacacatgaacatgtcactgaggaggatgacagtgaagctcctcgaaggagtaaaagacaaaggacggttaagtcctttggtgatgatttcactgtgtacctcgtcgacgacactcctaagtcaatttcagaagcatatgcatctcctgatgctgactactggaaggaggctgtccgtagtgaaatggattccattatcgctaacggaacttgggaggtgacaagtgggtgtaaacctatggggtgcaagtgggtgttcaaaaagaagctgaggcctgacggtaccattgaaaagtacaaggctcggcttgttgctaagggctatactcagaaagaaggcgaatatttctttgacacttactcacctgttgccagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaagataaggtgtgcaaattgttgaagtctttgtatggtctgaaacaagctcctaagcaatggcatgagaaatttgatagaacattgacatctgcaggcttcgcagtcaatgaggcagataaatgtgtatactatcgccatggtgggggtgagggagttattctgtgattgtatgttgatgacatactgatatttgggacaaatcttgaggtgataaatgaggttaaatcattcttgtctcaaaaatttgatataaaggatttgggagtagctgatgttatcctaaacatcaagctaattagaggtgagaatgggattacactcttgcagtctcattatgtggagaagatcttgaatcgctttggctacattgatagtaagccttctccaacgccttatgatcctagcttgttgcttcgcaagaacaagagaattgttaggaatcaactggaatactcccaaatcaatggctcgctgatgtacctagctagtgcaattaggcctgatatctcctttgctgtgagcaagttgagccggtttacctctaatccaggagatgatcactggcgtgcacttgagcgagtaatgcgctatctgagaggtactatggaattgaggcttcactattctgggtaccctacggtactggaaggatatagtgattctaactagatctctgatgtggatgagatcaaagccactagtggatatgtctttatactaggtggtggtgctgcttcgtggaggtcttgcaaacagaccattttgacgaggtcaaccatggaagcagagttgatggcactggatactgctactgttgaggcagaatggctgcgtgatctattaatggatctgcctattgttgaaaaaacggtgccggctatccttatgaactgtgacaatcaaacggtaattgtcaaagtgaatagttctaaggataatatgaaatcgtctagacatgtcaaaagacgattgaagtctgtcaggaagttgagaaactccggagttataacgttggattacatccaaataactagaaacctggcagatcccttcacgaagggactatcacgaaatatgatagacaatgcatcgaaggagatgggtttgagacccatgtgagttatactatggcggtaaccaagtctatgtgattggagatcccgtgaattagatcctcggaagaacaaaccattagtaaactagaggagagtaccgatatataccctctctaagtgaagatgcatgtactctcgtgagctgcaaggcaggttggctatgccttaatgagttctgttgactttaattagcgaagatgctgtcctgcagagcattcttgaaagaactcacctttgtgagcttgactgctggtcgcagtctatgaagattttgggtgaatcttctaggaagcttactaaagacctagcagtatgacttatacgctccacccgaggggtagtctacagacggtctagtaccagataagactttgagtgaaacttgcttgcacaagacttacaattcaaggcgtaatccattgttaaagttgtgagtaagtgtagcttggagttctagatagaagttcaaccttaatcggtctccatcgaaccgctggtatatagacagtacattggaaaaggcaaatctcagtgggattttgagatttggtgggggattgttggaattaatggatgggccttagcccactcgaagattaattctttggaaaatcacaaaagcccacctcatggaatggcatgcatgtggagtttagtaccaccttgcttattctaggagagagggacctccttaaaagggaggatgccctcctagccacttgaagcatgtgtggtggagagaagagggggaacacacgcgcgctcgctcacctcgcctggccgggcagggcaggcggcgcgcgtgcacgatgtacgcgtcgaatggtccgccaaaaattggttcctcaccttgcgcagatgcagcctccttttgcagtcttattttgctgcaaattcggattcgtttttgttttggaaatgttccgaaaaatccggtgcgtgaaaacggcgtggagtccggataagttacgcgcgacttatccggttcggttatgcgcagtggagatcgtgcgggcgccatgatcaagcaacccttctctatataaaccgacccgccgtcttcacgcaacacacgcaaaatcaatctagggtttgcctcctactctgtgctacgccgtcgctcgtagattactctatcccgctcgccggcgtgcaccggcaatcgggagagcaggtctccggaacctctgccttcgacgtcctgcaccgggagaaggcgacaataaggtttttgggaagcgcttagcgcgactgctccctgttcgtccgcgacggctcgtcttcctcttcgctcgcgtgttgcgcgccttcgtagacgcctgcaatcacgaaaagttcctgccgagtagccggtctttctaccacctcggtacgtgttcaatatgttgcgcatatttgatctgttcatgttttactgcttagtttacatgtgtagatctaatgatgcgttaatgctagtatatatctgcaatgccatgatttatttatggaatatattaaatcattatatgcctataatctcaacatatacgaagccccaaccactagtaactttttttctaagtcaaatataatttttgtcaggtagggatttgatcccgagacatctccctcacgtgcacctatctttaccaactcacctacacatgtaccaactcacctacatacatgtgtgtctcttgtgtaatagaaacgaaaatctactgcatatatacgaagttgtttgtttgattatttcatatgccattcaatatatatggatttagtgatttgcgtcttaattgatactagaaaattactccgcgcgttgctgcggaaacttatttatataaatgtatgacagtaaagaaatgtaaggtggcttgttcactaattgaaagaagaaatgctatgtgctaaaaagtatacaacccatattctaaagttagttaactagactgtttcagtagtctctatctttgtatttaataccacttatctagaaaacgcaacacttagttcatcccaactaagtgtagttagtgctaattttcttttctgtcgtgaagctatatcacctcaattatttttaacctttagatgatttatcaaggttgtaaattgcatatcttcatatcatctcaattgtttctagactttggataattcatcaagggtgtataaattgcatctctttttttctaaaaggcacaccatacaacctaatcatttataacctttggataactgataaaggtaaaaaaaatatataaacacatggaaaaaattatatagtaggtaggaaagaaaattttagaactcacatatactatattatcacatatgttacttaggtaatcaaggaaagagcagcaacgcgcgggtacccatatgttacttaggtaatcaaggaaagagcaggaaaatcatgggcactgttcatctctccaagaggaaaaaaaaatgttgtctaataaacatatgccttcttaattaacatttatttcttcatgaagctgaggggctaccttggcaatcctttcatttcctttgaagagattttctaattttgtttgcaacctaaataaacaggtaaactgtctattttaccaaaatataacttgaaaagtcaagaaaggagatggtaggcctatattatgcttaccgtgtcttaaaatgatgcaaacttaataaacagggagtttagtagtctaacctgtgggcttttggctcactattgaatctggaatcaaatagatttctgcatctattcatatggaaaatatatgatgacaaagctatattataagattaatatgagaagagtataattagcataattttacatgatatatgatgcaataatcggaaaacataatctcaaaagaaacaaagattggcaatatagcatgtggcagtttaagaaagcaaataaaaagaagaacatgaacagtcgatcagaagaggcaaagcacaagaactggaaaagaggtaaaaaaatagtacctgtgattctgtagaccacgtcaatgaagaatttatagtggggcgagctagatcaacggtattggaaaagatgaggcgcttggaagacacagagacgcacatgcacgcgagaaatttcaatgctttgcctggtgggcctggaccatggttcaactcacgttttacagcagcagaccaatcaaaaacgatctaatcctaccgtataacttcaatccaacagttcaaaagcaatcaaggtgacgtggaacaaccacattgcaggaaaatcatattaattgcactaagtggggattaactatatagatatataggattagctaattaattaattgtcattcaataattgagtgtttctaataaaaaagctgctttaactactattttctttgcaacttccctgctaatcactggtccaccttaacatcctcatgtgggaggggtcaaaatttgcatgaattaaagcgaaatttttgactggagggacattactaagaaaatggctaaatttgatgttttattaagagagccaaagaattgattgacatatattttagttatctctattgattggaaatagttattttcccatttcttaaaaagaaaatcaacatgtaagaaaaataaattgtaacaaacgtcctgcaagctggagtagtttattatagattgagatatgactctgacacaatgtacacatatgtatgtataatatctcgcatgaagcgcccgcacgttaatccaagaagaaaatgacagacgatataatatacatgcatagaacacacatatggacgtacataactaaattaatcctgatataatcctagtcatccagctataaaaggttatcacagcaggaaaccaaactgaaattaatttcacatcgaaccatactacttactgatcacacacactgtcactatacaaaacaatgccaggaggaggcaacagatgcggtttgcagccaattagcctcctgcaggctctggcaacaattatcctcgccgtcgcagcagcagcagctgcagcatggctggctccgatcgccgggacgtcgtcgtcgacgtcgcgtgtggcggcggccaatggcacgtgccagtcaagggtggcaccgtttggctacgcgtgtgaagagcacacggtaattaatcaattgcttaatttataatgcatcgggttgatttcacagacactctatttttttgtttttgatatatcttttgtttcttcgtcttacttaaaaattttatatgattgttattaggtgactttacgcgtggctattttttttatttttttcataagttttttaaataagatgaacggttaaatgttaaacacaaatatctagtctttgtgggacggatggtgtatatacgtgtgatcatcgtaatcggagcactcaatcgtgatgagaaattgagaatgatcgggtgttatagtaattaattaatcgattgatttgggggaataatttgtgcaggtgacgacggaagatgggtacatcctaagcctgcagaggatcccgagcggccgcggcgagacggcagccggcggcggcggcggaggcaaggtgccggtgcttctgcagcacggactcatgatggtacgtgtggaggaattaacagcacgtaaacattggtgtgtgaataaatttagaatctgtgagtagttaaatcaagtggttgagaattttgttttaaaaaatgatcttttaaagaattttcgaagccaaatattgaattagtcttacttgtcttgattttacgacaaaaatatattcagttgatgggatagataggaaattaatgttatggatagagcctatatgttttgcaccaaagttaattactgtttgctttgcaggatggggtgacttggcttatgaactcgcccaatgagtcgctaggatacattctagcggacaatgggtacgatgtctggattgccaatagccgtggcaccgtctatagccgccaccacacttcgctcgtctctagtgactcggtacattcttcaatttattctctaacgtaaccaacatttggctataaaattaaaacacatgtctatacaaagttatgtttaaaagttaggagtaccatatcatggtaacatgcattggtgaagccaagatttaaacatgaggggccaacttgacaactgatcaatcacgattataaacaaaaatagtggttttttgtaggtaataatatatcgtatcaatgtaaaagaacattataacacaaaagaacaataggcagattgccatattgcatatacttgtttatttcaactagaaagaaaacccgcgcagatgcgcgggaaatttatttaattgtttgtaaaaagaatactaaaagaagtcagatctcactattttttataagaaaatagattgtaatagtaaatatagaaatatttatatcccagttatatgtgaactcgcctatcatcattcttcacaaaagtatgagttaatatgtgtttgttttctctttcattatacatccgattcatctatgcatattcataggtaatatacgatggaataatctttattggcaaaattatttgtgctaattatcaacactatttggatgagaatgtcataattaaatgggatataatgtggttccatgtgatattttttattgtaagtatgtatgttttttctagcaaatagtagtcacctgtacgaatgtactttttccttttttgataaatatttttctctgataagataggtgtgtaattgtatttataagttggatgtgcatgtatttatatgagtgctcacaattcccttttataccattattaaaataaatactttgaagagatttggtgggatggtgtgaagcagcactgcagcggcgtggcttcttcgacaacctcaccagaagtggtcactatatatatacataatttcagaaaaaaccttagagctgcaaagaaagaaagagaaaactacttgatgagttgattatacacactttttcttctttttgacatctcttgtgtacgtacgtacatagggagggattagccggtatttaggagtgagggattacatagatatattctaatggttgataataatggatccactagtctaagtgtaaatcaatggctaaatgtttttttctatttattataattttcttacattttctctattttattagagtgtctttgtggtatcttagaagtatatgcaggtgtgtaggaacactattgataatagtcgtagtctacttgtaatcaactattatttgttccagcttggtgtatctctacttacatatcatttattgatggttctcacttagtacttcctttatcttttgtacttgataacacatgtgcttattggttatcagctaattattagttgcacaatgcatggatgcctcataactattatgacttggcgattggtggacagtggtttctatatataacttatatacataggattagtgggagcataagattgatatatttggcttgttcctgattgacaaagtatattatgtacttcatattaagtgttttagtatgtaaggttgacttcgaaagtgcttatctgattggctactttgttatttaagatgagcgtgtttcccaaactacagaagtttcttgagctaaacgatgcgtgttttctaaatactttctatacaaaagtatttttaaaacatgaaataaacccattttcaattttgtaatatttaatacctaattaatcctttttttatgacgtgcatcattttgtgtgtcctaaataaactcagccagatccattgaaagcctaggtaggagataaaagacatcgacacggtatcaaaagaatatatttcgtcgttgattttctagcaatatatgaaaagaaactattcaaaataaatttagtaatgtcattttaacatatcaatatttttttctagtaggtattgagtaaattttgagaatgctactcacagtcgaagttgttttacttttaaaaataaaaatctaatagaattatacatgttgttaagtgatatatctataattttaatttatttatatttttcatgaatgtttccatgagatatattttttatttgaacataacttgaaataacatatatttttatttttacaacttaaattatagttaagatgtgctaattattagattggtttttcaactaagtgagaaattaaaaaaaaaggaaagagaagtgcacgtacaattttttttgggtcgggtgtgggtttcgggatacaaatgtacgtactcacgtacagatatggaacaatttagatctttggagatataaatttgattgttaatttagaggatagatctaatggttaaaaataatggtcctaccagattaaatgaaaatcaatggctagatgttttatttttttcttagattttttatgatttttaaagtgccacatgacgaccttggagcgtttgtaggagtgtcacgtgctgacttgagagcgtttgaatgaagtttaatggactttaagtatataatagatttagcgataagaatactgtgcaaatggatcataaacggtgataatatcttctaggcgaaaagtctaaataaataggcaacaattagaaaaaaaacttctccgggatgttcagattcgtagtattaggatacgtcccatccgatcataggttgctatattctgggacggagggagtagatcttagcaaaatgagaaacaaactatctatcttaaaagtattaagtaatattttagaaatttgagatgatagccatctaatgatgtaaataatacacatgattaacaaaatgtattgttatataagaaaaaaaaagaggttgttatgggtcacgggcaaagacccgtgctccttttgattagggattagttaagctgaaaatagtatatatattctctccagtacatacaatacattattatcaattaattctttaatacttttatagtctgattctctaccgtccagacttcactcacttattatgcaatatagacgtaccttattttgaggacgctactctttatctatttatctatgatcgtatcatgccaatcttatggtgtacacttatttaattttatggatacttgctactacaaggattcagtgcacagcgtgcgctcgacagttcgggttagtttgtttggaaatagaaatattatttggttgtttgttcagaaaagaaaattataattattggattcccgtgaagaaaaaactctcgatcagcctgttcatataaaatattatactactagtagacacggctcctctccctcatcccttctctatttcaccttatcgtctgaacctatgttgcgtcttaggactaatacttttgtgtttattttacttgctcttgcttatgccgctaattaaaatgggaaattttacaaatttattggcatatgaaacctaggcatactggaactggtcatgggacgagctgtccagcaaggacctatcagcagtagtgcagtacgtgtacagccaagccggccagcagaagatgcactacgtaggccactctttggtaagtgaaatggcgttaggaacaaaaaaaaaatgcatttcagtttcagtaccacatgggtaaaaattcccgcagccaaacgaattttggtcatccttaaaaaatttttaacttaactctatttttcagcttatttaaacggattatgtacttcacgttctgaacaaatatgttctcttaaacgtaaacgtacttctacagtattgcttagacaacttattttaaactatatatcaagtttattttttaaaatattaaatttatcactataattgattgagtagataatccgctcgataatcaaccaccaagtttaggcacacagacaaatcgatcctttgcccttggttgatcttctgaactgtggatgcagggcacgttgatcgcgttggctgccctgagcgatcagcagcagcagatcgggatgctgcggtcggccggtctgctcagccccatcgccttcctcgacaagatgtcgtcgccgctggcgcgcgcggcggccgacgtcttcttggctgaggtaagttcgccggagctgacgccgccgacgccgacgactacgacgacgaatggcgtggccattaaacgggctagcttgctgattgattctgtgtgttctctgcttgtgcaggcactctactggctggggctcagtgagttcgatcctacagggtaaagctcaatttcttcccattgcttttcagaaaaccgagtttcaaaaaattcaaggagatgaaaggaattttcagataaagtttgaagtttagtttgctaaatttgaacaaatagtataggcttcattcgagcaaatgcagttctgtttgctacaggcacttgtagggtccaacggtagatctaaaatttcagaaataagttctaaaaaaatcagaaattttaaacaaaatacaatttcaaattgagtgattttacagtccttaataaagtaccagaagataccatatttttaaatgttaaaaaattttagtatctctcagtaccttcggtaattatgggtaccaatttttttaaaaacaattgatagttttttacctctcaagtaccgtggaattttaaggtagtttcaagccttcgatttctccaatcttcagaccaagatgttttcagaattcctatttatatcgatatttacgaggtttggtgaattgtgtttattactgttcattcatttcttgctgacaagtgacaatttatatttctatgcagagaatacgttcacagcttggtcactgacatttgcaagcaaccaggcatcgattgctacaatctgatgtcagcattcacaggtaatagtagctatatgcataagttgtcacgaccgaatataattgtgttcttttttcaaatctaatatgttattgacctgcattttgacgattggagcaggtgacaactgctgcctcgacaactcctctgttcaggtcttccttgcccatgagcctcaagctacagccaccaagaacatgatccacctggctcagagtgagtatgagaactgacaaatagtctgtacaaatgatttttaaagaatcctaccacctgaaagaatatgacagttttcccatctttagtcatccgtagtatttgagaaggtaacacaaggtaccacacttttagcatcagtatttagagaatttttgagggctttgagagggtgtcacgagatacataatcatcactctataatatgacgaagataacaagaggtagtataacaaatcaacattaaaattgtgttactgcccgatatctcttgagaaaccatacaattattaactagatacgtcaataccttcgcactaaaaaaaacttatcatcatactttttatttcaagtgtccatattatttttttctaaaatcaaatacctatactccagaaagatgtgcaataattttggcatagctatatagagatattaaattttacgctgaaaaatataatatcttatccgcatttttcctaaaaccaaaatgcttgtgccaagcagtgattagaggaggcacgatcgccaagtacgactacggcaatgccggcgacaacagggagcactacgggcaggcgacgccgccagcgtacgacgtgacggcgatcccgggcgacttccctctcttcctcagctacggcggcagggacagcctctccgacgtccaggacgtgagccgcctcctgcgggccctgggccagtcgcactcgcgcgacggcgacaagctcaccgtgcagtacctcgccgactacgcgcacgccgacttcgtcatggcccggaacgccggggagagggtgtatgcgcctctcatggccttcttcaagctccaggagaagtgagagcggatacatatatgggcgagatgggtagtgttgtcgattaattgtgttttgagcatctgtgagataattagtttcaagggatgatatctcatgttgtaaaaattaaatcaggtgtgataagaaaatgataaaaaaaaggttaatgatagttagaattttatatttggaaggaacactactggagaattgatctttatctggatggcaaaaatcattgtcgaaactagatttcggcaataataaaagggggtggctatcaagctggagaagtgtatgggtttggagacaaaagatttatacaggttcaggccttcttattcaagaagtaataccctactcctgtccggggatgaatccgccgagtgtcttattgattgtataatttggagaaaatcaacctctgcccctagaggcacccggaccccccttatatatgggagggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagcccaaatatcatcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcatgcatcatatgacaaaagcatacacggcgcctaaagaggcattcttagccgactgctttttagccacaattaaaaggaatccgagtggttaacactctaaaaggttcacgaatgaacacacttgacaggcatccgaataaaaaactctaaagattacccaccaaatattataaaaattatggtaatgaataagtctaatagcctaggctatgactatttaccataatgaaaacaggcatataacataccagggaaatgactatggtaaaaacaagccattccaagttaacccagacagcttttgtagcctaaaaaagcttacaaaaacagcataacacctttctgtcgggcacattttaatttgcattgcaataattccaaagaattatatgaccgcgtaaaaaggattttatcagcattgggcaacactattgtgcgcataaattgccaaagcaaaaaaaaatgcctaagtccctaaggagcacaatgggccacgctgttaaaagtactgggctgaggtactgttcaggcctaagcccatttgcacctccgatacccttaacaagaaaacccaagatccaagcgactcttcatcttccccgccggaactctcgccattttccccactccctgctacagtacaaagctgcgccggcaaactagggttcaccattccactcgaatccaccttcgaaaagttcatcaaaatccttcccgtgatccaccgcctcaatccctcacttctccccagccatccctcgaatcaaatcagcacattcgggtgaaattaatggcggaagagaaggaaagctttgaaggccaatgggcgccatccgacgtcacggaggagaacctgaaggagatggtggcgcacggcgttctccctgccaaggaaatcatcgggtggcggccagcatgtggtgaggcttttccgacccccgatacacacgaggttgtggtcttctcccatttcttctatggcggcttcgctcttccgacctcaaaatttttccgcgggatattaagcttctatggaatcagcttgcatcacctaaacccaaattccatagtccacatcgccaatttcgtccatgtttgtgaagccttcttgggaattaagccccacttcgctctgtttcgccgaatcttctttctcaagccccaaccaaacaagagtaagccatgtgtagtcggaggggccggatttcagctgagggggactctgagccagaagtatttctctatgcccttcaagacctcaaacaaagggtggcatgcaaactggttttatattcagaatcctgagcctgctcttcccgagtactcttgtcttcctccggtgtaccaagatacctggaactcgcttccgattggggatgaagcagcccaagccttggagctgatggatcgcatgctaaaactcaaagaacaaggcttacaaggagagcagattactcggcacttcatcaaatgccgactggcaccaattaaagaaagatcccgtgcagcattcgagtttgatggcaatcatgatcctaatcgtgaagaaccagattctctggattttaaaatcatgaaggagagaatgtataaaatcttctcaaacgctatcgtcgtcagctactcacatcagctgccagttgtgccatataacgcattcaatctgcctccgcaggtacgtatccgaaatcttcaactcatgaccaaaacataatcttgtcttcatattgagttaactaaccgtggaggcatctcattcaggaatatgtattgatgaagtctgaccccccaatcactcagcgccggtctcctcgccagcacaccgttcagggaggtggagggccgacaatcagatcagatccgcaacctcaaacctccaatccgactgggcagataagttctcgcaagagaaagctggtgcttaatgacgacgaaggtgatgacggcaacaaatctggggacaaaggctcgcccaataaactcccaaagcataccactcccaggaaaaaactggctagtcgtccaaggccaaagattagaacatcttccaggtataaacctcttggtaccatttcacttcgacatgcttctctcatggaaataatactgaatattgaaagaacactttgcaggaaaccatccgacatagatccaactggaaaagatcctgatccgactgtgacagaaccaagttcatccaaggattctgagccgactgccgaaagccagccgactggcgcccatacttcaggtgataatgccaatccgagtgaccagcctccgactggaaaccagtcggcagcaactgaaactacaacaacccaagagcccccgactggaaaccagtcggatgtaggtctagatcaagaaactcccgaagttgaagcgcagacgacaacttctcaagaaccggaggctggtaacgactcgatgatcgggtctccagataaagaacaaggatctccccacgctcagctaggaacatcctcaagtaactcatcttctcaagtgatgccgatttaaataacttcagcttatttgtctaatgtcttggaaatacatcaggaccaccaggcgatgacgaagaagaaattcctcgcataaaggtgactgatgactctcgtcctcctatcttgctcaaatggtgggacgagaactcacaagctgccggcatcgtcataaatcgtcaaaaagaagatgaggaagtgtgccagctgaagaaggcacttggagaagccactcgcattgtgaatgtaaatcttccgggtgactgcctttgatgactttgttttctcttcagcaaaactaaaccatgaatcatcatgcagagaatccatcttcgcaatgaggccaagaccgtaactttagaaaagctggttcctcatttgggaactcttgaagcagttagggatcagctacatgaggccaaggagctcgccaaaaagacagagaaggaattaagggaccgaattgctcagctccaggattcaaacttcgagctgagtggttcatcaaaaggtaatctctagatctgccccattaatttacgctgtcgtaactgtatcctcaaccatttggatttcaaacagcgcaagccgccagaatggctcaaatggagaaacaaattaaagccctggaaagagacaaggtaggactggctgcgcaaagggactcggccttgaaggaggttgaaggtactgccagctaacaatctgaacttctctctttttaatgcagtagattttgatcataaatgtgttttgtagaccgcaaaatcaaatctcaagctcaatttgacgtcctggttggtaagatcaagaggcttgaaggagcaagagatgaagtcgctaatgtcgctacaccactcgtccaagctatgttcctcaataacagtggtccgagtgcactcgacgcaaccgaaatcttcgacaagctgagagttgctccggatgtatatttcaagaatatcaagaaagctggaagtatgggagctagcatggcattggcgatgaccaaatccttgtacccaaggattgaaattgacgccattgatggctttgcagacgggacaagcgaagaagctgctcttgatcttatcagcaatgctcaaaacgcggctgacaagattgcaagtgacgttgtagatcaattccgcaataccgaccttcagccaagtagtaataactctgatgatgaaaagactgattctgactgagtataaatgtagcaaatggaggcataacttgtacaatactggtgtatttatgctgtgcttgataaatctagccaagtctttgatttcttaaaagcttttatcaagctttgttgagcctaaaacccaaataagctattaaaaactttcagtcctcgcagactaagtagaaaaaccaaacaaggcaatgatagaccaagtaagcaaattaaagtgataaaaaatcacactccattattatgatgatagcccctgactgacaacgtcaagaagaaaacttgatgttgacagtcaagatagggaagtacaatgataagcttaagcgtagaaacgacgaagatgttcaatgttccaagagttgtcgacaagtgtaccgtcttcgcgcttgagtcgataggaacctggtcgggtgacttcagagatgataaatggcccttcccatagaggagataacttgtgccgatcttgtgtagtttgaattttcctcaaaaccaggtcgccgactagaaaggcacgggatcgaacattgcgattatgataacgtcgcagcccttgtaagtatcgagccgactgaatcaaagccgtttcgcggacttcttccaatcggtgcaagtcatccactcggtcctcttcgtagcgttcttcacggaaatttcgaaagcgcaaagactcgaattcaacttcactcggcaacattgcttctgccccataaacaaggaaaaaaggtgactggcctgtggcccgactgggtgtagttcgcaaagaccaaagtactgatggcagctgtttcacccatttgccggcatagggttttagccggtcaaaaacacgcgctttaatcccttgaagtatcatgccattggctcgctccacctgtccattgctcatgggaggcaccactgaggcatagcagatcttaattccaaagtcttcacaaaagtctttaaaaactccgccagtgaattatctgccattatcagtgatgatccgattgggcactccaaatctatgcacaatgttgatgaagaagtctcgagcgttatctgctgtgattgtgacaaccggtttagcttcaatccacttggagaatttatcaatggccacaaagaggtgcgtgtaaccgccgactgcctttttaaacgggccaaccatgtcgagcccccaaaccgcaaacggccaagacagtgggatggtctgcaactcttgagctggtagatgaatttgtctggcgaaaaattggcaaccttcgcacgtgcgcacaattttgtcggcgtcggacactgcagtaggccaaaaaaaaccctgccggtaagctttgccgacaatggtgcgtgcggcagcatggtttccgcatatcccagaatgtatgtctttcagcaattgtctcccttcctctaaagatacgcagcgttgcagaatccctgaagggcttttcttgtacaactcagcttcatgcataacgtaaagtttgctccgccttgaaatccgctcggcttcatctttatcttgggggagttcttgagaagtcaaaaatcgtatgaggggctctcgccaatcggcttcaaccatagctacatcatgagtgcccgcaacttgagtagtatctttgtgaggtactgtcggcgtataaaggtgttcgacgaaaacatcggagggcgccacctcgcgcttggatccaaagttggcaagtctgtcggcggcttcattgttgtgtcgaagaacgtgactgagctcgagtccatcgaacttgtcttccaatttgcgtacctcttgtcgatatgccatcatattgtcgtcaaggcaggaccactctttcataacctggttgacaaccagctgtgaatcgcctcgaactattagacgctttatccctagggaaattgcaatccgcagtccatgaaggagcgcctcatactcggcaacgttgtgggatgccgaaaaatgtatccaaagcacatagcttaatctttctccagttggggaaatcaaaactactcctgctccagtgcccgaaagtcgttttgatccgtcaaaatgcatggtccagtgctccatcttctccgcgggggtatcctcctggcactcggtccattcggcgacaaaatcagctaacgcttgggacttgattgaaattcggggcttgaatgatatgtccaaagacatcaactccaaagcccacttagcaatccgtccatttgcttcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaagtaaatcggtcgctggactttctggacatggccttcttcctcgcgctcaacgaccaagactgtgctcacaacctggaggtggctgctacatacaacaacaacggctcctgcgggtatggtgaggctaagaccggtggctcggtgaggagtttcttgaaatcttcgaaggccttctgtgcttcgggtccccactggaaatcgtctgttttctttagtagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatgcccctatgagacaccataaaaccaagcagcttccctgacggtactccgaaggtgcacttttcagggtttaatttcatcctgaaagcgcggatgctcgcgaaggtttcttctagatccgagatcaaatcatccttttgcttggtcttgacaactacatcatccacataggcttcaacgttgcggccgatctgcgttgagaagcatctctggatcatacgttgataagttgctcctgcgttttttagtccgaacggcatggtgacgtagcagtatgctccaaagggcgtgatgaatgaagtcttcaagcagtcggattccttcagtcggatctgatgataccccgagtagcagtccaaaaaactgagaagctcacagccagcggtcgagtcgactacctggtcaatgcgaggcaacccaaaaggatctttagggcaagatttgttgaggtcagtataatcaacacacatgcgccattgccccgttttcttccgtactagaaccgggtttgccagccagtcgggatgaaggacttctttaatgaagcctgccgctaacagcttggttaattcctccttgatcgcgtccttcctgtcttgtgcgaatcggcggagtcgttgtttgataggcttggcatcttgtttgacatgtaaggagtgctcaatcacctctctaggaataccgggcatatcagatggtttccacgcaaagatatctttattgttctgaagaaaggtgatgagcgcgctttcctatttacaatctaactcggcacctattacagcagttttagtagaatcagaaggatctaggggaatctttttagtcttggcttcgctttctccactttttgagatcttggtagcgggcacttctccttcgctcgccgtggctgcagccagtcggatatcctctcgggctgacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacgccgggcgtccgagtatggcatggtatgctgtctcgaaatcggcgacttcaaagctgatattctctgtgcggaagttttcccgagtgccaaaagtgaccgggaggatgatctggccgagtggagttgcggataatcctggaattactccgtgaaaaggcgcattgcttggttttagctcggagcgagggatctgcatatcatccaaggtcttagcgaagaggatattgagtgcactgccaccgtcgatgagggttctgcgaagcttgacattacggaccactgggtctagtaccagggggtaccgccccggatggaccactcggtcaggatgatccgagcggtcaaacttgattgcaatttctgaccatcgaagatactggggcgtgtcgggctgaacagcattgatctcccgttcagtcaacttttgcttccttttagactcataagccagggggccgccgaagatatggttgagctccttgcggtggtcttgaaatcctgccggggtgtcgccgtcgtccttcttcctcgacgtgctttgttcttcgtcagagtttttccgtgtagtcttggtgtattgctccgcaaactgcttgtagacgaaacaatctttggccacgtggttggagttaggatggtgcgggcattgggagttcatgatcttgtcgaacgtgttgacgcgcgaacgctgtcgagaagagtgagtggcggttgcgacaagttcctcaggcttacgcttgcggtccttatggttgttacttccacctcctcccgtagccggcgtacccttgtttggcttccaactgggacccgactgctttgatgcggtgacggcgtcttcggctttggcgtactcgttggctttttcaaacataagcttgactgtcctgggaggcttacgcccgaacttgccgaccaattcttcgtggcgaatccctttggtgaatgcggcgatgataacgtcgtcggtgatgtcggagatcttgttacgttgttcggaaaatcgtcggatgtaatctcgaagggattctccggacttctgaataacgttgtagaggtcgtattgtgtgccgggacgctcgaaggtgccttggaagttggcgatgaagtggtcgcgtaattcagcccaagatccaattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccgtcgtacttctctattccagtcggcttgaagccggctggccaatccactcgacgcaggtcgtcggtgaaggctgctactccgtcaaggtcgtcgtcgtggcggtccggcgaatgatgatggcctcgagctgctcggcgctgtatgattgtgtcgcgaagatcgacggggcggcgacgaggtggtgagcgaggccgttccactcggcgctccctatgatggtcgggaggtgagtgaacggaccgctcgtcgtgacccctgctcctgcgattggatcctgcgccggtgatgctgaggcttggatgacggtagtcatgagatcggaagtgggggactcggctgccggtcggcgtatggacgctttcggagttaactgggaccgaagccgcaatcatggtcttcgtctggttcaagatgttgacgacgtgatcagattgattgagctcgttttccttgagaagggtgtcgaggagggtgatcgcggcaaccgcattctgttgaggggtgcggaaaaccggtgtcccttcaacatcttgttggccgatgagatcacgcgctcggcgccctgcttccaaagctcgctgccgtcgatcctcagcctccttcgcggtccgctcacgctcctgctgctcacgccgtagccgttcttgttcttgtgcttgatgctcctcctccagtcggcgacgctcagtctcgcgacgtgcttcggtctcccgggcttggcgttgctcctccgtctcgtcatcggccatgaagacgccgaagtagagaggggtgtagttgtcatctaggcttccgtcgaagtcgtcgagatccgggtcgttgtagcgagagctaaactcgtcgtactccacgatgtcggtggggcgcgagtcgacggtgggagagctgtagtagccatccagctgatccgtcgaaaccgtgccgagtggttggaggatgacgccgacttccctgaagctaggcgaaatcggtgttgaagccgacttccgcctaggcctacgggatggagacgctgtcgtgatggagacggccgccaaatcgtcggggagcttcatcaggatcggtgggtaagccccatcatcttgatctggtgacgttggagaagatgcgatctcacccaagtggtttgaagccaactcgattgagatggtcttgaagtaactttcagccgcgtttgggagtccaaacgggactgaaatccggttctctcccgactggtctgacaccgagtcaaggagagagatcttgccgaagttgttggtgacgaagtcgaggctgccgaaccgaaacgtctgcccaggtgggaagacgaggtcgtcgatgccggagacggaacccattgcactgatcggcgaaaagcttgacgcaacccctacctggcgcgccaactgtcgaaactagatttcggcaataataaaagggggtggctatcaagctggagaagtgtatgggtttggagacaaaagatttatacaggttcaggccttcttattcaagaagtaataccctactcctgtccggggatgaatccgccgagtgtcttattgattgtataatttggagaaaatcaacctctgcccctagaggcacccggaccccccttatatatgggagggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagcccaaatatcatcgccgtgtagatatgggatatccataatctccacaatcacattagtcccggtttcaacaaactgggactaattcatctttagtcctggttcaaaagtccatctttagtctagtttcgttaccaaccgggacaaaaaaaattatatctttaatcccggttggtaaccgggattagatatctctctcccacgtcattggcatctctcactctctctccccctctctctctcttccttatctcggcatcggcaacaacgccttatcccctcctcctcctcctcctcccctcttcacgccttcttctcctcctcctccactcctcctccccctcccctctcgtctgatcccctcctccccttcccctctccctctcccatctccacggcgacaccctcccttgcgtcggatcgggcgggagaggagccggcgggagaggcgggcaacggcgcacgaggcggcggcctcccctctgccagatccggcgggaggggaggcgataggatgggagggtggccgggtggcagcccggtggaggaggcggcggcggcggccgggcggggccctcctcctcctcacccccgtctgctggctatgactgatttgtttttagattttattatagatttttttagatttgggaagattttgtggatgggccagtgatttgtggatgattttatagatgggcctataaattgtggatgatttgtggggatttggggtgacggcgtcggtgatttcggctcaaaatcaatagatgcaagcagcaaagaacaatagaaaaagaaagaaaaagaactttagtcccggttggtaacaccaatctggactaaagttggtagcaccaccaactgtgactaaagatgaatctttagtcccagttatttcaaccggtacttaaaaaatgctcatcggagtctcggtttgtaacctaggactaaaggcgttgtaaactagatctgaagatcacttctccagcggtggaagaacaaagaagagagaaaggtagagatcatcaaaatgaatactccactacttttagatcatcaactgttttatttccaaagattacccaaatataaacctttcatgatatataagaaagtacccaagatttttggcgtctgcgccaactaggaaagctgacatgattatccatgaactggagaaccgttagttcttcggcctaatttcgatcccctctacaataatttggcattggtgcgatccggttaagcccctaaactcaatagaaatgtctccattctcttcattgttctgttttaccactgatatctctgtactaatttcctgctccatccatccatcacttcttacacaaatgcctacatatttcagttctttcttctggttattgttggtttttacaaatgatgatccatcataatccatgttgaacaacagtgagcgcagatgtttctgcggcataagatggttgcattcatgactgcaaatgctggaggtggatgatgacccagatgctgttgcatcttgttctttgtagcctccattttgatcttctgtgtgcaagaattggacattgtacacaagataagctccgtaggatgtaccgtttgagagatgctttgtgttgaagataccatagatgtccaaccaacacaagtgggagaggatggccacctcagaaaacctagaaataaagaagggaaaataatggacatataatcgtcagaagggttgtctgctatttatgggagagaaaaatcaacaaggagtacatcccatgacaaaaaaaaagacatgtttacaatgttctgtggtagtagaaccaatctagattttctaatcaatatggaccatatctactgatagcagaattcataaatcaacacttaagatcatttctacggatgataatactcttagtattcaagaaggaaatgcatgatattttgtactccctccgtcccaaatataagcatttttagctattaatctggatgaccgtgcgtccagattcatagccaaaggtgttacattttgggacggagatagtagtaaatgatatttacataaagccagaattaaatttgaaaacatactgttgatttgtttttttcttataaatattcggaatgtaaatgttttggcggaaatataccgtcgacctcgcataaccgttgcgtaaaaatgatgtaggcgtaacgacacgggcgatctcgcacggcaaagatgcgagaccgcacggtcttgtgcgaggaaacagctgagaccgaacggtctcgcataaggaaccaacgagaccgaacttcttgtccaacggtgccgtctaattagtgattaattacctgatttatgatgataattaatcactaattaattaaccatatgaattggcatggcagtccgggatcgccgactggttcagcggggtctcgcggtatggctgcgcaagaccgctcggtctcgcgccgccacgtactgtccacgtcctcgttttcgcgaagcgatattgataatatatttctcccaaaataattacaccccgaacaatttaaataaaaaataggtaaacaatatatttctaaatttaattccgtaaagccttgcaaaaataacacatataatgtgggatttcttcattggttttgtgcaccaaccacaaacctggaatccggatggttttgtatccagacgagacctccgtagggatagccgctccatccaaaaccgagagctcttgctcgcatcatgtatttcttggcaccactacgcttctccaacgaaaagctctggtgcaatgagagcagggatatcagtgaactgaatgcccagtactgttagtgtgaaggcaaaactggtatgaactagtctattactcccttcattttatattataggtcatttgactttttttagtttaatcaaatttatagaaaatatatagtagtatttctaaaacaaagcaaacatattatcaaaatatattcaattctagatttaataaaattaatttaatattttagatgttgctaatttttttataaacttgatcaaatttaataaagtttgacttagaaacaaaagacaaacgacttataatatgaaatgtaggaagtatctatctatttatgtatttagttgtgctattcttcttatctatctatctatctatctatctatctatctatctatctatctatgtgctatcagtcagtgaaatgaattacgaaggtctagattaaaagaacagatcatatcaagaaaagtttccaaattccgtaattgtgttttatcaatagaaaacatatattaaggttcacaaaattaatctagaaaaaataattgtccacaagtatgtgttgaaaataaaaatattcaataattttttacgtacaattttgaatacagttttaaataaataacagttattaaataatagccttgacaaacttacccataactactatatgctatgaaaattttccttttaatcattacaatttacatagaatttcaataaaatccaaatggataaaaatagttttgtaatatattgtatccacctattaatatattttgacaaacctattaattccatatttacctgtcaacccctttatttttacttataattggtcagttaagatttggagcttcagagtttaaacatttcatagaacgagattaaggcactgtttagttcctctaaaatggcataagttttgctgtttttgagtactttttgtcaaaatggatctaaacactaatatcaaaagttagcaatttagcatttatcatttggaagtctagagtagcaaattttaccaaaaaatacgttgggagcattgctctatctgtctttactagtaaaatggtaaaactttaccatgcatctaagtcatctagacaccaactaacaaacttcaatgccaaatcttttgccaccaaaacttttaccaaaaaaatttaccacagcaaattgatcttaacaggccctacaaaagaggcaatagtagtacatagtacttcctccctctagttttggttccataaggctattcccaacccaagacactagatatagtttccataaacttcacataattaagaaactaatactagacactactcttccaaacatcactattccatacttaagtttaatgctacttatctcacatgatgtcttggatgttgtgtagaaactatgtcccatgcaagacgtggtttccttctctttcctcatttattcacttgtcacctcattttttatcctaggtggcagtttatttaatgctatgacaccattctagtcattggattggaaatggcctaatgttttgaacaatgacatagtttctaaaatatatatttaactatgtttttctattatattatatagaataaataaatacatttttatttttatatagtactactatatatattgctcaagtgcctttataaactaaatatttataaaattattgatagtcaaaattataaatgtttgaccaaaccgtgttcaaaacttcaataattatggaaccaaaggtaaaaaaaaagaattaacaaacaacgcagataaggaattaaatggcttttgattaccagcttgccgccgtcgagaaggacaggcaagtcgcagaggcggaggaacatctccttcttgctctccccctcgcggccccccggcttaccgtccagggcgtcgccgtcgccggcccactccggcgggaggaagctcccccacacgtcatccgagtcggccaccggccggagcgccgcggccgccgccgccagccggcacgcgtcgccgggcgacgtcagcgaggcaatgcacgcgatgcagtccatcggcaggtcgcacatgccgctgccgccgccgccgccgccgctcgacttcctctgcatgttggatatatgtatatatcgttctcacgtctgcccttctgctgttgttgaagctgcttggcggcgagaggtggaggatgaatggcaaaatgcgggcatatatatgcatataaatgcttgttctgtggtaatgaaaataacatggtgtcgcgaccatggcgacacgcagagctagtcacctgcgtcctgtagtttctgttttcattgtaggcgagggacgaacaagcgttcttgtgttaatcacataatgacgacatcgtgtataagagcgtacatagaaaggttgacccaaccggtcggtcggtgaagagaacaaatgatgactagctaatactccctccgtttcacaatgtaagtcattctagcatttcccacattcatgctaatgttaataaatttagacatatatatctatctagattcattaacatcaataggaatgtaggaaatgctaaaataacttacattgtgaaccgaagaaagtaactctatgttaggttatatacttatggtgtactccttttaatccgtgtcactgtgtttggcaccaaatttttatgtaaaagagaagtaatgttagtatgttgtggccattattttctttttatatatatttattactgacatgtcgattctttggtcccatgactttttttttctttagacatcctcaatgtttattgtaaactaggtagtaaggtagactcgtgccatgtggtaatagtaggatgaagaggcaccacaatatatatatgtgtaaagtagataataaggtgggacccatctgaaaaattcttcaaacatgagtcatgctacaattaaaaaatagatgggaccagacataaagtgctaatacatggtagtaagtttatatttgctagttgttaaccatctccacgatgtgatgcattctgtttattacccacaatttcaccacatgtaagctctctaaccccgtatgttactagctgatttgctcgtgcgttactactgaatttttagaaaataaacttttgcattcatttttaaatcctaaaactatctacctatcaagctatacttcaccatgagtttttgatgcttactgaattagctagagtagaggcatagagctatttctgtttgattaatcataggagaagcaaaaaagtttcaccaacattatagggtccatacaaaggtgaaacacgtgatggtgatagattcagtgtcaccactattaccaacatttaaaaatagtatagcaaatagtaggcagttggtgaggttgggggtggcgaaaccaccaccactcctctgtttcaaagaagtataaataataccccttatttaaatatatatatatagtgaattatggtttggatcaacttttgttactaaaatttcagcttcgaccattttttatccaactaggaaggtagcccgcgcagttgcgcgggcatcttatttaaactatcataatttttgttattaggattttgaatatcatgacttttgtctctcggtgaaagaatttgaaggttctttccaacacatgattgaaaaaaatatataagtcagaaacatgttagaaatgcatgtgtgaaacaacgaataaatgaattttggacagtaaacgaattttttacagagtacagcaataatatgaatgttaaaatttgttaacccacatagatgaaatcatcatctttcattgcataaataaactgcagttaaccaaacaacctttgcatcagcagcttgattttctcgatcccatgcgaaggaaaaaaacatgcgcatgcatcttatttctattttattaattttattgccattgagatataccgcaactttttggatatcagctaatcgttaggtgcaccgtgcatggatacctcgtaagcaatatgatttggggattagcagatagtggtagtgtggatatacctcataagttataattgatagtatacatattaagcgtttaagcgttttagtagctttctaaatagcttatcggattggctactcccttgtccaatatatctgtaaagttcatcccactaagtgcagctaatgctaattctctcttctctcatgaagccacatcatcttaattgtttttagcccttggatgattcatcaagggtgcaaattgcatttcttctccccaaaagccacaccatacaactcaaccatttataacttttcaataattgatcaaagtacaaaatatacaagcacatgaaagaaaatcatatagtaaataagatttttttttctacagctcatatctactattttatcacacaaatctcccgcagcaatgtgcggggtacccatctagtttatagtgagaacgtttcccggactactaaacatgtaatattttatctttttctcataatttctatgattttatctaatttattatagtatcatgtatgaatttaagagtgttcataagatgtttaatggactttaacttttctatg

SEQ ID NO: 16706 - DNA, 7434 bp, Oryza sativa
aatagttaaatgctttttttcttagaatttatgtgatttattatagcgtcacgtggcagcttaaaagcgtttatagagatgctatgtggcggcttagaaccgtttatagagatgctatgcggtggattagtaccgtttatacgaagtttattggactttcagtatataattgatagatagatgggtagattgtcaggaataaaaagaattaacctgagcataaaaccaacatatattttttaaaagttaatacatgcaaggatgcacgcatgcatgtaactctccatgaagaggacatcgataaatgtaaccatagaagtctatatttaattggtgatatagatcaaatgcttttaatattttattatatatgctttagctctcaacaacttacgaaaaaaaagaacagatgctgcatatacatgcttgagcagtgagcagattttaccggattggacgttttatatgttagctgttaatttttcttttcaatctgtaatttttctgattttttatgttttttatttcgatcttctttcagatggatagtacttacgtattttctctcgtatagaaatgtatattagaagtgagagattatattttaatggatctaataataatctaatggtccaaaataacgaatccagagtttaagtattagatgttttacctttttcttagaattctctaattttttatcgcatcacatgacgatgtatgagcgttcgtagaaagccacataatggcttaagagtgtttgtaggaaatttaatggacttttagtaccggctaggagggaagggtgaaggagatttattttttatctaatggttaatattatcgggtccaccattttaaatgaaaactgatggttatatattttttttcagaatttttctctaatttattagaataccatgtgatggataagttttttattttttcgtatagtagatctaatttatttatgcatgttttgtgaaatgatacattatcatgtttttctattttatataataattttaatagcatggatatgataaaaactaaatatttcttacaagttaaattacagattatattgccttttgaatcgttaatggaccacaatggatagaataatacggaagaataaaaagttttatgtgtaattaaaaattaaccacattttttataaattatggttattttaaatttattaattttttaatattttaataactaaagaaaaagaagaagggggagagcaggaggggagggaggaggcatgtaagtaccttacgtacgtcgtacggtacacattggaaggtgtgggccgggcaggaaagatagggaggtgggttatgttttttttgttaagatagatttgataaattaaatagtaagaaataatgggtccaccaatttattagattgccacgtgacgatctaggagcgtttgtaggtgtgggccgggcaggaaagatagggaggtgggttatgttttttttggtaagatagatttgataaattaaatagtaagaaataatgggtccaccaatttattagattgccacgtgacgatttaggagcgtttgtaggaatcccatgtggcgtcttgagagcgtttgtaggaagtttaatggacttttagtatataatagatagatagatagatatgtctactttgtactaaggtaatttttacctttgtgtcacttcggataacccaaacttttatatatatccacatctagcttagactaagtcaaaatctaacctgcataattaattttaggggttcatcagtcggcgtaatattatgatctacatataacttttatgagttttatgagttaaagccttttggccttgaagcatgtaactaactaaaatttactccctctgtctaaaagtataggggattttgccccctagctatgcccacaaatataggcctggtttagttcctaactttttcaaacttccaactttttcattacatcaaaactttcctacatacataaactttcaacttttttcttcaaactttcaattttagtcaaacttttaattttggcgtggaactaaacacacccatagtggatttgtctcctcccaaagcaatcaggactgccagccacccatcaatcaattgctgaaaaggtctgatattactactactacttcattcttcctccgtccaaaaaaaccaacttagtactggatgtgacacatcctagtgctacatacatttgttcagattcgttttactagaatatgtcacatccagtaaatttcttttttttttttgacggagggagtaccatccatgccaaaaacttaaaaaattacaaagaatgtacttgaaagtactacttaccagtactactttgtttattgtgccaaagatgctttttcaaacttcatagttgtactgcttactctttcttaatttatgctattttaggcaataataccttatatacctggacggagggagtaatatatattgttgttacttgtagagacttcgatcaaagatcaatgacaaagctgttaacaaattgtataatgtgctctctctctctctctctgtgtatttcactggttttattgaatatatttgctgccgttagttggggtaaattagagatgacaatgggccccgaaacccggaacccgacgggtaattactctattaggggctgtttgtggttcagtttttgtccccatgggtctcttagcgggcaaaagtgtcacccgtcgggtggagcgggtgcaggtccgttatcttgcccccgtacccgttaacccatggggctgatatgcagttcttgtttaataggtggcccatcagaatttcgtttcacatgcattgtttggcccaaggcccatgcggagaagagctctccagtaaaaatcaacgcaaccctaatctcattcctaagtcctgaccagccgcctcccttcctcgtttctcctctttcctctctcatctcgctgtagtccacacgcggacatgccgccgccgcctctgcactgcgccgcctgcctgcctgccgcgaccccattttgtccgccatccgtgctgcacctgcgcctcgatgccagccaatagatcgacgaccggcggccccaggcgcactgcgtgctcgaccacgccgcttcctcttgttctgcgctgctcggcttgctgtcgtggttgttgctgttgtgtgtggagacccggtgggtgccccgtacccgttgcggggacggggacggggacgggggaaatctacactcgtgtgcggggatggggagggtggcgttcgattttttctgctgcgggggtgggtacggggtggtcgcacccgacgggcgcagccccgttgccatccctaaccatgagcgatggccacatcgtccaggtgcgctacggtgacacaggtgcgggattggggaggaggagcgggtggtcgtggcggagccaccctggatgcagcgaggtggcacctgctcatgttgtacaccgacctagcaccatggttcaagtacgccaccgtgtgcgcccacgagctcagctcctggtgccacctctctcactcgcctcgacgggacaggtgcatccattgtcgccacagacgacgccgacgatgcgagagaagaggaagggagagaagatggcaaagagagagggtaaccgactcactgacatgtgagttccacaatatttctgaattttgtcagcaccacgttagcagaaaccgtcatccaaatcgacttgggaagggtgtgtcatatctagttctacggtgcaagatgaattttagactcaacaattgagggacctaagtgaacttattcctttccactgcagttgctaacttgctatcatgtatagttagttgaactagctagcactgttgcgccacgggtgcctttgcggtactaggctgcgaatggatttacgggcctgttcactttgatgcgaaaaaaaccttaccaaattttggtaaagttaccaaaaaaaaatagctatatttagtttgctgccaaattttggtaattatataaaaaatcctaccaaaattttggtatcaaagtgaacaagctctacattatttccgtatagttgggccacgcagaaaaggaccgacgagcttggtgataattaactatatacacgaatgactcacgatgaaaactgagcaagacttgtacaacgccgcatacagacgccacgccacaagaagctcctatgatatcatttttcctctcatgtgggttgatatatgagcctctcccacgaactgaggctcatatatcagtcacttgaagttatagttaagtcagagggtaataagttagaggatcctggttcctacggacgcaacatatcccatctgtttttccatcgccaattaaccatgtggtactcgtatcgatacaagtccattctgaaaactgtggcatgggactcaacaaatcaaagctcagtagaaaccggtaccctcccaagaatagactttgtagcaaacattcaactgtatcatatacatcttttctttttcgttagtaacttgcaactaaaactgcggttacctgtagtatgcatgattgaacaagtcagtccacctgctaactcaagaggattcttctcatcacatcgcatcaaagagcgaaaagtcctgaaaatgatcaaagtaaatgtcgacagcacattttctgaaagaccggtcacaggtattgcgtgaaaacaaaccttattaggattagtgctgaaagcagcactagtgaggtcaagttggggtcaaatgtatgaattgtcagcgccttagcgtcgtctttttctggaagagtgagtatccaacaagagcagacagtaatatagtccataaaacctgcagaacacaaggggttttaactgatgaaccatgatatgcaatatttaattgtttaatcgaacataatgccaacgcatgcaaactgaattaaatcttaaggcagttgagaaagaatatgggtcttgaacagcatctgaaaataaagagaaattaccatattaattgtattccatctctcaagcctccttaacctagattgcacatcatcaagcacactatctgtagaagaaacttctcttgtaggtgaagataaatctgaattgaagctacctccctgcaccacagaattattcaatatatgagaataaagttaagaaagaacaatagctaattagccatagaatctgatcatacaaacacatctgctattacagttccgtcgaggaaaatctcgaataagtatactacaagttgtaaactaaacaaaaaaaaaccggaaaggttaacttagaatcctcaaatcaaaactagcgcatgacatgcagtcacacagctgatggaatcatttacagcatacattaaatgattaaaagtaacataactttttgatataggaaggtgcaggtcatagcatacatgcacatattcatacatatagctgatggagacatttacaacatccaataaaagtaacattgaattcataaaattaagtgtataagatgtggagaggaagatactaccactgacactaacttcttttaaaggaccaatagacattttttttagatgaaaatagctacagttaaacatgatcgcagcctttggtaaatcatctgttaactgtctgatgtttggtaaataatgtatggataagcatgctacatggacttgaaccaatcaagcaaccatgctcaatgggctattttaaaccaccgaccaggtgaccacactacgaaacataaccgcgtccaacacaaaaggcaatttggtagtatgttctcccacaaacagttgtaaagaacaaatacttatgttctgactaccctaaatcatagccataaaaaatatcccataatgtaacagtagtatttacaactagttggtttgaattaacatacttgtgactggataaactcaacaagttcttgtagcctagcagcttgttggttatgaataccagtatgaacattttcatccgctggcaaactctccagaataatttgaagatagctctgcagagcagaataaaatcatgaaactgatatgcaataatgtgtgtgcaaattaatcaatttaactagctaggattttctaggagacctttgtcgtgtatgaatcatctaagctgagtgcagatgcagcagaggaaactatttccttgttcgttcctttaatctgaagatacggatttgtctcaccttgtagactatcaacctctataagaatcttcaatcaagtaaacaaacgttttagaagttagtggttccagaaccaatgacaattgcaaaaacaggaaatccgctggcatcatcataatgttaactaacttctgtaaaaatattacaattatgaaatgagaaatatggggaaaaagtaggcattatcataaagcagcttcaaatcagaaaaatattagctgttcaaattctgtgcaactgggaacaacaatgtcctgatctgactcctaatcccagtaagtatgagaacactcaacaatgtcctaatcccaacaagtatgagaacactcaaaaaaaagtggtgaaaattattccaatgcaaataaatattattccatcgacccaaacatacataataaatttattcatatacaagagtgtcactattcctaaagcataccagaactttcattgaataaactttttctttcaacaattcaacagatatgaatactactacctccgttttttaatatatgatgccgttgactttttgactaacgtttgatcattcgttttgttcaatttttttgtgcaaatattaaaaatttaagtcatgcttaaagaacatttaacgataaatcaagtcacaataaaataaataataattacatacatttttttgaataagatgaatagttaaatgtatcttaaaaagtcaacggtgtcatatttaaaaacagagggactatagttttctgcatagatatcaatacaggtagagtacaggttgaggcacaactgttaaccaaaacaattttaatttacaaatacttcaaaccgcatcattttatactatatatagtgagtcaacaacagtaacttaaactccattcatttgactgtttcacaatataaatcagaaccaaccatacacacagaggaagcactcaaaaatttctgaaggaatatttggtaggtactatgtctaaaatttcataaaaatgcatcaaactaggtgaaattttccatgatttctatatatcaatatctttgaggaaaatattagccagcagcccaggcccagcacttgctgacaaatttttggccatatcagcccaaacatcagaaagttagacaaagagtgtctccaaagatacattatttaaactacgccagcagcgcaaagattgtatcctgcctttttgagttaaccggaggag

SEQ ID NO: 16707 - DNA, 719 bp, Oryza sativa
agtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggcc

SEQ ID NO: 16708 - DNA, 1593 bp, Oryza sativa
ataagtttttcaaaagaccaaaatgtgaaaaatccagcctaagcctgcgaggctgcgaccgcctcctcgagcagcatgatgatattgctcggctcgctgccatcgcacggcttgttccccttaccgttttcggcgtggttatcggaccccacggtaaagtggttaccttgataaccgcaagatataccgtggttttaaaaaactttatgtattgtaaccgcgataaccgttaagtaaccgcactgttttgtaaaccgagggaacgatagccgtacagcgtggacgaacgcaagtatctgtacagaaacgcaaacagagatcgacgaagggaatgccaaacgcccagatctgggaggctacgacctggagcgcagatggtgtttgtctctgaaacagaggagaggacgagtcggctcaaagcaccagagagaaaaactaaccacaggatggtggcacgctcgtggtcgtgggcgcctgggcgacgaacgtgcaagctggagtatgagagagcgagccatgaaggatgggcaggccgcactcacgggcacacggcgagctgcaagcctgcaatgcctgcaaggctgcaaatcagagtccacggagctacagcgtgtcgttagagcaagtttaatagtatagcttactgctagctctaattcattatatccaatctaataggcaattcatacaatagttgcttactatattattaatatattgttccatctatcatacacacattgtgttttggagtccgcgctgtagctggttacaaatctgtagtccgttgctcttctctctcatattttatctcgttaaaatatgtttacagctggctaatagattgctattgtatctgctcttatgcatgatcgccattgttcccagataaacagaggcattacccccacggctcgggatctctactacacatttcagcatagcaaagcgccaaagcccattggccccaccggccaccgcgcataagccctcgcaacaacagccaacttgaagcagtggagctcaaaattcgttccgattctaggggggatcgagcagcgagcggactcccctcgcttaccgccgcgcttggccgccgccgagggacggtggatcgcggtgtcgggggactcggcgtgaggggaagcgggaggcgtggtccacctcgttaggccggtgcctactcccagcgacggcaccgccaggacgacgcgccgccgtgatctcggcggctccggacctccggttgtcttctcgaaccgatattggtacgcttccttctcaaacatcaatctccatgcctcgttgatgttttaatctgctactattattgagtattacctccgtttcaggttataagactttctagcattgttcatattaatataaatattaataaatctaggcacatatatatatatatgtttatattccctagcacagtgcctgtgcgttgccacgggtgaagtcaattttgattttacatatatatactctgtacatgcacgttagtagataaggaatcgaaagcgatgacatatcaaccgaaagtgactccactaaatcgaaccttctattgttgtgcaacgaatt

SEQ ID NO: 16709 - DNA, 15234 bp, Oryza sativa
cttcattaccggatccgttgctgccgcgcatccccactaccggatccgctcgatttatgattataagaaagatattgataccaccttgaaataaaattgttttttattgactcctatatttatggctacaataagttatttatttttttaggtcatgtaatattgtccatatcacggatgcccgccgtccttctcgtcatcatcgtcgttgtaaccgtcgtcgttgctgtcctcatcctcatcctcgtccttgtcgtggggcgtagggggctaggggtggccgggtccgcccgctcccatcactgtcgacgcgcgggagggagagttgaatccgttgcccccgtgcctcttcaccatcggatccgctgttgccgcgcatccccaccaccggatccgccgcagtcggatccgcgcgggtgatggccgccgcacctccccaccgtcggatccgccgccggacgcctcaccaccgccagatctgtcgccgctgtcgcatccctcctccgccctctcccactgcccgagccctccaccgcgtcgggaggggggagaggggagagaaagagtgggggagaagaggaggaagccatcgtcgtcgcccttgcctaccgctgggagggaggagatgaatgggggtgatgggaaagagagaggactggagaataaaaaaagtgagaatctacgggggggtatttttgcatgccggtgagttaaacaccacattttcacgtccatatattttaaatggtccgtttggaaaaaatgattcttgcatacaagtttcttaagaagccgtatgggaaaatgggataaatttttgtaggcacaaacacttatggcctgtctgcaatctattcgggtggtcatccagaaaaatattttttaagtagtgaatggaaagatgacatgatgaatccaacctcattttttcgctcttggctacacttaatgctatgtatttgttggtgaattaatgttatatataaataaattaataagttgtaaatgtataataaaatttcctaaatataaagcatggatggatttaattctatgcgtggttaattctgctctctggaatttttctcggatttttcaaagctcaactactaattttaataatacaaagaacgtttcagtattatttaaataataaattaatcattaaatgatctggttttaatgttgttatccaagtatgttcaagagttttcttgatattatttgagcatttgaaataattttaacaatttaaagatcattttattggttaatttatctggagaagtaattaaaaatcccctctctttcttgggcctaatccgtgaagtccactttagcatcctacttcttcctgttcggcctagtagctgcaccgctaaaagtttgtttcacgtccttccttctttttttctcgggctaggctttttttccccaaagtccacatctcatccctgtcgctacagtgttgtcttcaacctctggccggagacagaacccgacccggcgccgctttccactccaaatccgggcgcccctttctattttttccaaaattggttgaggggaaatatttcccttatcctcctcttccgttttccccaagaatcggaccttatcccggagaaattaacgcggaatcgagctcggttcgagcttatctctccaaatagaaccctagtttttgtgaacaaagctgaaggcgacggtgacggacgaaaaacgtgggttaaggatgtgacgaccggaaaaatatgaatatttatattagttatagatatagatatatctcccatgctgattttattatttgtgtggccgtgagtcaacctatgtgatttgtatcagtctggattagagtccgatcgatttgctgacatatcgatgcttcgatcttttttccggctggtgcgtgcgaacgactcgtgagggaggatgtgaacacgcgcaggtattaggggagaagtcggacactaacacggacccgattctgatgcgcacgaggtctggattagagtccgatcgatttgctgacatatcgatgcttcgatcttttttccggctggtgcgtgcgaacgactcgtgagggaggatgtgaacacgcgcaggtattaggggagaagtcggacactaacacggacccgattctgatacgcacgaggtctggattagagtccgatcgatttgctgacatatcgatgcttcgatcttttttccggctggtgcgtgcgaacgactcgtgatggaggatgtgaacacgcgcaggtattaggggagaagtcggacactaacacggacctgattctgatgcgcacgagcgggcgagagtgcgcaagccgagtaggaatcgaagtcagatgacgtacgaaacatctggcaaaaacatcttaaacttttataataggtaaagattaacatatacttcctccatcccaaaatgtttgacgccgttgacttttttaaaaatgtttgaccgttcgtcttattcaaaaagtttaagtaattattaattcttttcctatcatttgatttattgttaaatatacttttatgcatatagttttacacatttcacaaaagtttttaataagacgaacggtcaaatatgtttaaaaaagttaatagtgttaaatatttagagaatgagggagtatatgaatgtgattccggtaaaaaaaaataaatgtgaacaatgctagaaagtcttataatatgaaacggaggaagtactgcgtaagcaactggaaatggagttatgaaattattactgaatggatctgttcatgattatacaaatttttgtctttgccacctggccttaattaatcccttacaaccatatattcctcacaaataatgatagtaatatacaacaggcgtgggctatccatacgtactgtaacctaaaattacacacaggaaataaaacaatacagcataccctgttcagaacggaactacaaagcatatcagatatcacttcaccgtggtatacctaattagcgtggcaaactaattgaagatgataattcttgctccagactgtagcaaccagaacctgggattccttcagatgttaaatcaccagcatttgtataaatattctgtgcataagagttactagtatttgggcttaaaaggtgctcgatttctccatcatttcctgggagcagttggaattttcttagcctcttagttttcaggaactgcagcctcatctctacttctttcatagtaggtctatctactcctttaactttcaagcatgccattgtaagcgaggcaattccatcgatctcttccttgtttgcctcttcaacaacctgaggatctattatttccattagagagccctcttgaagtccttcaacgaagtaatgagacaagctttgttttgcacctgcctcattaatgaaaattggtttctttcttattagaagttccacaagtatcactccaaaactatatacatcacttttttcagttagttgtccagtatgataatactctgggtctagataaccgaatgtgccttggacaatagtcaccacatgagtttcatcaagtgaaacagatcttgaagcaccaaaatcagagacctttgtagtaaagctgccatctaagagaatattggaagatttcacgtctctatgaaaaattggtattgcagcagctgaatgcagataggaaagtgcccctgctgcttctacagcaatcctaatgcgatcatcccatgacagcgagcatctaacactaagatcggtatgaaggtggtcatgcagtgtgccattcgatatgaattcataaaccagcagtggcacctcagattcaagacaacaaccaaaaatctttaccacattgcggtggataatttgagataagataacaacctcgttgataaattgatctatctcagtttgctcaacgatttttgattttttaatggccaccacacgctggtcagatagaatgcctttgtaaactgtgccatgtcctccacgtccaagaacacgagttccatcaaagttgttggttgcctcctctagttcttccaaggaaaatatcttcgttttgtttgtggcgctttcatttgagattagttgctccaagagtaggccttgatttttcttgaaatatgctctccgtattctcttttggatgcctttcctccacttattggcaagtatcattgcccccaacacgataactatggagccaagaccacaaccaattccaattgcaatacctgcatcaattcattttgtcataataaaatcattttgcatgttggctattacttcttacggtcttacctaaaagaagattgcgttgctttgctgatgtaacacacttctttttgattggatcaaactcttttctatgcgggcagcttgtgcatgtataatttccaagtaaattttgacacgtgccattgcaatagtttggcagtaagcattcattgatgtctgcaaaaaactatgattagtttgtcgattctcccaagttaaattgatataattcaatttctaaacatttgcaggcatgagcattgctggtgcacactggaggaggtgtgaagaggaaataacctgtgcagccatcctcgatgtatgggtttccttcaaaaccgggagaacacttgcaacgatatcccatgaactctttcctgtgggtgacgttcaggcagtagctgtggctactgcggcatgcgtatgtagtgttcttctgcacagctacttcacaagttaagttggtaactgcccatcttataacaatggcgtattccatagagagatcaaatctatcttccacagggcctgagaatgaataatcacggccagtatctgtggtctgaacaattatcgcctctttctcgtagtttgtgtcattcatcatgtttccgacagttagagtcccatcatccaaagacacagcagtcacatgatattgtgcttctcctaattcgcaaacagttaggttaccttctgtacaattaagtctaaacctttcgttagcaaaacaaccttcttcgactccaaaagggaaaggaatcttcatgtctccacaggatgttgaacagtgttctttatatttggggttgtaatctgttccaccatagaaattacaatatataataagaataagaaggaggttagtgacagtgcattatattttgcttcgttttgggggtaaaaagggggcaggcaggaagtacgtacccgtgcatccatctagaaggtaaggattcccctgttcataaccagagcagtaacaatgataacctccagatgacacattccggcaattgctgccagggctacacgcataacttgtgttgttcatgcgcgcgcgttcacagcttggttgatctatggtagcaaaagaaagtactgtgccttcaacattacttgtgtttgtccaacctaagaaaaggtcacttgtgtttgatatataatagtccgatgacatgaaagccatgattccagggtgcactggatctgtttgtgctacaggaatgccatccgaccgaagaattatggttgactgaaagccccgcaagacccttggtaactcgatgaaacagcatcccatcccattacaaggccctcctattggtgccttttcaccatcacatctactcatgcaagaacctatgaggtcctccgtgccatactcgaacaaggtagcatcgaaattacaaccgataacgtaaaatgtgttgtaatgatcaatagtaataccctctgttggggccacccaggatatgttgtaggtatccgtacctggtctcaccgtaatgttgaagtatatctgggccaaaacatacctataacccaagtctgtgatctcagtagtaccatcacccagaaagagcttaggagttttggcggtgttgcggcagatgagctcgaagccttcccggaaacagcccggcgctatcccgaaggggtagtcgatgccaacatctccgcaacgagaggggcaatgagccagggaatcattagaagggatagacaagagccctccgccaactccgtagactgcagccgatgctggggacgtagcagccgagcacagcagcacaaaagagacggcgcaagctgccactaataagctcgagctcatctttgcgccgatcggctagcttgcctagctttgtgggtgcagatatgtatgctaactacgcgtgagatcgattttgtattcagaggcaacgtctgtcgtctcttaatttatactgatcgtgcgcctgcagagacttaagtaaacgcaagattaagagcgattccccaagcgctatataacatatggagacattgattgatcagtatttcgatcagcagcaaacagttttgttgcaatctgccaagcctgtatattgtcctcgtatatgaacgaattccaggggcactagtcccatcagatatccctgtcgttgctggagccaacgactcgcccaactgccggtcgctgctcactgatcctatacacatctgattatttccacacgtccatggctatctgactatctaccagctggaaagaatggtactgtccggatgctattaatcacaacacacagtaacaaagcaatacacatgctactagatgacgaaaataatggcctgcggcgttgccaaactagagactgtagaagattcaatagtagatttttgtaggttcttttctaatgaatccttgaaaggaagtaacatgtcaagtcggtcgatctacactgcagttagcagtactctgatgtttctacaaactggccaattcgcccaccatattcttattgaaataattattcgataatcttgttatgcaaaaacaaaaaatgacaagtaatggggtggactgtggagtgaagatacgtacgtgtagaaattaaaggtgataaccacagatggaagaaatatatatgtggttgagagatgaaatgaggctgtgtttagatccaaagtttggatccaaacttcagtcattttccatcacatcaacctgtcatacacacacaacttttcagtcacatcattttcaatttaaaccaaaatccaaacttcgcgctgaactaaacacaacctgagtctaatttaggtgtgagtttgtttattcgtgtatgtctcaaactcttttagagctgtcaaatttatttctaagcatttaaaagctctgcattaacttttgaactaagacttcgagggaatgactacggccggccgtgttagaccaggtatatgcatgcccgggtgttcacggtaagatgacctcgcaagtcgaaatcatttctaccaacatgttcttcggcggtgactacgtacagctgacaagtacgtgacattttccttcccgacaagctagcgagatgatgattggaacgaccggtgcacgtgcgaaacgtttctggtagatgactgggaatataaattattcatacaagtcaattccgatctgaacgaaggacaacccacaaattatggaagtggtgtaataaatctggatcaactctgaatttatattgcaatcagttctgcgatctacacttatctatatgatctacacttatctatgtagtacgatttattttatctacaatctgaatggcctcgtaatttctggttcccaattttaagccatttttgcccgaaatcgctaataagcgactagtcgcgcgtgtgagcgcgcgcggcgagttcacccctactacttctagcctaacactgtttctataaacccacgggtctctgttttttgggcttcttcgtgtcgtgggctttcctgaaatgggctaatagccctcccgcgcgcgacacgacaaaggaggcggcggtcggcgcgtatgggcgtacggtttcccttttttttgtttttttttccgtatcttttccggttttatttttttccttttttttcttcccgtatatttttgtgtttgtccgttttttaatagtatatgtatgctaaactctgtgtacgtataaatacaaactttatatgcatgtatacaaactttgtatatacgtatgcaaacttttatatacgtatatacaaagtttgtatgtgtattttttggtttttatacatacgtataccaactctgtatacatgtatataaagtttgtatacacatatatatgtttgtatacacttattttttaggttttttatacgtatacacacaaactttatatacatgtgtatatctttttatacattaaaagtgcatacatataaaaaattatgtatatatacacacgtatgtataatatatatgcgtataaactatatatatacatatgtatatacatatagtacgtatacatatagtacgtatagtagtatatataggataacagatcacactagagggggggcagctgatcgcgcgcgcggggcctcgcgcgactggtcgcggatcagcggcccccacttttgcctacgtgcataagcaagtatggcgtgaattctcgatcttcttcccggcctgttagtttttgggcctcaagaagcccaaccacgtgcaacgggagccctcaactctggacctcaagtccaacatcgtccagggcagcaacatccatcccctcggcctcatcgcggcagcgccgctcgtcgccctcccctcagacctcaccgccggtgcgcgggccacagttcatcgcaagcaactaagccacagcctcgggagggagtcggggggaagggggcggcgccgtccacctcagcttccagcacctcctcatggcggaggcaccggcagaaggccaggccgacacgccgctgtagctcagcgccgattaatttcctgttcgaaatcggtacgctccctcgtcaaactgcaatattattattgatcgatgcaatggctgcttttgtgtgcgtatataacaagctctggttcgaaacacactctgaagtaggagtagtcattagtaaaattatattttgcgactggaggcacgctgaggagatgccctaagagtgattaaattggggttgctagcttaattaattagaggatatttgctggatttgtcaccgtatagggtcactatgctcgtcttgtaagctattacgagcagattcgtaaatataatcccgcagactgcagttccccatgaaaacattggggactcatgatttcaacattttttgagtgaaaattgggctattgtcattaaaagcaacatctaaaatgacaaattaatttcattaaatttagcatcgagtatattttgataatatgtttcttttgtattgaaaatactacactatttttccataaacttaatcaaacttaaataaatttgactagaaaaaaaatcaaacaacttataatataaaacggatggagtatattgcaacttctaagaatgtggtactactatatattatccttgcaaaatctaaagccattgcagggaccaataaactcgcccgcccattctttccacaaatccagtaccagatggaaagagttgcaatgtgcaaatcctaatccctgtacatatttttgatctgttttttcttcatctctataaatatatgaggcaaagcttttgccctcctttcaaaaaaaaaaagtgcaaatcctaatcaccatacactagcgtgatacaattgccacagtcttctaattcatatagatgaacaaaagaaggccggcaccgttgcctaagtaggattactgtagtacgataacgccgcatacacttttgtatactctttgctctctacgtacagttagaagctctgccctacaagttaattagcagtgtgtttcttctatgcaggagcaagccaacattggtgctctaatttatgagacggcggtggcgcaacatgagcaaagagcgacatgaaaatgacggacacaatcacgacacagcggcacaagtgcaaagccaaacagagaccgcggtggagttgcagggtgtttgccgacagaggcccagtgtcagagaagtgtccaggtgtggcggcgaaggggaggccctgtcccgcccggcagtagggctcctcctcttccccggcgcgatcagaaggctggtgcctcccccaagcgcggaggccggcaggccgccgctcccggttgtctcgtctgttcgaaccgaatctggtgcgctcccttgtcaaacggcaatctccactgttttgcttggtgtgtttgtggttgtgtgcataatctaggttggagttcttttttttagtctaattgtactggtatggttaactccatactcaaattatcaccactggtaaactaaactgtcttttgcaaagctacagaatttggagccatagacaatagcatttctgtttgcagcataggtacttactactacttgtggtccggtttgctgggatagagatttttttttttagagaaggggaaattcgctccataggagatttgaactcaggaccttggggtactactcaggtcactgtaaccactaggctacatgccctttcgttgctgggatagaaatggtgatggggtgtggagtgtggactgattctaacccttcacttttttcccctgatcctcaatcaaaccataaattagatttcctctatatatccctattcctgtgaccttatcccaccaaatccaaacaattttacagttcccattatgaatgcagggtttttggacaagtgatgaaataaaaaatttgaaccgtgccatttatactttgtgtaaaggcattcggaacgttctctgagttccaagttttgacttccgactagctctataatggctgtgtttagatccagacttccaactttttccatcacatcaacctatcatacacacaacttttcagtcacatcgtaccaatttcaacccaaacttccaactttggaaggaactaaacacagccaatactccgtattaacgatgtcactgctatgtggaaaaaaagatccagcatctacaaactgagttatcagtcagatacctattggtgacccttactgagcaagacattggcaatggagtaataaaattattactgaacttgttcactttgccactgtagcttaaatacaatattacaataccatgtcattccttacaaggatattgatcacaaataattatagtagaatacaactgtcattctatcaactcacatgggctatgcatacatgctgcaagtatacaggaagtgaagcatgcaaaaaccattctctggagtgaactacgtaacataacacttcgtagaaaatatgtgataactcaacactccatgttacatatatagctagcgtggcaaactgactgaggatgataattcttgctccaaactgtagcaactggagatcccttcatatgataaatcacctgcactggtatagttgttctgtgcttgggatttaccagcatttgggcttaaaaggtgctgaatctctccaccaattcctgggacggggagaaattggaattttcttagcctcttagttctcaggaattgcagcctcatctctacttctttcatagtaggtctatctcctcctctgagttttaaacatgcctctgtaagtgaggcaatatcatcaatgtcttccctgtgagcctcttcaagaacgtgagaatctattatttcgataagagatccctcacggagtctgtcaacgaaataatgagacaaactttgttttgtgcctacatcattgatgaaaatcggtttctttcttgtcaaaagttccaccagaatcactccaaaactatatacatcactcttttcagttagttgtccagtgtgataatactctgggtctaaataaccaaatgtaccttggacaatagtcaccacatgagtctcatcgagtgaaacagatcttgaagcaccaaagtcagagacctttgtagtaaagttgccatccaagagtatattggaagatttcacatctcgatggaaaataggtattgcagcagccgaatgcagataagcaagtgcccctgctgcttctgaagcaatcctaattcgatcatcccatgacaatgaggatttaacactaacatcagtatgaagacgatcatgcaatgtaccatttggtatgaactcatataccagtaagggcacctcagattcgagacagcaaccaaaaagcttcaccacattgcgatggataatttgagataaaatagcaacctcattgataaactgatctatctcagtttgttccacaatttttgattttttaatggccaccacactctggtcagatagaatccctttataaactgtgccatgtcctccacgaccaagaacacgagtagcatcaaagttgttggttgcctcttctagttcctccaaggaaaatatccttgtttaatttgtggcgctttcatctgagattagctgttccaagagtaggccctgatttttcttgaagtatgctcttctaattctcttttggatgcttttcttccacttattggctagaataattgcacctaatgcaataattatggaaccaatgccacaagtaataccagttgtaatacctacagccattcattaattttctgccgtgaagccactttgcattatcttaaggcaataagattgactaatctgtcagctatgacttacctataataagattgtgttgcttagctgatgcaacacactgtcttgtaattggattaaactcttttctgtgggggcaactagtgcatgtaaaacctccaggaaaattttggcatgtcccattgcagtagtttggcagtgagcattcatcaatatctgcaattaactcttcagttttttttgtttttattggtacaacgtatagacataggctaggcactagtacagccttgttcggttagagagggattggaggggattaattccaatcccgcttgatccccttgtagatgggattaaccgaacaaggctaaaggggaaatgccatggttaaactatccacataaaacttctctaaaattcttaaacaattgcaaataggaggggaatgaacaggaacaaacctttacatccatctcggatatatggatttccttgaaaaccaggaagacacttgcaacgatatcccatgaatatgtttgcgtgggtgacgtttaggcaatcgctatggatactgcgttatgcatatgtagcattcttttttatatcggtatcacaagttaaattggctacggcccactttataacaatgttgtattctaaagagaagtcaaatcgatcttaacaggaccataaatcactgtatcaccatattggtcaccttgagttattagtatctctctcccatattccgtattattcaacaaattacttatagtcagagtcccatcttcaacagacacattagtcacaataaattgtgcttcacttgtttccaaaactgtgatatgatctgatgtacagtacaattaagccgaaaccttttgtttgcaaaacaaccttcttccagaccaaaagggaagggaatgatcatggttccgcatgatgtcggacagtgttctttatgcttggggttgtaatctgtcccacaaagagagtgacaagggatgaaagttagatatatatcgatatatgtgtcttattttgcaggaaattaaaggtggtaggaagtaccttgcatgttgcatcctcccaaaatgtaaggattgccttgtagataacgattggtgcactcacaggtgtaacctcccgatgatatattttggcaattgctgccggtggtacaagcataacttgatttgtttaccagtgcacttccacagcttggttggtccgtgatggcaaactgaagctcggctccctcaacgttgctcacattcgtccaactcaagaaaagatcactcgcattacgtacgtaataatccgtatatgacatgaaagccatgatcccatgatgcagcggatctgatatttgtgctgcagcttcagcttgaacaagtgttgactgaaatccccgcatgtcccttgataacttgatggagcaacatccgttcccattacaaggctgtcctattgctattggtgccttctcaatgtcacatctactcatacaagaaccaacgaaatctcccgtaccaaactcgaacaaggtggcatcaaaattacaacagacaacatagaaagtgttctcatctgaaattttaatacccttagctggcgacacccatgaaatgttgtaggtgtccataccttgccttgtcgtaaaattgaagtacataggagccaaagccatgtcatattccattgctgttatctgggttgtactattggcaacaaggagcttgggagttttggtggcggtgttgcaggtaagctcgaagccgtcccgaaagcagcctcccccaatcccgaaggggtaggagatgccatcgacttccccgcagctagaggggcagtgagcgagggagtcattagaagggacaatcaagagccctccaccaactccatagactgaagccaatactcgtggcgtagctgccgagcacaccagcacaaaagaagtggcacaaactgccagaaagctcgagctcatctttgcgccagccggcttgcccttcctggtgtacgtaggccggtgcctgttaactaccgatcaatttatattcagaggcagccatctctttgtgctcacgctttcgtggactttataagtatagatgccagattaataccagccactccccaagcgctatgtataaaacatatatggaggaattgattggcttatactcgatcggcagaaaacaattttatcgcaataatttgccattgatcgacgaagtccaggggcactagtcgcatcagatatcccggtcgttgctggagccaacgactcgtccaactgccggtcgctgctcgcttctacgtccgattttctcctcgcgtccagtagctatcttccaattggaaagattggtactgcccaggaaggctaattaataatcatatatatactccatctgtactaaaatatactatctccttccttaaatgttcgacaccattgacttttttaaacatgtttgaccgtttgtcttctttaaaaacttttgtgaaatgtgtaaaactatatgtatacataaaagtatatttaacaataaatcaaataataggaaaaaaattaataattacttaatttttttaataagatgaacggtcaaacattttaaaaaagtcaacggcgtcaaacatttttttgatagagggagtaagagattttaatcggata

SEQ ID NO: 16710 - DNA, 4385 bp, Oryza sativa
atccatctccacgctgcttctgccactgtcccgtagcgctcaccgccagccggagccacccagctcaggcctccacctccgcgtctcgtgccgcagcccacctcctgcccctgcgcgccgcctcgtgagagcgagagagagtgtgaagagagagagaggaagaggggaaaatgatgtatgacatgtgggtcccaccattttttaaaaaaaatgttgatgggattgtcatgcgtacaccacgtaggacaaaaccgctctggaatgggttgagggtgttaattcgtccggtattaaaggtttagggtaagcaatgtctggcgggttcagaggggtaattcgatcgaccgcgatagttcagggataattcatctttttttccaactagagattgtcctacaagacatgcctatagacttttgcacaggctcttctgatatcttccaagtacttcatccgttttatattataagactttctagcattgcccatattcatatatatgttaatgaatatttcatattataagaatttctagcattgcccacattcatatacttcctccgtttcacaatgtaagtcattctagcatttcccacattcacattgatgttaatgaatctagcatatatgtctatctagattcatgaacctcaatatgtatatagaaaatggtggaatgacttacattgtgaaacggaggaagtatatgttaatgaatctagacatatatgtgtctagattcaataatatctatataaatatgagcaatgtttgaaagtcttataatataaaaagaagggagcataattcttgaaagaaagcaacatgttgaatcattctacacttacttagcgctcctttgcttctacccaactttccaattctcccactatattcttacttaattagacttttcgcaattcttaatatgcaaaacagggacaagtatggtgtggaatgaaaataaggcaacgtagaaattcaaggtgattgccccagataaaattaatatatatgtggctgagatgaaatgggtctaatctaggtgtgaacatgttcagagtctggttcttcacgtgcatgtctcgttcttttagggctgtcaaatttatttttaagcatacttgtatatagttactatttcatccaccaatatggggctactatttcgacgtaaccaactggaatgtgcagacagagatttcatagctaagcaagtccacgtagatcgaaagcataagcatatttttagctgaaaaccttcaggagctctgcgttaacttttgactatggtggtgtttaaatctcccaaaaatggagatgagataaaaattaagtgtttcacgtaaaatgatgtggtaataatgtgtcttttaaaaaaaagtgataataatgtgtgattaattgagttttaatttttataaacttgaaaaataatcttatattttaaaataactttcatatagaaagttttcacacaaaacataccgtttagcaatttaaaaaacgtaccatttttatctaaaagtttatacagtttttttgagaaaagaacaggacatagatgcacggctccacgccgcccgcagcatggcttaaacaaaacaacgttaaacacatgttggtcactattaaccaaatcttcctatctagcttattttaggttattatatctacacatatcataaattaaagcaactgaaatgtactggagtagaaagagattagaagcggccctgtttggatcagggactaaaacccctatcacatcgaatgtttaaatactaattagaaatattaaacgtatactaatgacaaaacccattccataactttagactaattcgttcgacgaatctaaattaatactccctccggttccatattaattgacgttttggacaaggctgaggtcaaacttttataactttgaccattaataactttaaaaatatttagtttaaaggaactagaacaacatatatagatttgtcttttaaagtactataataaaagtaaacatgtatttatttattatatatattataatagaaaaataaggtcaaagatatatcttgtagaccgtgtcattgtccaaaacgtcaattaaaatgaaaccggagggagtatatgattaggctatgtgatgctagagtaaacatgtgctaattatgaattaattaggcttaaaaatttatctcacgaattagctctcatttatgaaattaattttataattagtctatgtttaatactctaaattagcgtacacgtatccgatgtgatatgagtatccgatgtgataggaataaagtttagtcatggatccgaacaccaccgcgtagctgagtcagtccacataaatcgaaattaaagcatgcacctctcgaccagctggaatgacaggagaaacttttttagcctaaaacatttagaagctctgcattaacttttgaattaggacttcgagggaatgactacggccggccgtgttagaccaggtatatgccctggtgttcacggtaagatgacctcgcaagtcgcaatcatttctaccaacacgttcttcggcactcggcagtgacgactacagttgacaagtactacgtgacagtttcctctccgacaagctagcgatctgaacgaaggacaacccacaaattatggaagtggtgtaaatcttgatcaactctgaatttatattgcaatctagttctgcggtctgcacttctctatacagtactattgtgaatacttttgcattggcgtgaattctcgatcttttttccccggcctgttagagtttctgggcctcaagaagcccaaccacgcgcaacgggagccctcaactcttgacctcaagtccaacatcgtccgggggcagcacatccattccctcggcctcgtagcggcagcgccgctcgtcgccttccccctcaccgccagcgcgccgcagttcgagaaaatagacatttagccactttcaaaaagcggtttcgctggaatgccattctgaaaatgcgtttcgctaaaatgccaatacgaagcgtgtactcaccgccactttgccatttttaccattttgtgtattttcaattgtattttcggcttgatggtaccaaattgccccttgctagctagctgaaagggatcgatccagttcatgggagaaagaggacgagcgtggcgaggtggtccatgacggcggcagcggcgggctttgtcgcccgcgtgtagaggaaggtccagggctccggcgactgggatgacatgctcgccgctgcacccgttgctccgcggagaggtggcgcggtacggcgagctcgtcggtgcatgctacgcggcattggaggacccttcgtcgccgaggtacatgaactgcaagtacggcaagctccggatgctggaggacgccggtgccgggtacgaggtgacgaggtacatctactcgtcgccggacgccgctgtgccgggcatggaggtgtcgaccagcggccgcgccagctgggccgggtacgtcgctgtgtccaccgacgagacgacgcggcggctcgggcggtgcgacgtgcttgtctcattccgtggcaccgtcacccccgccgagtggatggccaaccacaggagctccctcgtgctggcgcgcctcgccccacgccgcggcgacggcggcggcggctacgtgaaggtcgagtcggggttgctcaacatctacacctccgccgacgagacatgccgcttcggctgcaccgacagctgccgcaaccagctccttcgcgaggtgtcccgactcgtcgcctcccgctccggtggtgaggacgtgagcgtcacgctcgccaaccacagcatgggcggcgcgcttgcgctgctcctggcatacgacctcgccgtcgccagcgtctcggcggcgacgccgccgccgcccggtcaccgtcttctcctacggcgggccgaggatgggcaacgcggcgttcaaggcgcggtgcaacgagctcggcgtgaaggtcctccgcatggcaaaggggaaggcggcggctgtggaggaggaggtgaacgggttttttgtggaggaggaggggacggcggtgtcggacgtgtcgttgatcggggtggcatcgtcggacagctcgacgggagaactcgtcgttggagaaggaggggcattctcgtctcttcaagccgctttgcagaagaaataatatccaaaatagtaaaaatggagaaaatggcaaagtggctgtgatggcgcgctctatatttgcattttagcgaaacacgttttcggaatagcatttcagcgaaaccatgttttcaaagtggcaaaatgtccattttctcctgcagttcggcgcaagcagctagccacagcctcgggagggagtgggggg

SEQ ID NO: 16711 - DNA, 7977 bp, Oryza sativa
aaaattatattttgcgactgaaggcacgctgaggagatgccctaagagtgattaaatgggggttgctagcttaattaattagaggatatttgctggatttgtcaccgtatagggtcactatgctcgtcttgttaagctattacgagcagattcgtaaatatagtcccgcagactgcagttccccatgaaaacattgggaactcatgatttcaacattttctgagtgaaaattgggctcttgtcattaaaagaaacatctaaaataacaaattaatttcattaaatctagcattgagtatattttgataatatgtttcttttgtattgaaaatactacaatatttttctactataaacttaatcaaacttaaataagtttgactagaaaaaagtcaacaacttataatataaaacggatggagtatattgcaactattaagaatgtggtactactatatattatccttgcaaaatctacgtccgttgcagaggccaattaactcgccgattctttccacaaatccagtatcagctggaaagaaagagtggcaaggtgcaaattgttaccaaccctgtcaagaccaggccgaagagctcaagatagcgacggcccaacactcgtataattgggccggactgggttgcgtaagagagtggctagcctgtgtatataaaggcctaaccttatgggaatcggtatcgaaaaacattgtactgaaacctctctataattcaaatcccatcatcctcctcctaatcctttgttctttctatcctgaactcttccattcttcctgtctccctctctcgctcttgctcaccaactgttcgacagaaatcccaggaagagttcgtaacaaatttggtatcagagcagtcgaatctggattatctagagaagccacggtatcattcgcgagcgcaactcaaggcgaacgagatggagcagcaacttggcgagctgatgactacgatgacttcaattcagaagcagaacgaggctatcatgatttcggtggaatccatcgaggaaatcaagccgatggttgtggagctagcgggatggaagccgacggtagagaaggtggtggcggaattgcgggacgaggtgggcgacatccgcgctcagctcgagaagatggtgaagcagcccgcgccgtccccaaatcaagtcaagtcggagtccgtcaagccggatcccgtcaagccggaggaaatggctccacgtcttccgacgccgcttggggcaaagcggctgccgaagaggacggtggaaaaccgaccttccacgtcggcgttcggcaaaggagcgcctaggcaattttgccaccacgaggcttcgaatcaccgggggaaggctgtgtggggaaacaactccccacgaactcccccggtcaagggtgcgtataactctacttcccctttccattcagttcctgagtcgagtgggggatgccgtgggtttagttttgggggtcaaatttctgcatctagagtagagtgcccagagtttgcaggggaaaatcctaaggcctggaaactgaagtgtgagacttattttgggctgtgtggaactccttctgatcactggattggtgtggcgatactccagttctcgggtactgcattgacttggttgcagtcgacccgagctcatgaagttagtgggagttgggaggaattcgctgcctgggtgtgtgggaaatttggtagagaggagttccaaagtttgattcgacagttcaataggttaaggcaaactagcactgtgtgggcatatgcagaaaagttcaacgagttgatgcatgggttacatgcgcatcatccctcgtggaattcggttttctttgttactcagttcatggatgggttgaaggcagaagtgagatctgctgttgttttacattgcccaaccgatttggatactgccgtggaattagcttgtttgcaagaggaagtactggaacagaatcgcaaggaggggcgtcgctttgagccgactgggggagcccgaggacccttgcacactggtgttggaccttttgtgccaaagggagatgataagctaactactgaagtttctgctactgataaagttgcagctctcagggctttccatcgagcgaaggggctttgtcacacttgcggggaaaagtggagtcgtgatcatcgttgtggccctactgtgcagctgcatgtgattgaagaagtgctacagcttttttctgatgaggttcctgaggaagtggagtcatctactagccccctgctgaatcagatgatggtgagttattggccatttctcgagaagctgtacttggtattgagtcttctcgtatggtgcgtttgtaaggattgatccaacgacatgaggtcttgatgttggttaattcaggaagctctcacagctttatcagtgagaagttagctaataaactgcagggtgtgcgcagctcgctgactcctctgaaggtgaaaatcgcggatggtggtatcttgcaatgttgtcaggagtttcctaattgtcattggtgggtacaaggggagtccttcagcactaatcttaaggtgttaccgttgggctgttatgaggtcattctgggcatggattggttagagaaacacagtccaatgcaaattgattggaagcttaagaccatacaatttgtgttggacagcaggcaggttctgttacagggtgtggtgccggatgttagctgttgcccggttatttcggctgatcaacttaagggtctcttccatcataatgcagtcctacacacagttgaactttgtgccagtgaagctgttgcaatcagtcttgttctgccaagagaagtggagggattgcttcaggaatttgccaaggtttttgatgaaccctctggcttgccaccaccaagagcttttgaccactctattcccttgctgcctggagcccaaccagtaaatttgagaccgtatcgttacagtccggcacaaaaggatgagattgaacgacaggttgctgacatgctcaaacaaggagtgatacaacgcagtgccagtcctttctcctctcccgtgttgcttgtgcagaagaaggatggtacttggcgattttgcattgattatagacatcttaatgctatcactgttaagaatcggtaccctctgcctattatagatgagttacttgatgagttggcacgagcttgttggtttacgagtttggatttgcgagccggttatcaccagattcgtatgaagccagaagacgaacataaaaccgctttcaagacacataatggccattacgagttccgggttatgtcttacggattgaccggcgcaccagcaacgtttcaaggtataatgaatacaatctttgagccattcttgcgtaaaggtgtgttagtcttcattgatgacattttgatctatactcggactttggaggaacatgtgcgcttgttaagggctgtatttgatattctctctgccaatcagttgcaagttaagagatctaagtgtgtgtttgctcggtcatctctcacttatttgggacatgtcatcagtgctgaaggggtgtcaaccgatgctaagaacattcaggcagtactgcagtggccggtgccttctaatgtcaaggaggtcagaggatttcttgggttagcggggtattaccgcaaatttgttcgccattttgggattctgagtcgccccctgactaattttctcaagaagaatgttattttccattggactgctgaaactcaagcttcttttgatgccctaaagactgccttgacttcagctccagttctcgcattgccggatttctcaaagacatttgaaattgagacagatgcttcagctgtgggtgttggtgctgtacttatgcaggagggacatcctttggcatttttaagcaaagcgcttggtcctcgcaatcgtggcttgtcgacttatgagaaggaatgcttggcgattctcctagcaattgatcattggcgctcgtatctgcagggtgctgagtttgtgattcgaactgatcaacgtagtctcattcatctcggagatcaaaaattagccacaccttggcagcaaaaagccttaaccaagttgatgggactgcagtatcgtttggtttacaagaaaggtagtgagaacagcgccgctgatgcgttgtcccgacgagtggccgatgattcaacagaagtattgtctctttcagtttgtattccagcttggcttgaggaagttcaaaaggggtatgatcaagatcctcattcttctcagctggtggctcaactgacactcaaatctgacgcattacctcatttttccttggaatctggtattttgcgctataaggggtgagtttggattggtgctaacccgcacgtgcagtctcaaatcttacaatctttacatgttggggcagtgggtggacattcaggggtacaggttacctactcccgtgtcaagcgtttgtttgcttggacagggctcaggaaagcagtaaagacatatgtggccaattgcactgtttgtcaacaagcgaaaacagaacgggttcgctaccctggccttttgcagtcgcttcctgttccggatcatgcatggcaaatggtatccttggattttattgaaggtctgccgacttcctcgggttttgattgcattatggtggtcgttgataagttctctaaatatgcccattttgtgcctttagctcatccattctcagcttttgatgtggcacaagcttatctctctaacatttataagctccatggactgcctcagtctttgatctcagatcatgaccggatctttacaagcactctatggaccactttgtttaaattggcagacactcagctgtgtatgagtacggcctatcatcctcagactgacgggcagactgtacgcgtcaatcagtgtttggaaacattcttgcggtgctttgtgcatgcttgccctaagaaatggtctcaatggttggctcttgcggaattttggtataacacctctctgcactcagctttgggaacttctccttttgaggtattgtatggccatcctcctcggcactttggtattgttgatatcgcagcctgtgcagtgccggatttgcaagaatggttgaaggaatgcactgttattacttcgttgttgcatcaacatctccaccgcgctcgccagcgcatgaaacatcaagcagacaagaagcgtttggagcggcagtttgctgtcggagactgggtgtttatgaaagtgcaacctcatgcgcaatcctcggtggcggtgcgagttaatcagaagttggcctttcgattttttggtccctttcaggtgactgctcgggtgggggcggtggcttatcggttggcgctgcctgcttcttctatgattcacccggtggtgcatgtgtcccaacttcggaaggcatcggaaccagcttcttctacggtagctaccctacctccagcggtggaagaagcagatcctgttccagtgcgagtgctagcacgcagactgatacgtcggggatcagcggctgttgatcaagtcaaggtttgctggtcgggctgtccaacatcggaggcaacctgggaagatctggagcggctcaaggagcgttaccctgctgctccggcttggggacaagccggatgtgaaggaggggaggatgttaccaaccctgtcaagaccaggccgaagagctcaagacagcgacagcccaacactcgtataattgggccagactgggttgcgtaagagagtggctagcatgtgtatataaaggcctagccttatgggaatcggtatcgaaaaacattgtactgaaacctctctataattcaaatcccatcctcctcctaatcctttgttctttatgtcctgaactcttctattcttcctgtctccctctctcgctcttgctcaccaattgttcgacagaaatcccaggaagagttcgtaacacaaatcctaatcacgatacactagcgttatacaattaccacaatctcctactaattcatacagatgaacaaaagaaggccgacgccgtttgccaaactagaattactttagtacgataaagccacatacgcttttgtatactctggcttttgtatactctttgctcccgtaattttgacaaattgacccgtctataaaacttatttccaaaataagccgcgtcaaaaactaattttaaaattaggccgacctcagcgttaaccccaatggtgctgagataaaacgtaccagcgccaccctaagagcaagtccaataataggctataagtcagctgcaaacatattttaaggaaataaatgatgagagagaagagcagcgggctacagatttgtagccagctgtagcacggacttcaatacacaatgtgtgtatgacaggtgggaccaggtattaatagtataatatataactattatacgaatgagctattagattggctatagatgaattgaagctagtagttggctatactattaaacttgctctaattggcactaatatcacgttcaacgtggcacggattagccacaaaagaggagctcagcgtcatgtgtgctggcgctgatatttacatggtttaaaagaatgtgtgctggaagtgtcataacgcagaagctagctcagtggtcaggcccctctactccagcccacaggttcacagttcgaaccgggaaagccggttttcaggttttttcttacttcctctttgaatcttgttctattgaaattttttttccaaacaatcacatattttgtttgtagatttatttttatgttactttttaaggggattatttattttattttatgttcaatctggaataaataaatttgaaaacattaattaaaatgttaaatacttagctcaattattataattttgtatttttaattttatgttgtatgatttaggttctcagttcttaccaagaaacgaaccctggaactctggcttgcagccacactgaccaaccgctgagctagatttaacttgtgtcagttattgcccacactaattttaaaccttctaagaggtcagcgctaactcatttggcgcttagcccgtggctaatatgttccacgtcggatatgaccttagcgccaacaatgctggcgcttggacgttttagcttagctcagcgccaaccctaatggcgctaaggtcacggcctagtattgaaattaatttttgacccgacttattttgaaactaagttttatagaagggtcaatttgtcaaaattacggctctttgctctctctacttacagtcagaagttctgccctacaagttgattagcactgtgtttcttatatgcaggagcaagccaacattggtcctctaatttatgagatggcggtggcgcaggcagcatgagcaaatagcgacacgaaaataacggacacaatcacgacaaagtggcacaactgcaaagccgaacagagggaaaatggaaaaagaaagagagaaagaatccaaagcccatgagcccaaatagcgtaaagtgctgcggacggcggagtgcggagagcggaaagcccttgcgcctccaccaccgcgcctcttgctcggccgtcaactggtggccgcggtgtcaaggtgcggggggcgaaagggaggcctggtccgcctcggcggtcgggctcctcctcttccccggcgcgatcagaaggccggtgcctcccccaagcgcggaggccagcaggccgccactctggttgtctcgtctgttcgaaccgaaattggtgcgctcccttgtcaaacggcaatctccattgttttgcttggtgtgttagtggttgtgtgcataatctaggtttgaattctttttttaagtctaattgtactggtatggttaactccatagtcaaattatcaccattggtaaactaaactgtcttttgcaaagctagagaatttggagccaaagacaatagcattt

SEQ ID NO: 16712 - DNA, 13408 bp, Oryza sativa
gatttcaccagcattttgatagggtcaattataaatggcaattttgacttgggaggaaaacttgggagtgtgacaaacctaccccccttaaaggatatctcggccccgagattcggtgtaactggtcaagaggtacggatgggcggccttcaactcatcttccctttcccaggttgcttcctcttctgaatgatgactccactgaacacggcaaaacctggtgaccttgtttctggttctcctttcgctagtgtcaagtatgcgaaccggcttctccacatatgttaggtcctcttggatatcaatgtgttccgaattagcctgttcttcaggtacccttaaacacttctttaattgggacacatggaacacgtcatggatgccgatcatagtggatggaagttctagctgataggcaacttctccccttcgttccaaaattttgtacggtcccacgaagcgtggtgccaacttgccttttgtctgaaagcggtgtactccccggagcggggtgacacgaagatacacgtaatctccggcctcaaaagttagctcccttcgacggttatccgcgtagctcttctgtcgagactgagcaatcctcaatctctccctgatgattctgactttctcttctgcttccgctaatacttttgttccgaacagctgacgttcgcctgtctgatcccagaagagaggtgtgcggcacttccggccgtatagagcttcaaacggtgccatctgtagactggcctggtagctgttgttatacgagaattccgcatatggtaagcttttgtcccaagctccaccaaaatcaagagcgcaagctctcaacatatcttccaagatttgattgactcgctctgtctgaccatcagtttgcgggtgataggccgtgctgaaatttaaacgggtccccatttcttcctgcagcttctgccagaactttgaggtgaactgactacctcggtcggagactatcttcttgggtaccccatgcaaacacatgatccttgcgaggtacaattctgccaatctctttcccgtataggtggtatgtactggtataaagtgagccaccttggtgagtcgatccacgactacccagattgaatcatgtcccgatgatgtccggggcagtcctgtgataaagtccattccaatctcctcccatttccattccgggatttggagaggttggagtaaacctgctggtctttggtgctctgctttcactcgttggcaaacatcgcagagtgcgacgaattcagctatttctctcctcatgctgacccaccaaaacttttctttgaggtcttgatacattttagtgctgcctggatgaatggagtactgggtctgatgagcttcggtgagtatcagatccttcaattccttgtcgtccggtacgcacaatctttctcccatccagattgtgccatgctcatcctcaaggaaatcccgagcctttccgactctcatgttctttttcaattctgctatttccggatcatttacttgagcggctctgacttgatccacgagcgtaggccgtgcctccaaagcggctacaaacccgtgttcaacaattcccatgttgagatgttcaaattcctgccgcagttcctcacacatgccctcgatgcatagggcagtgcagtaacttttccggcttaaagcgtctgccaccacattggctttacccgggtggtagtgaatactcatgtcatagtctttgattagttccaaccatcttcgttgtcgaaggtttagatccggttgggtgaagatgtatttcagactcttatggtccgtatatacttcgcagcggtttccaatcagataatgcctccagatcttcaaagcatgaaccactgctgccaattccaagtcatgagttggataatttccttcgtgtggacgcaactgccgcgaggcatacgcaaccactctgccctcttgcattaggacacatccaagtccgtgacgggatgcattacaatagacttggaagtctttcgtcgggtcgggcagaatcaatactggtgcggatactaatttctttttgagctcctcaaagctcttatcgcactcagctgtccatttaaacttctcatccttcttaagcaactgagtcatgggtcgggcgattctggagaagttttcgatgaatcggcggtaataacctgccagtcctagaaaactccgaatctgcgacacggtctttggtggggtccattttgtaactgactccacgttcgatggatcaactgctacaccctgggctgtaatgacatggcccagaaatttgacttccgtcaaccagaagtcacacttgctgaacttggcgtatagctggtgctccttcaacttctcgagtaccagacggagatgttgttcatgttcttcctcggactttgaatagataagaatgtcgtcgatgaataccacaacaaacttgtccagaaatttcatgaacactttgttcatcagattcatgaagaatgcgggtgcgttggtaagtccgaaagacataaccgtgcactcatatagcccgtaccgagtggtgaaggccgtcttcggaatatcctcttcccggattctcagctggtggtagcctgatcgcaggtctatcttagagaacactttagctcctttcagttgatcaaataaatcgtcgattcgcggtaagggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccatcctgtatggtctcttgtaaattggagcggttcccggtgccaagtcaatccggaattcaatctccctcttgggtggcatggtagtgaggttttcggggaacacttccggatactcgcagactatgggtatatcttccaattttctcaagttcttccccacggtgtccactgggatttccgtttcaatctgattcaacgaggctcctttctttggcgagactagggatttgtacaccacggtttctcctttctcattggtcagggtgactgtgcgattcgcacaatcgatgactcccttaaacttggtcagccaatccatcccaagaatgacatctaggtctttggattcgagaaggatgaggttggctagaaatggtgatctttggatttctattagcactgaagggctaaaactgactgaggttgaactatttcccggggtacgaaccctcattggtgtgctaagctcttctttccttagcccatacattcccacgaatttctttgaaatgaaagaatgcgttgcaccagaatcaaaaagtactgttgcagggattgagttaacagggaacgtacccagtacgacctctggtgctgcttgtgcctcctccgcagacgcgtggttgacacgagcctggataaaccttggcccggcacgcctgggcttcgggcatttgtcagcgaagtggccaagctcgccacagttgaagcaggaccctggttttgctcccgtctccttcttggcttgcgcgggctgggctgactgtgccggtgccattggtgggcgtggagctgcaccgcggttgggctggcctccctggtggttctgactgccactagtgccctggtggaagttgctggagttgaacgggcggtgctggcggacgatcatggtggtaggtccaccctgctgtccgggagtgaagcgcggtcggtgctgactgccttggttggaccggaactgcgccgcctttcttttcctgtccattttgttgcgctgatcctcctggcggattgccttgtcaaccagcctctcaaagtcggcgtagtccccagatatcagttggttggtcagctcatcatccagacccgccatgaacttctcctgcttctcggcgtcggtgcggacatcctctggtgcatatcgcgcgaggcgattgaactcatggaggtactctgtcacagtcctgttgccctgatggagcgcacggaattccctcttcttttgtgccacgaccccatctggcacctgtgccttcctgaagctacggcagaactctgcccatgtgacttcagtacccggtgggcgggtggccatgtggttgtcccaccaagctgacgcaggaccctgaagctggtgtgtggcgaaagcgaccttctcctggtcattgcactgcaggagattcagcttcttctctatcgcatggagccagtcatttgcctccatagggttggtggtgctggagaaggtgggtggcctgacacgtagaaactcaggcaacttggactgggggggagggggaccaactgctggtgctgctgttcggcgtgctgcatcatcctctgatgcatctgctgcatcatggctgccatcatctgagtctgatgtgccataacttgggcaagcgtcggattctcgggaagtggtggcggaccattgccagaatcaccgttggggtgcacaccatcagcgcgttcttcgccgttgctgccctcgcctgttgcgcggctaccagtcctggtgtagaccatctggagggaagagcagacggggaaaagaagaaaaacagatgctcaagaactaagctttattacaaaggaattaaaactgtaattgttctgatctgaattaaaacacttaaaaaggcaagcaaaaatccttattaagacagccatatcataggcacatgatatcgaccgtcgtctgaccccaaacaagcaacctacacacacaaactaacaaacaaaaactagacagtcgatgaactagtggaaaaacgagcctaatgctcggaacggctcctgcggtcggtggagtcgaaggcgtcctcctgctcgtcacccggtccctctaagcgactcctggagcctgacggatcggtctcgccgctgccgctgggagtagcagacagccaacctccggtaccactggctgaacctctggcggctgatgctggagcgaaggagagagtgaacgcgggagctggagctggagctgcaggaactgcgggcggaactggagctgctgcgggagctgctggtggaggtgggttcctgggcgcaagctggatgcgcacaggtgcagtcgtcctcttacggggcgtagtgcggatccggactcctcctggcgctggaaggcccttcaactgagcattctccttcttcaggcgcgctacctcgtccttcagagcgacgatcctcatgagcttcccatcgttcaaggccttggtcgccttgtgcaggtccgagtgcatcctatccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtagcctggccatcatcaagtaggctgcctcctgacaggcgtgatctgctgtgcctcctgacgcctccaccgccatgttagcgaggcaagtccccacgtagccatggacctccaagcggacacggtaaggaagctcgccactgagcggtgggatggtcgtgtactccggcgcgtcggggtagcccactaccagtgtcatgcgtgccagctctgccacaaagtcgatcatgccttctccgcggtggttgggtgggtgaccggccatctagagaagacaaaggagtaggatcaatgcatgctcaaatccaaatttaaataaagcaataaagactcaaataaaggaatcaaataagagcaaaattttatgcatagatcattttacatgagcgcgaataaataagacagactcacataacgataaaataatgggaaattagatacataataataataacgaacaaagcataaataccttgcaacccatgataccgagctaggaccgaatgcatttcacccatcaaatcccaactgactgacgaataaatcccaataattttactaaaaccctagactgactcgttttgaaaaactcactttaaacgagcgaccaagatttttcccttgaaccacaagaacagatccccattttcccggaacaaatccaattgcgaagaacatatgcaatgaaaaaggattcagagggctcttaggtttttccatttggcttgccctacggtcaaggtcggttctgataccaacttgtcacgcccagaaattcccgaatagaattccaagcagaatgtgcattaaaatccccgtccaggaccagccggggtacacaaacgacaatgttgacatacagatccacgtcttacaaacattgtaaaatcttacagaaatgcagcggaaaacaaaagataactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcatggatttaacaagggatagctaagcaggttcatttgcataaatactggcatttataaacaggaatttaatgcgaaaacagttgtaaaaattaaacagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacatcagagtggtggtattaaaccaacattatcatataaacctatagtctaggttttaaatgagatccccaatgtgtgctagttgaactaagcatggctaagcaagtcctagtccaaagtctaatcatgttataacccaagctaacaaaggagcatgatatccaaaagcatggctgtaacaataggtatccatcccatagtgatattataaaacagtgcaatatttgaaagaaaacaatggagcatttgcaatataggatcaacatgttcaagtgacaagcatgacttgccttgctctgctgctggaggtacctcggcgactatttcgaagtacaccggagcgtcgaaagaaccggaatctagcgacatacaaagcaaacattgcaaacaggctataagactactgaaacagagaacaaaaccatttttaatggattctacacatttttcttgatttactgagacttgaatgggcttaaacggagctcggatgatttagttatgaattttagaagattcactgtgtttattactataaaagaaatccttaaataatttattgcgcaatattaaccagggctgacgtcagcgagggggcgcggcgccgacaggcggggcccaccggtcagcgaccgggagagagagaaagagggtggcggcttgcgggcccaccggtcagcggcacgggaaaaggatggggcggcggcgccacgtggcgaccggaccgacggccccgatctacccaagggtagatcggacggcggcgcgggacctcgcggccggggcgcgcgggcgcggcgcgagacggcggcgaccatggcgccggcggcgcggcgctcacacggcggcggcgcacatgcggcagcggcgcaaagcgacgaccgacggcggcggagagcggcggctagaggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagatagggattagagagagagagatggaccatggcgatcgggatccatggccgaaggcggcggtagaggtggcgctcacccgtgcgcgtggagatgagggttccggcgacgaacctcgacggaggaggggtggacgaggtggacctcggccgcgcgaagctaatggcggcgacggcgtgagacggcggcgagcctagcggcggctagcggcggccggagtagcaaaagcggcggcggcgggtggttgcacggcgcgggagcgatggggagctcgggagaggtcggcgaaatggggaaaaagcgagagggggtgccggcgatgcttaaatagggggagagggaaccggacgtggccgggagcggcgggaatcgccggccgacgcgggggagtggggaggagagagaggcgggattcggttttcgaatcccggccatcttgggcgcgggcgcgagcgggagagggaggggaacgggcgcggggaatgcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgcggccggcccagtaagggaggggaaggaagggagaagtgggccgacggcccacttgacaaaaaggagggaaaagagaggaaaaagaaaaagaaaaggaaaaaggattttccctggaattaacaattgcactttagtgatttttaattggttaaaattatttctagagctctgaaaattccactaaaaatcctgttaatgaatttcgacatgtagaattcaagaaaaattccacatgtcagatccgattattatttgcattactttcttagggttttctcctgatttcaccagcattttcttagggtcaattataaattacaattttgacttgggaggaaaacttcggggtgtgacaatagtgtaatgataaactgtgggagccttatataccttgttatggacagctacatttctcaagttttaacaaattttgctaaacaaaaagccatggagaaagattacctaaaaaaaatatcaataacagggtatgatctactgaagaagtgaagctaaatttttgcagagaattaactttgtcctcagcattcttataaagtgaaagtttgcaaaattgcagggtatgtttgcattcatgaaaaatgtacgggtagtgaaatcattgagaagcttgactgcctcatgtagaaagctacacaaaccactacaatataatttggaaaagagaaacacagtggaaattattgtgctctattatacctcactgtaaatcctgctgcagaaagataattcttcttctcaactgcctcaagccctaacgacttaaactctgcaattttccttcgattcacagctttgtcctgataaagtgagccataaaaaatatcaaataaatgaaatccttgcagaatacatgggaaagatatatactaactgtaaagaaaatattgtgaatattccaggaaagatacatttgattactcaaacgtgacattttaagcactcatggtattctacaagtattcatcttcagcattgtcaattgactttgtcctctgagcattcttgtaaactgaaagtttgcaaaattatatactaaggatcactaaatcggctgaacatttctatagagagcacaatatatatcatcagctgcctactatttctcttgctgcattccctatcaaccttaattctcaacataattccttaatccatacaaccactccatacatcaactagcaacaaatccatccactagataagtcacaaatcttttcagagtgggaaaaaaggagatcaagaatcagacctgcttcttgatgtccaggctattgtcctcgaccttgccatctcccgcaatcggtgaatccgaagcgagaaggagagatggcaagcagcggtgactgagggcgggatggagagcgggaaggagagcggcggcggctgaagcgggatggagaccggcggcgaccgagggcgggatggacacagtcggcggccgaggacgggatggagaccggcggcgactgaagcgggatgaagaccggcggcgaccgagggcgggatggggggcggcggctgctggagatatgctactcctagatctctgccctagagccgcctcccggacctcgcgccgcctccaaaccctagcgccatgggagtcgaggaagacgagcgctgtctctgctcggggaaaaaaaaatcgtctcggagatgatttttctttacccgggggtttggcgtggatcgggcggagaattgcccccaccccggcccaggcgaacgcgtatatggcccacggaagaaaattacacccggccgggatggcacacggggatttcaggccattcccccccaaacccagcctaaaagaacaaggccttaagggacaagatctcggtccttggctgtgacaggcacgcagggggggagggatgaggaggaggagtaaatacctgaccccctttggctcctccgtttgcagcaacaaaagatcgccgattcgccgcgcgtacagcgcgatcgcggcacgtgtgcgccgttccgtatccaaatcccgtggattcgatcaatcgatcgatctctgcactgcacagctgcgcctgcagaatctcgcgacaccttgtacttccatttttttttcctctcctaaactgcatggtgacctcaccggcaactacagccacctgtgtatatatatagacgccccaccgtggtggtgatggatgtgaggttttgtgcggcgcgcttgctcagcgtatcgatcgatcccacgagagtctgcgagagagagagagagagagcacgtaggagaggttgagaagttgagatgtcgtcgatcggcgccggcgcaggaggagccgtggtgggggcggccgtggcggcggtggcggtgggcggcggggcgccgccgcacgtcctcgccgtggacgacagctcggtcgaccgcgccgtcatcgccggcatcctccggagctcccggtttcgtggtacatgtgtggttgatgcatatcagttttgttttttgttctgtttgtggttgctgctgttgaaaatgttgttttggacgtttttctggtgcagtgacggctgtggatagcgggaagagggccctggaactgctaggctcggtacgcctttgtttttttcctgaacttttggccttgttttgcatgtcaggttgcggtgatatgcagccgcaattttctcatgttcctttggctcgctcatcatcttgcaggaaccaaatgtgagcatgataatcacggactactggatgccggagatgacgggatacgagctcctgaagaaagtcaaggtatacatgcatgatcttagattgtcctgcagaaagcttaattactttgattaacaggagaatcaatctgacgacgcaaaatcatgaatcgtatatgcatgcaggagtcatccaagctgaagaagatccccgtggtgatcatgtcctcggagaatgtgccaacaagaatcagcaggtatttttatccgtttataatatctctattgattagagcattcttatgtcttatccatacagattaccgagcacttaaccattgttcttccatctttgctctgttcgattggtttattaaccagatgccttgaggaaggcgcggaggatttcttggtgaagcccgtccggccatccgacgtgtcgcggctcttcagccgcgtgctaccatgagcctcgccgccgccgctgccgactcaccggccagccggcggcgcagtcacgcacggcggcggacgcattgtttgtttcggagacttttgaaagagcaggagaaacggtgcaaccctgccttgatcacttgacgaatgaattctccattttttttctcgttggggtcgtcttcttgtctttgtgtaacttgttgcaagctagtattaagacagagggaactactgaactattgaacagagcatatggtctctgtttctctctttttttttctcctttttgttgctttcagtttcttgaagttaatttaaaggcggtgacaatggagttcctaacttgagcctaaatattttcctgtcagtcaagtcccgtttgtgatgtgtgtgtacgtgtatcgatgagcgtatgcaatacgtcgcgcgtacggtgggagccctggggggatcttgtccccgtcacaggccgttggtgttcttgtgcaaagcgtatccggcgatatcgttctcgttccagtacagactcggggcttgcagagccatgtgcgatgtgcccatgtcgtcgcagtaatgtacagtagatagtagcaacaagttctggtaattctggctggctcatccgctgtggtgatacggtccattaattcctgccatttcaagttcataaaaccatcggccagctggggattgggattcggcagcgtacttgccaaatgcaacctggattttgttcttcaggacatttaatactccctccgttctaaaaaaaactcaattcctgggtttctgttaggtccgtatctaacgtgttcgtcttatttgaaaaagttatgaaaaaaattaaaaagataagttatgcataaagtattattaatgttttatcatctaacaataatgaaaatactaatcataaaaaaagcattattaagtctttttaggacagagggagtaagtttgatgatgtcgattggcgaatccgctactgtttatttgccgctacacttcgtagtggcaggttcatttatactcggaataagatcactttgactccctcaactgaccaccgaatctaaatcgtatccctcaatcgcaatactagaaatctcgaccccctgaacttgcaaaaccggtgcaatttgactccctcaccggttttgggaggtggtttcgccgatgtagcgccatgtggcgcctatgtggtga

SEQ ID NO: 16713 - DNA, 4192 bp, Oryza sativa
ggccgaatgggaagaaggggagagaaagagagagaagggagatagggaggaggaagaggactgacatgtgggccccacatatcagtgggcccacatttctttttgtgccaatgactaatgggtcccacgcatattttgtaattctaatgccacgtaattgccacgttaacgccacgtggaccgaagactcggttaatatcgccacatagacgccacgtggcgccacgtcagcgaaaccacctcccaaaaccggcgagggagttaaattacaccggttttgcaagttcggggggtcgagatttctggtattgcggttgagggatacgatttagattcggtggtcagttgagggagtcaaagtaatcttattcctttatactgcaccgcagcaccacacttccttttcaagaatgcatccgaatttattacttattatcttgaaatttgtactcctgcatagcaatgcattgcaaaagtatgctccgctggatctttttatcacattgttttggaaggaagtactgtacctgattttctcccaaagcagattggtagatattcgaagaagtaccattttcttcagttcgtaggactttatatgcagtggatccggtgaatctggcccattctcacattttactgcaaggcgaaattactaaacaatgtgttctatacgaaaattttatatatagaaatttctttaaaatatcaattatataaatttattaagtttgtaataatcaaaatttaattaattatgtgccaataatagctttttcgttcttcatcagtttcaaacaccatctaattaggctaggccgatgggtattccgcattgtaattgtcccccttagtcaggccgtctttcggcccatttatctcccactcccccgcgtccgtccctaatattgggccgcgcacgtgcgaagtcattgccgggccaattttcacgggttaggcccatttaaggagagagatcctcctgcttctcccctcccgtgctcccctttcttcccctgcgccctcccaccgggagtccacacccctctcctcctcgcccgcaacctcccccttcgtgccggcctccgaccgagaaagcgcggcgtctccccagccacgcgctcgtctccggcgaccgccgcgccctctcctgcaggtacgtgcccctgcttcccccacgttcccctcccgtgcgccgtgcgccggggctctctcgggcttccgggccgagacggcggcggcggcggcggcggcggcgcgaattgtggcgcgcccgccctaccgtcctctcggtctccgcccgcttcgggacacccctgcggtgccgctgccaactagggagtagtttcacacgcttagttcgatccctaggggtttttggttttgatgcgttcaaacctagcgattcgattcctgtcggttttatttgcaattgggagaaactatccactttaattcagtctctgcggcccgcggggggtaggtgtgtgtggtggtagggattagttgccctgcagtaagttctgtatgtttgggtactttgagcactacagatctctagtgatcagcgtgaatctctaaataatggcctttatggctttgtcattaacgtgagatgcacatatgtcgtgcatatcttattgtgctgtttgtcagggatgttgcatttagctgtattttgcaaataatttgcagttgcagacttgcagtgaactactagtttctaaaacgtgaaacattcctcttctcttttctagttttgcagctttccactgtgtatatctggtttctactttttgtaaaataaaatggagaacactcagaatgagaacagcaaggaagccaagcaagatgacgagacccgccaaaacaagcaagatgatgaggtaattctggtgtgcctttagtaacaatctgaaacaggcaattttgcttaatctcattttagcacgatactttttcattgacaaaatcaatggatgttggctgcaattcaataagggagcaggttgatgtccataatttgtcattattataatggttgggttttttgcttcccatttttcaccatgatagccagagatactttgattacatgggggcataacacagcatggttctgacgcattgaaccacattatacttgtttactgtgaatctgaatctcgcaacttaacaactgaagttaccagcagaaattatgaatctgcaacacatatttgacttagctttacaaacaaaactgttctggttatattagtactcaacacacaagaaaactcccttacaaccaattcagttctagtttctttaacttgaggtatttgcgtaaaaagtgtactcttgattgcctgtgaaatggactcgtttgctgtttctagaactgtggcagatctagttgaagattgataatttgtaaactaccctgtacaattggtcgtctgcactttctagtgacgtgacttcagaaattctgctcactgatcctaaattttggctgtatgcaggaggctcgtcttgaagaatacaaaaaacttgttgatcaaaagactgccctccgccggagcaacctaaactctgaaaggcctggtactaagttgcattcagtataatgacttcatagtggtcatggtgaatattagtgactaatttgaatatttataattttttgctaaagtgagattgttgtggatgaggaatttttgtagtgattttggagtcttagctacgaaaataacctcaaaagctactcaatgacttcattttaattcattgtttgtcttttttactcaaatttaccactctcgtaatccttggttctcttgcgttggaatggatggttaatatttatgccgttgaggttaatgaaattttgagttatattcagtcagaaaaatgtttgagttcttgattagataatttctaatggtgataagtcataaccacatttttctagcactattatgatatggtgattctctaatttcagatgcaaattacttgaggactcttgactccagtattaagcgaaatacaacagttataaagaaactcaaaacaataaatgatgaacagaaggatggattgatggatgagttgaaaagtgtgaacttgagcaaatttgtcagcgaggcagtttcttatatttgtgaggccaaacttcgttctgctgatatacaagctgctgttcaggtaattgagttcgaataacttgtgtggtcttagtgtgtttgcaaaagtgcctatataaggaaccatccgacctgtacttgagcaaggtcttttgttcaatgcaattgactatttagtttctaggttgcataatgaagcattttccattgcctagtgatgctctttacatgtgctgttacatgtatttcagttattatttggacttattgcatcatgctttactgcaatttgcttgttttgagttttctttgataaagacttgaacttccaaaagtgtcacttctatctggaattgtgtaatataataactattgtgtcaatgtaatttaggtttgctccttacttcatcaaagatacaaggatttctctccttgtcttacacaagggctactaaaggtattctttcctgggaaatctggagaagatttggacgcagacaaaaactcaagagctatgaagaagagaagcacactgaaacttctaattgaactgtattttgttgggattgttgaagatgctagtatatttgtaaacattataaaagatcttacatcattagaacacttgaaggaccgggaaacaactcaggcaaatttgtctcttctttctgcctttgctcgtcaagggagatttttcatagggttacagtctcatggtcaagaagcttatgatgaggtaagagaaatttaagcatacttattaaatcatgagacttcattaggaagagagatctactctttacttgttgaacggaaatcattcaactggttttgtttctgaatatgtgcacatacatttttcagcttttagaaatgtataaaatatcgaatttggctagttcaccactaaggatagatagacccataaggtttaattttgttattataaaaagaaaatggtggggaacttcaattcaggaagtgcctaggctataattgactcgttgtgcccaagggcttaagcatgggaaggatctgtatgtataaaatgatcctacctg

SEQ ID NO: 16714 - DNA, 11015 bp, Oryza sativa
tatgatgctgtagctgaactactccaatcagaacatgcggtaactgctctcttatatatactagttttgccttcttttgtcatcattttttttactttcctctgatatcttttatgaatacgtcccaactatgcactatccccagtctcttcgtctgatggaggcagagaatgcaaaagttttaactgccaaaggtgaactaagcgacgagaacactgcttcgtatgaaaaactccggaagtcttttgatcatttacaacgtggtgtatcctcgtgagtatacatttgagagtgttatctttaatttatttgtatatggttccgtaacagcataagctaccatttatccagttctcgcatctggtcttctgttagggagcttatagttgcatagtattgcaggacatgtgctgccctggaatttaccattttaatttcctctaatttgttatctttattacaatgcaatcatggtgttcttctgtaccacacacactgtaacatagtttatcatatgaatatacatacacatgaatgaggagtataccatgcctaagtgcagctgggatacaacatgtaccagacattcctggcccttctcaaatttcagtataaaaacaatatgtaacttagaggatttccttttgatcatgtaaatcgaattttactgttttgatcgaacttcaaaacattgtttccttcctactaagcaaaagatttacaaagtgatatagaagacatctttctacctattttatcctataatatgttttcatgtttgtgattgcaaaagaccacagatatttagttaattcacagccgcacattctggggaaaaagatctgctcaatgacattgcaaatggttaaattgtaaattttgcatccaatgtgaggatggcaagttgggaccagtgtccacattcagtgatacatcaatgttaatttccaacacgtgatctttgtagtgttactgttcaatgccattaaattttggtagataaatataactattttgccatgtgttgactaactgttggcacttatcttttgatgatgttaacattatcatctagttgcatgtattttgtgtgtggtttttgccaatctttaacctttcttttgcaggttagctgaagctcttgacatgcagccccccgtgatgccagatgatggaaacacaactagagttactacaggaagtgatgtagccccgtctactgcaaaagaaccgtctgcactggaacctatttgggatgatgaggatacaaaagctttttatgaatctttacctgatctcaggtttcccttcatatcttcactgttatcttctctcactagttagttgttggggaactacattaacctatatgccttaatttcgagcagagcatttgtgcccgctgtgttattgggagaggctgaaccaaagttgaatgagaagggtcgtgaacaatctgtaagaacacaatgtctccaaacttagtactttttttctgtgtaaactggttttttagatatcaatatatcactgcatgacaatttggttgtcacttatgtttccttgggtactcttttttagtggcacgaggcatccagagtatctccattttgctcatttcttctgtgtatcaaagttcagaccttttcagtctcttagatatggctgacgattctgtttaaattcaaatagtgtatgtagattgattcaagctaaatatttgtgcagtgttttaattcccaattgatgttaatcaaatatgtgatgttatatggagatgtttgacagagcatgatccaatgaatgctttccatttccttgtttacaattttgattgataaagtgttccaatacattttcatatcttatacacaagattgtttctgtgtccttgttgtatgtttgtggattgggagaggaaaagagagaagatggaatgtgttcattgcttttttaaatgtgcattttcttacttttttttgtatcatttcccttttgtatgtcattgtgtcatgtcctgccctaaaccattgttgcatgttcttttgaaggaacccgtcgcagaacaagatactgacgtacatgacaatcctcaaacttcttccatcactgaatatcatctggaaggaaaggcagatgatggagtgaaggatagtgaagaaaaagataaagataagggaaaaggtgtagacaaggaaaaatctaaagagaaggattttgacagaaaaactgaaagagagaaggagaaaataagagctgtggatggtgcaagtttagacaacctccttcagaggctgccaggatgtgttagccgtgatcttattgaccaattgacggtattaactcaaattgtattatcgatccacttcatgtttaacaccaattatcattcataacttacttttggttccaggttgagttttgctacctaaattctaaagcaagtcgaaagaaactcgtgcggacgttattcaatgttccaaggacttcactggaacttttgccttactattctcggttggtggctacactttcaacatgtatgaaagatgttccaagtatgcttctttctatgcttgaagaggagttcaacttcttaataaataagaaggtatgctgacattaactattttcttccctttgcattatttgtgctcatttcatgttccttctcaaaaagattctttttttattatttttcgaaagaaaattcttgtttttttcttttgtgatatctggtatgccctctgttttcttttacttattgtttaggacattgttacagtctctaatgtacatgtttgatcatcgccttctctaatcgtatactcattgtaaaacaataactatgtttaaaaaatcatgacatttactaatgacatagttcacatatgaaatctttatattattatagcatatgcgagtgacttaagatttcaaggtttgtctgcatgaattctaaaacaatatatatttaataatggagggactatatatcattagctctccgatctatattaggctattaacatcaatgtaagcaaagacaatcatggaccagatgttctgcatcttccccacatataatccaaacagactaggaaatgttaagtttaagggacgcaagattttcttttctcccctttgatagttaccgtgactaactattcctcgctgttttgttattttttcaggatcagatcaacattgaaacaaaaataaaaaacattaggtttattggggagttgtgcaaattcaaaattgcacctgcagctcttgtttttagctgcttgaaggtattcatatcttgtgcattgatttggaactttatagctctgctgcatttccacttgctttgtgtactcatatcttacatattttgcagtcctgcctagatgatttcagtcatcataacattgatgtggcctgcaatctactcgagacttgtggacgttttttgtatcgttcacctgaaactactattcgtatggctaacatgttggagatactgatgcgattgaaaaatgtgaagaatttggatccccgccacagtacacttgtagaaaatgcctattacctttgtaaaccacctgaaagatctgctcgagtttcaaaagttcggccacctctgcatcaagtaaaatttctgtcttctttgatcgtttctttgattattttcactgaatttatctacagagtatagtgtagtagtgattatttcatcgtctttttcttcctctgcagtacatacggaaattgcttttctccgatcttgataaatcaagtgttgaacatgttcttcgccaattacgcaagctaccttgggtggagtgccaacaataccttataaagtgttttctaaaggttcacaagggaaaatacagccatgttcatctgattgcccttctaactgctggtcttagtcgccatcatgatgactttgctgtttcagtggtagatgaggttagttcctttgttcaaggtattagctcatgttgtttttgatccaaaggggcatgtctgattgtaataatttacctttgtttctgaacaaaatctttgtgtttggaatgtttgagaaatagctacgccaccaaaattctatccacaagctctcttttttgcaagtcagctagtagaaataaattgtaacaaagtggcagttttcagtttttttgtggatcatgtccaagtggtttactttattctctatttcaattcaggttttagaggagacaagggtagggctggagctgaatgactatggaatgcaacaaaggcgtctcgcccacatgagattccttggagagctatacagctacaagcatattgattcatcagttgtattcgagactctgtaccttatcatcgtatttggtcatggaactcctgaggtaaacgagtatatcctttagcaaagattggaaacttttttatatcttcatttaactttatggcactattccttatttctgttgatatgttcagatgcaggctcagactctgtaattttcaaaaaagaaaaccacatggctctaagattgctgttttgaaacaattaaattgctatactagaacattgtttcgtgctctgatcctttctctttgctcagtacaacacatgagcaacttcatcaaaagttaatcatgctgtgcctggctttagtgttatgtaacttgtttgctgtatttgtgtgcatattacacactccaaattatacagaacatcagcatatttcttagagtgaaaagcctggattttgtggcattaacattgatcttcttactcatgtcctttttaatacttattgcaagctgattttaagaaagatctaacaaatctttctgtcattgtattcagttgagtaatcttcttttttttttatcccagcaagatgtgttggatccaccagaagattgcttcaggatcaggttaatcattacacttctgcagacttgtggccactatttcaacagaggctcttcaaaaagaaagcttgacaagttcttgctgcattttcaaagatatattattagtaaagggcccttaccacttgacatagaatttgacgttcaggttagtttttctcattatacaccttgccaatgttcataagtacattttagtactctttatcatgtgaacagcctgatgacaacccaacatgcatatatactttgtgaaacttctccattagagatgctgggttactaagtaaaaaaaacacgagtgtcatatgtgtgcagtcaaactgctgttgtttgtagccaagaatagttatctagtggtttcggattctggttatgaacttatgaggggaaaaaacccaacaagatgggtcaaatgactgcataagctttctattgattacttcatcatatttctgaggcatgttgatattcgggtattgccaaatatgggtatttggtttgtaaccaaatgaactttacaaaaaaatagcattatgaaatttggtaagcaaatggacctgtaatcctttcttttcttgagaaactagggggaccagaatagaaaagaaaattgggttttactcctatcgacctgtttgttttgctaaataggagaagctaagtcaacaatacttttcttgctaacaagaaacattaaacagtaaaatagaacaaggagtatcttgtcttgagccttgacttctgtagggtcactgtgcaaaaactacgtactttacaagtgaaacaatgaaatatcttagaacattgtaacttcgtaaccagtcaatattgttatgttttgtgcttaatcctaccattgttattatgtttgtacaacgagtcaaaaggaaatcgacaggattagtttcatgcatttgaattttggaatatattactctctactggagctgtagatatatggcttatgattacttgattttttttgttggcgttcattacattgatgatgccgaaaatatattttgccatgtgttcttgcaggatttgtttgctgagctaagacccaacatggctaggtattcatcagtagaagaactggatgctgcattacttgagctcgaagaaagtgagcgtgcagcctcagttgagaagcctgaaaatgaaaagctctcagacagcgaatctcagaaggtgcagccacatgatactgccttttctgctaacggcaggagctcagcaaatggagccgaggaaaatggcaaggatcatgaaggagctgacagtgaaagttattcagatagtggcagcattgatggtcatgaagacgaggaagatcttatgttcgaggataaatcaaatgacgcatctgagaatgaaggtgatgatgaggatgatggcattcctgctggttctgatgaagatgaaggtgttgaggttagacataaagtcgtgcaagttgatcctaaggagctagaagactttgatcgggagctgaaagcccttcttcaggagagcttggagtcacgtaaatcagaggtacggcccagggccactttgaacatgatggtaccaatgaatgtccttgagggttctaaggacccaagggctgtcgagtccgagagtggagaagaaactgtggatgaagagggtggtagtgctgggggtggcagcaaggtgcgtgttaaggtgctaatgaagaaagggcacaagcagcaaacaaaacagatgttcgttcctggtgactgctcacttgtgcaaagcacaaagcagcaagaggctgctgagcttgaggagaagcagagtattaagcgcaggatcctggaatacaatgaaagggagaaagaagaaatgaatggtggatcgtcacagatgggaaattggggtcaaggaggaagcaacaccggcagcagtatcagatcaggtggacggggcatttgggatggttcgatcagaggaggtcggcagcggcaccacattgctggtggtttctaccatagttatggaaggagacgatgaatgctacttgtcctaaggtttttgataggacgattgttttgaagggttttcttctaactgcctaaagccttgtttttgaaggggatttattatacatctagtgtggaattaattcccctcaattctcttcaatccctttcttatgaggattaactgaaaatcttgaagaggtaaaacaggcttatggaaaggtggttgacatgaagtaaaaacaagtttacgaaaagattaatgactagcactcaatataacctagtgcatcactgacaatggaggaaggaaagatgtcttctgatcagctaatgacttgatggttgcattggtcggaggctcggagcttaagtggggcacgttgatcccgttgtgcttttgtacataaggtgttcttgcatctcgagtgctgaataacatgttttagttgggaccttatcaccttaacagcctgtaatatgcttgtgcgtctacttgatgcaaaatacacatgtgctgattctgtcttaacgcggagctttgttaatagggagtatcttgcaaatagcatgtcacctaccgcaattattttgtaccagctcctatggaatatggacaaatccttgaagcccttgcattcatatcctcatcatggccacaaaggtattcttgccgttagtcgtcacaagttcccagaacagggtcctgtaaagacgcactcatctcatgcatagtacacactttcactactgacccaatctgcagcaggagctccgagtgatcgagccagccaacgaacaaacacaaaccttctgatatccagttcgttcctccagccagcttttcactcgggcacttcagcactaaggccttacctcagcttggtttcgtttcatcaccaatcatatgatctctgagctgtgagcaatccttcctctcctctcctctcctcgcgcgatgattgcttggcgactacgcgtgtctgccacgagatgcgctgctgctttacacggaataattacgccggagaaagcgaggttttgtgccctgaatggaccttcgcgcagtggacgcaaccaacttgtggtaattgcctccacggctgcagaattcgatccctttctatctagcgcttagatcaacagttgtgaaaatatcatcgtgttgtgagttgtgactcttgtgacaagacaatcgatggcaatatgcgtaataagagcctagttcaacgtatcatcaacacaacaatggtattttggacaactttctacgcccacagcttcgacaaacgccataatggatttatgctaaacaaagtttgaaaaaaaaatcggataaataagtgcaatttcctaaccctctaatatactccactgttcgtgctccaattaatccacttctatatttcatcgtttatagcttcatatacaatggcatcacacatggttatacatggtggtacactacctagcgcacaagacaccgggtagaatgtccatttctcgttgttgttttaggctacattaaatacaatattgctcaatttagaccattggtatgtgtatgaccctcaattttctgaattcgtcacggccaacgcatgcagctgattcagatcaatcaccaaattaatatgctagtgcaagcagtgagaaagcgagagaaaaaccaaaggcaaagatagagccgggtagccgtccatagttgcagccatgcaggagaatgcactactactaggagagaaatagtatctttggtgtggcacttggaatctccggcagagcgagttgcgattctgctcagtgctctcagccgccgtgtcgactcctccctggctcacacgaggaatctgaaccatgtcaccatgtgaaccgaaagccaaagctttgagagagagcctttgactcctggaagaatctgatttgtgcctgagagtgagaggaacaatgctaattagattctacgttgcgttagcttcctttattttttttcctcctttaaattcgtttttggggtgggtggattctgccttgtttggttggggtgcttgtttggtgctttctgctgctgccactagttattagtctctactagttctccagtatccagttggataaagatgcatctcgctttcaccttgatgtggaaaagcaaaggtttttagtgcctttcttcgtttgcaagctatcaaatctcttttacttgttatgtcctctgcttggattgatgcttgccgctgatattattttagtgctatacatgtatatcatcacagattgttctcactctttttttattgttctcactcttttttttattagctacggcctgaaatattttcagagcaatggcatgggaaactcttttcattctccaagggattttttgtgtgtcattcaaatgatcatcatagttttttcaaaaaaaaaaaagcatgatgatcaatatgagatatgtcctacaaacatgaaaaattcaaattcaacctatatatacaactagaaaaagaataacaaacttgactgtaatacctctccaataacttcttttgttgcaaaactaggtactactcaaaaaatcaaagaatttgcaacgagtgaaattaattttaatgagaaaaattgtataaatgaaccatgcatgaattttgtaagataaagctgaagtttgtggtggccaaacattctttgtatatatgatgtccccctaaagtgtccggactgtgcactgccaaagatctctatatgatgtactgcctctcagctgagaaccaatggaggtgaaaagggaagacacacattgcacatttacatgtgtctcttttgcacaagggttttgatttgatagatccattcaggtagggtcaagctcccacattgaaggggccaaccaaacacaatagtgccttctttttttcctcctttgtttcactggtctgtcatgtgtgtgttgtgcttgcttagtggtaaccagcactgaattgcaattgaggctgcagctagtgcaggtcgtatgtgcccgtactactgctatatctttcacacacaccattgcataatgaaagggagcttatgggctgttcagattgatgacattttcaatcatactattatttggtaaaattgataggcatatgaccacgtttagtttgttaccaaatattggcaatgtgtatagaattttgacaatattattaagccaatcataccaatttttttttgaaaatgttgccaatttgccaaattttggtaaggtttattttggcaccaatctgaacaaaccctatatattttttgggttggaaatacttgtgctatatatccatggatcgtcttaattaaaacctaggttgcaaaggctatatataagataataagaaatatacttgctagcacatggacaaaaagaaccctcttacctaatagcacaaggagtactttcaaacgtcggaataaagaaaacaatttcataacctaagtgtaacagcttttaagtgatctaaaaggctctctttcactatccaaaatctacttgttagataaaaatacggcaaagaagacgtcaccaagtgatttggtttaacccctgtggtgtgttaagttgagcatcgccatatgcgtgagagtatgaaaatgatgaccaaacttatactttagaccggaggaattaagaagcaaagactattacaatttcaacctgcaaaagcattaaagcactggatgctaattcgtacatgcatgtatgtgtgtgctttctcgcaagtcagatctcgtcggacatgacactacataaagtgtcgtgccaatgactcaatcgttacacattcgtacaaacatgtcaattattaaaagagagctgtctgcacgtttactatgataagtgacgactgacaaatgtaatgcagatatttaatcacacggaatttctgcatctgaaataaaacctttgtatgtggatctcataatttatattaaggtaattttaccatcctttataaagtacctcaaggtaccaaaaattttagtgtaaaatttagatacctcaagtaggagtacttaacacctccggttctaactttgaatcactgattcactggt

SEQ ID NO: 16715 - DNA, 20827 bp, Oryza sativa
  unsure (1)..(20827): unsure at all n locations
agtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgccgttcaagtcaaggcttagctccagttatcttttgttttccgctgcatttctgtaagattttacaatgtttgtaagacgtggatctgtatgtcaacattgtcgtttgtgtaccccggctggtcctggacggggattttaatgcacattctgcttggaattctattcgggaatttctgggcgtgacaactatcaccctttcaggatgcaacctttttaagtaaacatgctatacagtttgatctgacataacatgtccagcttctagcaatagagatacaagctttacatcaaaaaagcatgccttcaaaagataaaaatattatttttctgtggaatgatcgagtaggaaattatgtcttcaaacctgaggtttaaacaaaactaagtacacaaagtacttctggaactagtcaaaatctgaacatattattgatccccctcctcccattgcagactgtttatttgctgaaagattaaaagtatttatgcatgtagccaccttgaatgcctctaatttcatgtttaataatcttgtaaaacatatgcatattattatgttctcacacatagtttaaagtatagtaattctctccgtgtgtgtcagtgtgtttgatgtgtaattgtattattgcctgtgctcaagtttattttacctgttgcttaattagtttacatattagcaatcaccattgtctagtgtctaacacttgtttctttttggatgtgtagttacagggttccatggcccatttgctagctgtgcccattggaaggattgttttgcaagattcttagagactccttgaattgtgaaatgcgatggatgaaagataatttttccttaactgcttaattcatgtagctattatggttgcaggaaccaattttttctacagaattatcacttgtttgatcagacagagatatattattgagtttgattggacagagatttattaagttccaagaaccaatttttgtcttgctttgcacaatggcaattggaacttttattcttccagttagctcaatgagagagatctgatttgaacaaagctgttttcactgaattttgattgttgcaatagtgcagtgccccttcaatagaaattgtatgcgagtacgatgttaagagtggtcagttttagactgattttgaaagttagattctttgaaaacgaagagagatttttgtagtatcaatgttaagttggttcctagcatatctattggaaaacttgtgattattttggatgttttactgcttgtagaatttaatctatccaaaattatgattgtttaaaaattctggactatgtttagagtgcatatgttgtaattctacaattttatttttttggggatttttagaattattttccacgtttaatttttgttttgttttcatgatcaatttttttcttatcatttctagattattttgacgttcgtgacctttcttccagttttttttattttatccgaattttcaaaaatgttgtactcattctgaatttgaagtgtagtgaatggtagtgatcccttctaatcccacctctgtccaaacagagggatgagagggggggattcgcggggagggattgggtgtggggtgaggggacaacccaaaccccacgtgggaggcttttccctgggattaattcccacagctagcgaacaaagcctaaatgcgtgaaccccaccagtgattcatcagctaggagtatatgattcatgtttacatgtgccataaacgttttgctcgattcctagtgtgagagagagggagagagagaaatagctgccttttgctgtgttgccaagtgcaatctcgtgcatgcattgacagaaaagctaccaaccgtatcggcgtaatggcgcagaatactactactactactcttggttgtgcatttttggcgcgccatggggaagaactggattgctactagcgtccaggattaacctccacatggtggtggagccgcagctaaaaattttcggctcgcgccatttttctctcatgtccaacagcatagcagaaatgcaggatccaccgaacaagtacacgcataatggaacgcacaggaagccttcgctgggggcgaattaaagagtcaaatctatgtacagtgagcaacgtgtctgccttgacgaaatgtaatttcgatcttccgaaattcaataggcgaccgtagtagaatcgacttgcaaacaaaagaaaatccttacggttcaggacaggaacagtggtagtgtagtagtcctaggactctatgagtgaggggttgaattgatgaatgctagccctgcttgctgttgaagctcgtagatcgtcagagattggtgccggcctggggagcaaatcttatggatgcagacattggatgggtgcagagcactgtagcagcagcagaggcagggataagcgaggatcttgaccgcctgacaacacgcaacaaatctacacatctgtgactccctgagacaatggtcgacgccgacggtatatctactccggcattgccgtgtctcaggcatccggtgccccgtagtacgtttgattcttgatgcactggccagtttggattttatactctctccgtctctaaaaaaaagacaaaccctgatttccgtttgtaacattggatcatccgtcttatttaaaaaaattataaaaaaaattaaaaaaacaagtcacgcataaaatattaatcatgttttatcatctaacaataatgaaaatacgaattataaaaaaaaattatataagacggacagtcaaaattagacacggaaactcaaggtttatcctttttttttttttttgatagaggaagtagttgtttcagctcaccggcctgttagccagtagtatagcccagtaccgggtacaccgtacacgtgatgcggcacctgcagatttgcagctgcagctgttcgcggcgacaccttggacgccaggatgcaggtccgcgcaccgacgacgcacgcacattgcttcttttgctcatgagcggcggcgagcgtaagctagctaccgtcggctccaccgtgaaggagctgcgcgcgctcggccccggcggcgacggtggcgatggcgatatgcttcttttttcttgaagatagatggcgataggttggttcttgcctcgcctgcaaggctgcaacgcgctcgccggcgtgggggcggggagcacggccagtagcgcaaatggcggggaaaggccgaaacgtaagcacagttgggctgttggatccagttttcacggaccactcctaggatgaaagcccactggcgtatttttgtagatggaaaaagtgcactttgactccctttaataggccgaaatctagttcaccccttctcaaatcagaaaaccggatacaacgactccaagaggttttggagagcagttttgctaacgtggcactcacgcggtagtgttgacctctttgtcccacatggggcttatgtggtattagaattaaaaaaaaatatttcctccgtttcaggttataagatattttaactttggttaaagtcaatctgcttaaagtttaactaagtttgtagaaaaaaaataatattttcaaccaaagacaaatttattatgaaaatatattaaattattgatttaatgaaactaatttggttttacaaatattgctatatttgtctataaacttagtcaaatttaaaacagtttgattttgaccaaagtcaaaacatcttataacctgaaacggagggagtatatatgtgggacccatttgttattcacatacaaaaatatattgtgggacccattatcatccactctctccaacccttcttcctcatccctctctcccttatatatctctctcttttcttttccccttgggccgtggtggcagcaagcggaacgggatgttggagcgggccgtcgccgatgagcgtgatgtaggaggggcggcgagacgagtttgtacacgcgaggaagggcgccctcgccagctctgtttccacatccccagggccaagacgactaggccgtggcagagaccttctataagcccccgcagagccagatactctcggtccacagtcgcggctgccggaaccggctgtgcttcctggccagtggtagcgcccgcggcccgcctcgctgccctagccgtgctggtgcggctcagcatctcccacatcacgtgctcacctctgccgcaacctccagagacttaagaccataaaaaccaaaaacatcgtcagagttatacccacgtacgccgcctccaccccaccagaaccccctctcgtcgccttacatgtttggcgaacctcgaatcaggcagcgacgccgagccacgccctcctcaccagcagcaccacgtggtcccaccagtacgctgaatcgatatcgtctcctccccgtcgaccaccacgccagcctcgccttgcctcgcctcttctcccctcgattggggcctggtcatctcggcgtcccaaattcgtttcattgcccctcctccgtcgcgcccatctgcgatgccctgttcctcgccgccgctgctccagcacctgtcgtcccacccgctgccgccacagccgagaaaagaaaaggcaaaatttgctacagaacactcaaagattgtggtctttgctgtgagatacccgaagatcgtgtatttgctcgtggacactgtaaaaaagtggtaattggctgctggacactccttccattattttattatttttgatgaaaacggagagataaactttggttaaagacaagtttgcccatgggcccacttgtcattctcacgtatcctctctctcttcctcttcttccttgtgctgctatgtgtgccgccgctcgtgcccctcccgtcttcgtctccgattgtcgcggcaatggcaatggaggacaacgcggcatccgcggactgaatcgcctcggcgtcatagggatgttgcgtctgctggagctgcttgtacgttgccttcaccgccgacacgccataggatgctatcgccaggaccgcgtgcgcggcggctaggtggcgcggctaggtgagcgtcgtgcggtggcggtgcggctttgcaggcgtggcacggcgtgacgaccgggatacggcggtcgtggccaggcgtggcgcaggtgcaggctggcacggtaacgcggatatggaagcgacccgacgaggatggtaatgacgcagcccagcggtgtagtggccggccgaggggcggtggagcagcgcggaccggccgtgcggcggctgggtggtggcggggcatgcacgattccggccatccagcgggcagtgtggtgcggcatggcgcggtggccagatgcggcacggcgaccgggatgcagtggtcgcggctaaccgtgcgacgacgatgacggcgagggtgtcttcgacctcgtcttctcccctgacagccggctcatttgctncgtttcaatgagaggggatngggtctgttcaaaccagcgttacaagcaaaacggcacggnggcattttggtactttcaacgtcctttctctctccagttcagccaaaaattaataaaataatgggaggggtgtccagcagctaattaccatatttttacagtgtccacgagcaaatacacgatctttgagtgtctcacagcaaagaccataatctttgagtgtcctgtagcaaattttgccaaaagaagagagagagagataaggaagagagagaggaaggaagaagggttggagatagagagaggatgacagtgggtcccataatatattatttggcatttttgacatttcacacgatttctctctcctcttcaattggaagttattattttagtcggcacggtgtccactggcaaaataccacaattatggattgttttcctccaaaagttagtttttgcggtgtcctagggctaaaaccaggcacggtgtccactggcaaaataccacaattatggattgttttcctccaaaagttagtttttgcggtgtcctagggctaaaaccacacaatagcagtgccttgtagcaaaatttccttatatatttttgtgtgaatgataaataagtcccacatatatatttttttaattctaataccacacaagcaccacgtgggatgaagaccaggtcaacagctaagagagtcaaattgcattggttttaatagttcaggagtcatcctatctgataggatggggattgaatacgggaccttaagattgaaaccgcacaccttttaccactacactatcaattgcatctcgctagcgataggcaccaaaaaaaaaaactgatgtgttggattgatgctatagcccacaaatctgcaacaaagggagctgaacaacgccttgtttcctcttcgaaatttcggtaaagcccattgattttcagaccgaccaaaatagggcattcgaattcatttttttgcctacaaatattgttcagaatctatcggttttcgatcggacttcacgaaaatcgatgtgccactagcgtccggcatgaaaagtggtatcggaattgtaaacagtactccgaacctcccttcccccttcggtgagggggcggaggacttttttcgagtccaagtctatatgcgtagggggattccttgtgcgaatagacattgtcccccaatgtgatgttgcatgtccgattatattacgtgcatcaaaatccaataatataatcacacaacatgtatcaaattcgtcgatttagtgcgaaatggcgcgaatcgggatacttgccacaacgtttctaggccatgtttgagggagcttaagactttgagaatccgctggttggtagccaacttctgagaatctagagaagccgggttttctagcttctgggttctagttcattttccggattctacaactacagattcctagaatctgggtaaaatctggactgtttggggtcctaaagattctgtgagaagctataactgctagatgctccccaaacagacccccagtctgttagtgggtcgcatgaagcacaaatgagtcgcttcccattttcatgcctcgatattatattcggcctggctacgtggaaggaagctttgccgttaccatggatgagccattgccctatccaaggtttgtccgcactactagaaaagctatttttgcaggcggccaaaacacattttcgcatgtggccaaatactctgcctatagcaagatgtgaaaatcgtcgatttttgcagacggtcatgggtctgcctgcaaaagtcaatttttgcagaaggacccattaagaggaactcttgccaaaagaattgtgtgcaaaaagaaaaataaaaagcaatatattattcatggcatgcaaattcacattgaaagacacatccgtggtggaagttctcaaaaaatatgtggaagttcacgttcaaaatcacattcaaatccacacccgtatttttcatagcaagttggaagttctcaacaaaaaagaaaaaaaacatcaagttggacgttgtggtggtggtcatcgtcgtaggaaggatgccaccgtcgctgccgaggagccgatccggaagccggcttcctccaccatgatgacgaggaagacaaccatgagcaatgcgaggagggtgcgcccccgccacccatgcgtgtcgctgtcgctggatccacaactcacgtgtgtcgccgtcgccgaatcctcctcgccgcgcgtcgcctttaccatatttgctgcccacgcatgccatcgtcgctggatccccgcctcccaggtgcgttgccgtctattatcccgcgcgccacggccttggagagccaccgctgctcccttccccaccaccgccgccctcgccaccctcatcgccgaactaaggagaagagagggggttgggacttagaaatatctgatgtttcagtttcctctagcatctatttaaatgccacaaccaattttcacaagcggacgacttaagaggtccgcctgaaaaaataaaggtatttttgcatacgcacctcttaagccatccgcctgcgaaaatagatttatttcctaggcgggtggctattagacatctctccatacaactagggaggcggacaatcatagtcaaaaataagttcacatacaaaaattatgtgttctgctgtagaaaactgtttttctagtggtgccaggatctaccattttgtttgtcacgttgagttggctgaactctacggtgtgtgtgtgtgttggggggggggggggggggttgacttgacgttggcagaggagagctcttcccttttcggtaggggcaagatcactcttgatgactacggggtcaagaaaggcccaagtagaactcctatcctgcgcggaggaaattgctttggcgatccaatggactttgctgtctattgtagtagagactgattgtttggtggcctcttagctcattcagtctaaagagaagtatctatcagcactagctcacaccattcaagaagttaaacgcctccgcgctggggaaagggaaatcatcattcagaagatacaccgctcccagaaccatatatgcaagccatgcgctagccaataaggcttgttcagagtttgtttctgatttttggttaggagaaacctgtaattttatctctcagttagtttgtactggcactttggttgagtaatatatttctactcttcctcgaaaaaaaaagagaaaggcccaagtagcgaagaggaggagaacaccaaggaagtggaagatgatcctccgcacacagcacactaccggcctcttgcacaattaaacccaaaaacatggagatggtggagcaaaaccaacatagcgcacaaatggtgggtaacactagcaaccgacaatgacaagccccgccaaaggcatgttcgtacactcgtcctactaattgtatggaaaatatggaagaagaggaaacatagagtggttcatcacaagagctattggtgccatctttggccgtaaaaattaatcggctctaatagcagtaaaacgacagatattattccctagtttctccctttccccttttgtacagttccacaccatacttgtaaagctccctttgcactcctatattcaatgaaatttccacaccttatatcagtccattaaaaacattcctataattcaaatttgtacacaatacaactatttcttcgacaccaattttaatgcaagtgaatcaaagcatttgggtgcttagaaggggaatttaaacaattaaatttttgtaatttgaccaataagatgaatatttctgtctaaatctttgtaagaaaacctagcaatacttacatttagaaatgaagtaatcagtatgcgaacgaatcgtcagtttaggaagtactccatatgtcccaagattattgtaatctagattactgagctagattactataagctggattataataagccgacatagaataagctgttagttgtttgtttctctttattagctgttagccacctactccctccgtcccataaaaaaccaacctagtacctgatatgatacatcttagtattatgaatctggacatacataatactagaatcttagaattatgaatctgaatatatgtccagcttcgtaatactagaatatgttacatccggttctagattcgttttttatgggacggagggagtaataatctaaaagaaacacctttagagtggattatcgtattatagtaatttgacttatagactgtaataatctatcataataagctatctcgttgtttcagtttactcataataatccagattataataattctaagctgaatcaaacagagcctaagttaatttctacggtttaaaatatgttccaagataagttgatttttttaacttataactatcattagtctataaatcgagaagttttagtacttcaattctccatatctacccgctcactaatactactacttttattctattaacaagggacaatttcctttttcccaaccttgtaaaatttttcttgggaagtagggactcgatttatttgggagaggcaagggctgatctacattaattatgcttccctgttgcctagcacatccggtaaaatctataacttcaatacgaatagctggtttaaatgataaaccatccgtcctaaaacatggtttatataggctttcacctagagatagctgtgttaacagaagtgcaccgtacgtactgaccacgccggtttgatcgagtcgatatgacctggccaaacggctatagttaacatcgtatggtggcaatgctgtcattgaattttttttcatttacataaccctgtttagtacgacaaactgcacaaatcaacgtcgtcctccttgcaatatgccaactcgcctagtacaaatgatagtactaagtgtcgtatttgaaaattacatgaggcccgacgtcagaactagctactaggcgacattaagcgtgaacgcggtatcttcttattcttaactgctttagaaacacagttgtcctcctttctcttcttaaaaaactgctccccttctaaaaaaactcaaaaaatgaaaaaaaacatcttgaaaaaccaacataaaaaactaaagcatattaattcatggaaaataaactagtatttgaagaaattataacatcttatatttccgttcaatttgatgcacactttatatttcagaagactagaatttgggatttttagaacaataggacatcaaccatttcataaattttagaggggccacagaggagatgaaatttttcgtatttttgtggggcttcctggtatagttagtgacctccagaaaaattaccaaggggaatgaatgagcatagcctcctctagaaattgtttagtgccggctggtccagaattttagaacttcaaaacttgtttctaggctttcaaaatctgtaaaaactttatgttgaactcattggacagtatgaaattacatatttctctttacaaaattttgctttctatcatggagtgagggtaaatttcttacactcgacatatataccggcttttacatcgatctgttatttgactcacgggccggagaaaacatttgttttgcatatgaaatcacatcaaggtaacataaggatgttcactagaaaaatgtgaggaggaaaaaggtctacgcatcctaagagttttcatagatcgttcaagttcaatatttttgcagttacttttcaaatcaccaagttaaaatctagcctacgtcatcactgttcttaagcataaccgaatttctctctaccaacttcattctcaaacaaatgatatatttaaatgtgcatagtcgaatcttgaagtttttttattacgaatatataaaaaatgttaatatttggcacatgaaaataacatcattagaaatttcacaaaactacagatactttaaccaaattttcataaaactacagatttagcgtctaatttatgacaaaactacatatttaggatggaacaccataaaactatagattagataacaaatttatcacaaagctataagtttagtgccaatttaatcacaaaactacaatgtttatagctctaacataacggtagtactagggatttaaacttcgaaatatgtagttttatgataactttagtatttaaatatgtagttttgtgttacttatcattaaatatatattttagtgataaattcggtgttaaatctatagttttctgatacaacaccttaaatatgtagttttgtgatagtttggttaacgtatctatagttttgtgataaaatactttaatgttgttatattttcaatatttttatgatatatgattataggataggcaaaacaatcaaacaagtataatggagaccatggcagtatcctacattataagtaagaacaaacaaacgtaatattatgctttaagttcgtccatgggaaataagatatattagctgggagaggagagaggacccgcatgttattaaatttgttctcaatagaacgacataatgattagagtttaatcaataactcttaaatcattaatagatggaacatattacggattaaaatgcaaaaaaatatattataggattttttttatgaaaaagtctttcatatagttgtattttattttaattttttatgaaaacacgcatagcataagaggtaaggataaaaacatatgaattaaattgaagaccgtgacgatgttcaaaacgcatcaagcgaaaaaacaatggatgttgtatcggctgtctaacatattgttatcaaattaaagctaaaagaagttatcatgttcatgtgttgatttgcgtcaacaaaagtaaccatcggcgacggaaacactatgcgtttttgggactccgtttggatagaagggcgtaggccaaaagacctcatgccattggtcaacgcaatctcgaagaaagtccttacatcagggaatgaaaaataatgcttggatcaatgacttagaccttgaagccaacccaccaatctcggtggaccttataggtcagttagtcaccttatggactgttgtgcgggacatccaattaaacgaggatcctgatcaaattacctataagttcacaagccatggccaatactcggcgtcgtcagcttatcaggcaccttggggcaccaaacaagattttcatctctctcatttggaaagtttggataccggggaaatgcaaattccacgcatggctagtcatccaaaacagggtttggaccttcgaccggctcgcgattagagaatggcaaaataatgggttttggcccctctaacatagagaaggcgaaacggctttacatcttgttgtcagttgcagatacacaaaaagaatatgtagcatggtagcaatccgggtggcttacactactagaaaaacgatttttcatgacgttggtctatttcgctggcggaaaaatgtgaaaaccgccagcaaacttgtaacgagggggtgaggggcaccggccgccaacgaaaatgcattttcgctggcggcccatctaatgcagccgccagcgaaagtatgtctatttttgctggcggtcaattaggtgcgccgccagcgaaaatagataatttttgctggcggtgcaatttttcatggcggccaataaatagaaccgccagtgaaaatccaaccaaaaatatctgtcacattaaaacacccacctacccatcctcatcctcttctccacattaaaacacaacacatccactcctcttctctctcctccctctcctccctcccagcctctccacctgcgatggaggcgatggctctggcggcgacgaccggcgactgcggcggcggcggctctggaggcgacgaccagcgacggcagtggcggcggctctggcggcgatgactggtgacggctctggcaacgacgaccagcggcggcggctccctgcgtcgcccctgccctcccatcccctcctctcctatctgtctgaggggaggaggccgccgccggtggcacaacagaggcggcgacggggaggacgtgcaaatctgccccggcggtggcgcggggagcacatggcgcgggaggcggcggctcgtccccgtcggcggcggcggctcgtccccgtcggcggcggcggctcgtccccggcagcggatggcggcgacaacagcggctcgtccccggcagcggagctgacgacgacgaccgtgaccgtggtgacgacgatgaccgcgatgctgccggcaagcgtgtttttgtgtgttttggttccgcgaccggcagatggcagcggcggtggctcatcccgatggcttcggcgactagggttctctgtgttttttttgtgtgttttggtttgtaaggatgtttgttaggttaatctgtgtttgttctgttgattatgtcaatgttgtatttggattgatgccaatattatgtacgtatttgtgatgctctggatttggattgtgtttaaatgatgtttatgcccatttctaaatatggattgttttgaatttggccgggtggggaattttgaatttggggtagggaatttttggcggggtgggttgattttcattggcggttctctttaaacaaccgccagagaaaatgggttttcgcaagtgacactcaaccgctagcaaaaatcgtttgtccgcttgcgaaaatttactttcgcaagcggaccgcaaccgctagcgaaaatcgtgtgtccgcttttgaaaatagattttcgcaagcggaacgaaaccgtcagcgaaaatattagatcttcactggcctttactttggggcggctccaaattccgctagcgaaaatctaaaatggccgccacgaaagatggtttttgtagtagtgttaccaatagcttgacccttggacaatgggaggcgacccataccataaaagactggtgggaagctctagcaaacacaatgcgagttccaaaaaagggactgtgcactctcatcctccttgtcgtttgggagatctggaaggagaggtaccaacgaatctttgagcataatgaggctacgttgtctttcatttttgccaaaatcaaggaagaggcgtgacatgggcaacggcaggagcaaagcgcttacttttgcctcacactgtatagtgcatatagctttttcccttttcttgccctaaggggctgtatttttctcccgctatatttaatgaaaagcacaatctctattgttttcccttcaaaaaagattctgatatgtctttttttttatcgattctttgtatttacaaaattagaaacaagagccgcataacaaaatacaattctaatgattttcttaagtttaatttgactccaaataattgcatgggaaattgggtaattaattaattatgtgaaaggggtgggtgcaaaactatcaccttgaccacttcaattatttaaagtagttcttttgcctaagggtagtcccaacccatagtgtccataagtagtgtctatggtgccatgtcaataggacatcataatagaaactacactctacaacccatgatttcttaaagtgggccattaataaatacatcatctctcttctctacctatcatatttattcttcatctattacgaagacactgttcgaacgataccatgggttcttgcacgactctatgcttcaaagacccggtggacatgatgcaagcaaatgggacctgtgacggcataggttgctgcacgatcgagacgatgagggaagtgcagggctttcggctaaggattgtccgtcaagatggcatcggccaggtggtgccgcaagaacaatccagtgtcaaggcttgcttgacgtatgactcttattagtttcgcacggaagatctttcctccccttggatcaacggaagcaactttctctatactacgatctacggtgccatcatggaccagccaaactgtcacagcgcatccaagaacaaagcaacctatgcttgcagtagaaactctcaatgcttcaatgcggacaggggtggctattactgctattgccccgatggtaatcccaatgggattccttacactcaagaaggctgtactggtgagacttctaaccaaaccaaaggctgcagaagttttttttatgtagagcttctaccttattaagtcaattaagtataattagtacttttatgattttttgttgtgcatacattgaattgattagttacatgatcatcaaattgcactatttggatctcttgtctgtcataatgatttcgaaaaaaaaatattggttaaaaattttggggagatctaacagtgaaacgacagaggactcggggtgcgggctaactaatggagcctatttgccaggtcggtggtgatggtgtaatagtatagattgtccattgtgaggtccaaatatcgctgataggggtggtgcggcataacaatcatcactactgctccctccgtttcaggttataagactttctaacattgcccatattcatatagatgttaatgaatctagtcacatataaatgtttagattcattaacatatatatatgaatatgggcaatgctagaaggtcttataatatgaaatggaggagtaacattttaggtagtattgatattctatcagttccatacaaatttaaaagcataaatttcacaaaactatagataatttgactaaactatcacaaagttacaaatttaaaatgatccattacaaaaccacaaatttaacatcaaatttatcaaaaaaatattaagatgtagtatgttaaaactatatattttgtaataaaagttttcagagttagtgctcatttaactaaaaaatatataatgtttataactccagtagaacattagtgctaagggtctaaactctgaagcgcatatgtagttttatgataacttcattagtaaatctatttatacttttgcgataccctattttaaattatatattttcatgataaattagtgctaaatccgtagttttctaatacgatgtataaaagttgtagttttgcaagatcaaaatatcagtggttttaccaaatttgtttatttttaattcttaagtgaagaaaactttacacatgcatgttgcatcttcagtctaaggctctgtttgaatataagtagtagtagttttttttttcagcacgcagaggtaaccattagcacataataaattgagtattaattattataacttaaaagatgatattatttttaagagattttctcagtccaacaaaaagtacctcgaggtaccggtacctcacggacctcgaggtactttttgttggactggagcaaatcttttttttaagttatatatagttttaagaaaaatacaattttagcattttaaaaaatatgctcaaagtaaacgagagagttgtgaaaactaaacaaactaccgaacggagcctaaggcatccactaaatttagataaccaaacccatatatatatatgctccttttgtgaaaagaacattgctcataatataatagtttaatttcctgtatcattgagcaggttacaatccctttccgaaaggaatatgtaacagattttgtggaaatacaaatgtgcccttcccatttgggcttgaagaaggttgctacgcgctagaaaagtttcgacttaactgcagagcaggaaaactatttctggatcgaggagatgtagactatctcgtgaggaacatttcagtggacaatggatatatgagcgtaaccaacgagcagaacaattcaacttctaacggcacagagatcatggtagttgctcgtactatgcatggctcctcggaagatgaccctcagttagatctttttgatttaactcaagaaaatgatatgaagatgtggtgggctgtcgtgagttttacttgccaggaagctacgcaagacatcaatacaattcctatgcatgccgtagtgtccatagcgaatgcatcgatgtcaatgtaacacatgggacacagcttggctaccgttgtaagtgctctcctggcttcggaggaaatccatacatcgaagatggttgcacgggtgcggaaactctctctcttaccatcgttttaagatgattatttcttacggatcatccaaatttgtgggctagctgtccattttataccatgttatgttacttttatctctcttaagccttatttgagaaaaataaaataatgcattattggcgtggagtagtttgcatgtagacgtgatatgtcaccacagtaacatagcaattaattcgaaggactttaaaggtttcgagaagtgcatgctgactttttcttttgtttgaagatgtcaatgagtgcttgctaccgaactactgcaatgggagatgtcaaaattttattggaggctataattgcacaagttgccctcgcgggaaagagttcgacccaacaagaagggaatgtgtgacatcagctaagctcattagtaagttatatatactattgaattgccctcagtggttaatacttaattactctaaaaaatctacctgaggcaatttataggtgatgttctgactattgtcgatatataattgttgtaggtatggcacttggaattagttgtggtcttggctttgtaatgcttgcacttggtgcaactatacttatcaccaagtggaagagaggtatacagaggagaattcgaagggcatatttcaagaaaaaccaaggcctactcttggaacaactaattatagatgaaaatactaaagacaaaacaaggatattctcattggaggaactagagaaggcaacatataactttgatgctactcgagttcttggtcatggaggacatggcacagtttataaaggaattttatccgatcaacgtgtggtggctgttaagatgtctaaaatagtggagcaagctgagatagatcaatttgttaatgaggttgccatcttgtcgcaaatcattcatcgtaatgtggtgaagctttttggttgttgtcttgaaacagaggtacctttattggtttacgagttcatatctaatgggacactatgtgaacttcttcacaatgatgtaagtgctaaatgccttctatcatgggatgatcgtattaggattgcaatcgaaactgcaggagctcttgcttatctccactcggctgctgcaataccaatttttcatagagatgttaaatcttccaacatactcctagatgacaactttactgcaaaggtttctgactttggtgcttcgagatccataccactcgatcaaactcatgtggtaacaatggtacaaggcacatttggttacttagatccagagtactacaacactagccaactaacggggaaaagtgacgtgtatagttttggagtgatacttgttgagcttctgacaagaaagaagccaattttaataaatgatgtaggtacaaaacaaaacttatcacaatgcttcctagaaggacttcagcagggagttctgatggaaatcttggattcccaagttttggaagaggctggacaggaagaaattgatgatatcgcttcaattgcacaagcatgcttgaaagctaaaggaggagagagacctactatgaaagaagtagaaatgagattgcagtttcttagaactaccagactaaaaaagtgccaacccatttctgtaatggatgaagagattgagccttttatttgtccaaagaccattagctctgatgctcaaagcagtttcatccatactgctggttttacatcagaatatagcacaagaagttacaggttggagcaggaactctcgtcctcagttggtttgccacgataaaaatttgcgcaacagcatggtcgactccttgaagcttgttagaaggcatctaaattatttttcctatattttcataccctatttttatttaatttatgtatctgtctttatggtgttgtaaaaaaaaagtatactgagggcccctttgaatcgcagggtagaaaaaacggaggaataggaaaaacataggattctgacaggaattgaagtgtaaaacagaggattgcaaaacacaggaaaaacacaggaatggtcgtttgattggagcgcaggaaaaacgcaggaatcggatgagagagatagactcaaaggaaattttccaagaggttggagctcttgctaaatttcctccaaaatctacatacaatgtgtcattccataggaatttcataggatttggaaagcttcaatcctttgaatcaaagggccaaataggaaaatttcctataggatttaaatcctatgaaattcctacataaatcctttgattcaaagaggccctgaatatgtgtatcttggttttctctacttccatgttgtatctgtagagcaatatattatcattgtgcttgtatggtgacatttgagaattgaggtggtggactggtgataatgtatagacgtattagtaccgttgttcggcttaggtgcaagggcaccgcactgcacatagtaaaatacatgccaaatcacatcatgacacccgttaaggtagcaccacccaatcactacttctctctcctagctcatttcatcgcttcttagagccaatacaataatataaccaacagcgagctataatttttaccatgtcatcttgagatggaggaataaacgatcactagaacagaaatctacagtacgatgataacagaagcactattttattttattagggcccaccattcccttttgccactctctcagccaactgtagaaagtagcgctctgtgttagagcctgtgtaaaagcgagcgcttaatctatcatcgactaacactctctttcatgtatttttctctcaagctcatcaatcatgttaacatgtacgtctatcaccggctgaacatgctctattgaactcactcttagagcaagtttaacatgtgtagatagctaccggcgataaaaaagaacatgtcagcggcatcagataaccaaaagatggtgtacgtacagaagatggctatacatacaagcttcaatgaattaatttatcttttctttttgagaaaatctatgaaatgccattgacaagaactctaatcccagaaatgccattgacaagcgcaacttcctcaaaatgccatcgtacaagcgtttttctccctgaaatgccatcacagtcaacttac

SEQ ID NO: 16716 - DNA, 18733 bp, Oryza sativa
  unsure (1)..(18733): unsure at all n locations
atcacaaaatttctgaaataattttgatgcaaaaatttgtgaatttaattttgaaataatttgattgatagcaaaataatacacatatgtgaatttaaatatgcatcaattcaaaatgatattgtgtgagcaaacaatacaaaataatgatgttgtttgagcaaaaagtttgcccaggggtaagattgtcttctcatacaacttaacggagaggagttaacagcagtatggttgtgatggcatttctgggagaaaaacgcttgtacgatggcattttgagtaaattgcgcttgtcaatggcatttctgggattagagtgcttgtcaatggtatttcatggattttctctttctttttactaatttaactttccaccagaccatcactcgctcattactgcacatcatctcgtgtgtggagcccacgtttgtgttggataagattttctatggtttctctagtcttggagcttgtgtttagttggcgataattttatcgtcggcttgcactctcttttctggtttttttcattcagctcatcagttttgtcaggttggttgcgctatcgctggtttaaacttcttattatacctgtcttatccccctcttcatgcctttcttttctctctatccaactcccagaaaattaagccacagagcacatcttgcggatcttgctgtactctaggagcaagccatgggaatggatcgtaggatcgtagtgctcacggtgacttccacgggatgaggcgttgttgcttgccgatgggtaacgggaactgctgtgctccgaagctgcggcgctgtcgaggcaggtcgccggggtacggagcggcgttaccgcgttactcgtcgatgggtcatgcgagccgcggcatacagttccttcgtttgttgcaaatcacatttatcgtgccagaattttcaaatccataagccaatatctgctgcgagagtggattatatattctcacgtacgggaacatctctccatgtttacctattatatccaaatagttatgaatttctttttaaaaaatcaacaaaatagattaatatgtgatagatcactctacaaacaggtaagttaaaattcaacttttacaagttgaaaaaaaatgtctacttaacatatattcacaattaaatttatttttattgcaacttgtataaattaaaatttgacattgcatgtttgtggagtaatttatcacttattaatttatcttgtttttttttctaatttatcataaccatgtgggtgacaagcaaacaacgaagaaccccttaagagtttagaatagttcccctatttgttgcttacctttttgtttagataatgaaaatggtttacatctccgcctcaccaatgttttttaaatgaaaacgaaagaaaaaaaaaagagtaatgggacaagttcccaactcctctgagaagatgctgcatacactaatagaaaaaagatttttcccaaggaggcccatatcattatataggcaggccacattttcggccacaaacgttacgtttgcctgtatagttatgaacggggatacaatggatatccatctgcgaaaatgcaacttcgcatgtgaacaacttaagttgtccgtctgtgatatattttagcatacggaaccttaagccatccacttgcgaaaatatatgaattattacagaagggcagaagggctgcttatgacgcccgtctgaaaaaatccgatgcgatgctagaccacccataaatatctaagtgaaagggactcatccaccacccatacacccttactattgtaccatgtatctctaaccatagctctaaatgatatggaaatttttggggctatcaactggctatactattgatcctgcttatggcccacaaagtcaccactacttgtgtcaatttgttattggacagtgaacagatcatcgaagtgaggtcctgacaaggtatcatatccttccctatccagatatctaaccggtattacacgatacctattaggtatcaaacgatttttatcacgtatcaaatcatacttgagaggtatcaggcgattcctaccaagtattaggtgatacctataggtattgatgatacttagttggtaccatatgttcatactcgtcgatatcacctaatactcgtcgataccagagcaatacctaccagatatcatgtgattcttactaaggccctgtttgggggagctttaaattctgagaagcagctgtttggtagccagcttctgagaatctggaaaagctctgaaacccagcttctatagcttctggcttcgtagtttatttttcagaatatgtaactacagattctcagaagctgtggactgtctggatcagtttctagcagaagcaatttttgagaaaagctgcagctgagagaagctcccccaaacaggacctaagtataaggagttgggcatcgagacgtcgtcactggtggcaatgtcctccatgttgagcaggttcttcaccgtcacgcctcacgctgaagctttggtggcagcgggcccaccatccacgtcccaccccagagcttgtcgccggcggacacgcgtcctccatcgtccacgtgggcgtggctacaggggcataatggctgtctggctgagccgaatgaggcctaggaagtacttggactgggatttgagaggctttccgcataagttgtgagctttgtttctgagaggaaaagccgaaaaaggttgtcgcagaagaaaggagaaggaaaaaaggccgcttggaattttattcacatccctcgaagaagacagctccaaagcaggagctcctcttgttacagaaatataaggtctgtctgaagctccaaatattcatcattatcatcaacctatatttctatctgatgacagacggtggccgaagcaattcgaatagatgacttcatcaatgagctaggacattggaccctaaggcctgcattttacaaaataaataacattctgtagggtcaacatatgcaaatcaaatcaaatggattcctagagaaatgaacaaggttgctgatggtcctgcgagagcaactagacaaacttcagagcaaaatcagatggcctttgactgtagtaatagtactcatatttgccaacaaagtgtatgtccgatcaagaaaaggagatgtaagaatcactcttgccttgtgtttttaaaactttcaaacaaataaagtgcatgagttctaaaagaaaaactagaaaacaatgttcccaactatcaaaatgttatcggattctttaggctatgttcggtagctaggtttgggaactctcttcccgtgcacgtaaaatggagcaacttattaccacatagttaattaggttttagctttttttaaaaaaaatataatttttaaagcaacttttatatatatatattttaaaaacacatcgtttaaccgctcgaacaaggtacgcacggagaatgaggggtagacaatgagtagttgcacgttcatacacagcctacaagtatggcccaattagtttcgggtttgttagagcaataactacactttgactcccttaactaggggccaaatctgattcgtatccctaaaccacaattccggatatctcaaccccctaactattaaaaccggtggaatttgactcccacgatggttttgaagggtagtttcgctaacatggcgcttacgtggcggtgttgactcggtcttcattccacgtggcattgatgtggcagtataattaaaattatatgtgggaccaatttgtcatccacacaaaaatatatggttaattggatctatgccactggaaatgtgataaattagaaaaatgtcactactattcgcgataacggctaggtgccactggaattttgagaaattagatccatgccactccatcacatttttcgtccttcccgtcactctttccatccttcccatcactttttcgagtacggaggccagcatcgtgggcggaaggaaaacgaaatgccgatgaaaaatggggagcggcggagcggatgaaaaacggggagcggtgtcgtgggcggaagggaagggaagtaggcggagcggcggagttgccggagccgctgctttctccgagcccctggtgtggcaggcgcgccactcctcggcgcagcctcctccccggcctctctcccttttcatcttagatctgcccgaagggaggccgtcgacagcaatggcgcccctccctgaaggcacggtagcggcggcgcgactccctccctccctccctccctcccttttcctctcaccctggccctgaggggggaggggacgaagaaggaggacgatggcggcggcgcgactctctccctcaatcctggtggtggctcggcgacaagtaagggcgacaggagcccagctcctctctcccctcttctcctcttctcatccctgcttctcccttctaatcgcggtggtggagctagtttagggtcagggcaagaggcaggcctcaccgcggtgctcgcggcgacccgcgccgcggccgacatgcgcgtcaagctcagacgccaggtgcagtactccgtccccctcgacgaccgctcctcggatgccaacacggttatcaagtacacctccgcgagctcgccgccgacccactcctcacctgctacggtgcagtcctgcttcggcttcagcaggagctacaaccttgtcgtctttgagctctcacacaactcacttgatggccccataccggacgcccgcacacacgccgtcgctgctatagcacctgccgccacccctccggcccccgctcgccgccgccacgaccgatttggcccccgttccccgcgtacatccgtaggggaatagaaaggaggatagaaagggagggaagggagataaagggaggaggaagaagggaaggagagaggatgacatgtgggcttcacatataagtgggtcctacaatattttttttggatgaaaaatgggtcccacatattttttttaattctactgccacataagtgccacatcaacgccacgtggaacgaagcccaagtcaacaccgccacgtacgcatcacgtcagcgaaaccgtccttcaaaaccatcgagggaatcaattgcaccggttttaatagtcgggggttgagatatccggtattgtggtttagggatagggatggcagttttgcccatgggttcgggtatccgcggatacccgacccaatgggcacgggcatgggtgtaaaattttacccgtgggcttgtccgcccaagacccgtagacatcgtgggcaacagccgggcttcattttttacctgtgggtaacccatgcctgacccgatacatttgtattagctaatttcgatttatctcttaattattatacccccttctcttggttcatttgtgatactaactaataataagttgcgatgtaattcaaattattattgataattgataatttggtaaattgttgattttatttttctttgttaaattatatatctttcgagttattattcatgtgagatccattgggtacccgacgggcatacccgtgcccgtcgggcatgggtacgggcatagagttttacccactaaccctagtgggtaggatttgggcgggcgacgacgggcatggggtcaggcatggttttgctctacccgtgaccaacccgacccgttgccatccctatttagggatacaaatcagattcggtcactagttaaaggagtcaaactgaacttattccttcgttagaaacgcagccggcccagccgagcccggagcccgtgcaccccggaaccgtgcaggctgcctacgcgaaagcggaacagcgccaccgcgacagacaggcaggcagcaactacccgaccgatcgcctcctcttcctcctccttcccacctcccgcccacgcctccagatctccgcgagcttcgaccgccaccgcgaccgccgccgcagcaagcagcgtcatcccccgcgcgacgccaggcatggcggccttcaccaagctcgaggactcccccatgttccgcaagcaggtgcgccgccccgccgaaccctctcttctctccctgcccgcgggaggtgtcaccttttgatccggtcctctcagggttcgttgctttcgggcgagatctcgcctccggctccgcgtcgttggtatttggatcgtacgtggtgggggatttagggggggtggagctggaggttggggtgattgtggtagctttgggctgggatttgggaggttgggcgcattctgtgtggcgagatctcgacctgattgcatgctttattggccgttgattggttcggaaatgcgattgttcctgagtagaatggatatcaaattccgctttggtttcgacgaataccgtaggttggttttgatttgccggcatgagtgcattgtaggttgcaaaaggaatattattttacatttattgtgtgttctctgttcctttcccgatcgttttcatctttgagcagtgctgcatttctgattgtaatggtgccattttatttttattgctgcatcacacacttgaacaattttttaattcatcgtctaatttctcgagataaaatcctgtaaaaacttagggacgaaataagctagacgattttcttttccagttcaaatggctggtttgggttattagaagccatagaaaaaatagtgacctattatttaggccctgtttgtttcagcttaagtttattgtaatctacattattgagccagattactgtaagctgaattataataagccgacatagaataagctgtgagctgtttgtttctctggattataagctgttcgttagctgttagccatccaataatctaaaaaaacacctttagagtggattactagattatagtaatctggcttatagattgtaataatctatcataataagctatctgtttgtttcagcttattcctaataatccagattataataattctaagctgaatcaaacagtgccttagactcgaaggctgtgtgtagattggttttagtagttttaatatataatttggactgcaagcttcctgcttgtgctatcaagttgaatcttctctttttcctgataaatccttttgttttcatcttaaacagacctttacatgcatatatgctattgattgcggcttatttccattgatttgcaggtcaattctatggaacagctaagcgatgaactgaaacaacggtgttcaaatcttcataaaggatgcaaaagattcatgtacattaagctcccaactactgttttttttgggcgagctactaactttgcagcacaggcgtacactcgatgcagaatgcgtagcatgattattattattatttttggtttaagaaagacatcactctaggtttatgccgatgtaagtcaatatcaagtttctgtagcatacaaccttttactgcaatgcacacaattacacgatttcaaaacttgtttctgtttctatggtccaatatgaattgtctgcaagtttatatcgacaaaaatgtttattggataaaattgtgtcaataaatgactttgcattcttctttcttacttttctagttcaggattaatatttttttgttaccatgttacatgtaataatttgtagttcctattgttcctaggatagacaacgataataaaaaaccatatgttcgatatattgttttgttatagtattgctgataaccttagtttcaggggatcacttgatgaaggatacgcgggagatctaacatttgccgatgctctagaagcatttggtgctggtcaagatgatcctgttagtgttgccattggaggttaatttcatcaaatctctgttatatctgttgcttaatttttcctggtttcccatccatagatagctaaacaactgagtccatccttgccaattgctaaacatcttgccacgttggtgtccttttgtctcctatcgattatgtaccacatctttaattttatgtctgttccctctcttaaggaaagatcacagtaacagatcattagaatatatataaatgcagacataagcaagcacatactatgtacttcttttattttacttattaatatgttgtaggcttgtagtatgataacacaatgtttcttaactgtaatggtttaatgcaatgccatttcactgaaattatggaatgcaaatttgttaataaagtgaagttcatgaacacattcagctttcaatgtggaagatccaaattctgaattctgttgcagggcctgtaatgtccaagttcactactgcttttagggagcttggaacatacaaggaactccttcgttctcaggtaaaatctattctatgccattgaattctttatgtactactccctctgtcccacaaaatatggaatcctggattcccaatgcaaatttagtaataacatagaaagaccaaagtgccctcattactacattcattcatccacccattaattcacacagcacatactataagaaaaaaaaagaggcatctggcacaaaaataagcgccaaaaatttgaaattttctagtacctgcagaaagaaaagagaacatctcccatctgaaaaaaataaatgctggcaagaaatgctcttatttaacctgcaaaaattaccaagaaccaagaacagagaagagaaaggttgtccgccttcaccaaggtggcagtcatccacggtgcgcctaagggcaagaagaattcaatacagttaacaaggtcgaagggcagaaagaaacctcggtggaaaagaagaatagatggaaaaagaatacaaatggggttcattctaatggcacgcttctcgaactcattgaccacctcagtgctgggagatccacgggcgcctccctctccgcggcggcacccgagctgcattccatctaacgtcgttgccagcatcggatttgcctcttgcgaatctcctctgcaccgcatccatccgccaccgatgcagccgtcacatccaggttgcagcatcagggtggacgcataaggtcgtcgggaggagcgagaggggagcgcgagacagtggcgcagtgggcatggggatggagatggagatggagatcgttggagcgccgcattgatgaacgggcgagacgatggtgaatgagagagactcgagcgagatgggtgtgtgcctgggaagagataaggtccttctcgaccaccgatgtgaagtagtcagtcattgaatgtttcacttttttgtgtacagatcgtttttttttctgggaccctcctccagaaatcctttttgtgggacggagggagtaattggcaccctgtgcgctgcaacacgctgatcaattgttaatatgaaaaattagctgggtgatggaacgaaaaaaagagcatagcatagtaacatttttcattttgatacattctgattgcattggtgaaagaatgtgcatttaattttagataaaaaatgcttcctgtccaaatttgaactgcaataaataggactctacataaagattgtccagtttcatcataacataaatgttccatgaaatacaaatcgaagtgaatgtacctccttcaattgcttaatgcaaacacttggaaacaagaaaaaaataagtaagatatattcaattgtttgtttccaaatctgtagttttgtgacaagactcagttgattctgactcaccaaagcattcaacgggaggaagcataggggagaggaatgaggtgggtattatgacctgtgattattgtagtatttgatgggatgataaactcaagcatacgtgcggtacttctctggtagacccatggtgttgggtgtcaaggtgtggaggacttgtgggctacgcattatgccagacatggagcaccagagtgagggcaggtgtgcgctgaggaacggaggaaggcatatagtaggggatggacgctgaagatgcagattaaattcctcacatcctaccttgtctgcaccagtgcggtccactcagattccttgccattgcatcagcggttacagaagaggatgtgatgatgattgattagtgagaggatgagagaatggagcatgtaaggaagcgtggtagttgggccggatcatttgcaggttgatgacttaatcaggaatttttggaacatgtaggttttttgcatggcatatacaaattgaggtgacatggcacgatgagagtagaggaaaatagctttaattgcagttagtgggaatgaactttataggtacataggattctccttctccatatgttgtttcatacgtccatgtcactcatcggtaatgaaattgaaaagtaagattgctgaatgggactaggagttcccttttgatgcaaataacactgtgacactgtaaaagggttatttgcaaagaagaaccgtttttgttctttttatttttactagcttaacagattgaatctctatcattctaatcagtatgtgtcctcaaccaggttgatcatatgcttagtgaacgtttgatgcaattcattgatgtggatttgcatggcgtgaaggtgagggtgacaacctcctgccccaaaaaattaagcacactactgagatctgtatttatgtaggtagtacctcaggttttgctcttcttcatggatacttgcttgcgtgcttgactttttgttggatccgaatttcaagccttttgcttctgacaatgaaaaaattgcatgaagtgatcttagaaatgtagttcgagtttcactgacttccattttgggtaatgggaacaatatatggatgtccttctgtcttaaatacaatacacctgccctactgtcttgatgttcatgtggaagtttttaacacattaattagttaatactataggctaacatcctgcactgtatataggattgtcgtcagcgtttggatagggctacagtggggtatgatcaggtgatatcttgcactctagctatgtgattacctagttttcaatttgcatatttcttcattttggcatgtggtgccctataagaatatatgttgctatcttgcttgtcaggcacgtgaaaaatttgtatcagtacggaaagggactagagcagaagtagtgacaggacttgaggaggtgaacagggacaacttgtttttttttccgtaagtgatcatttatttaatttctatacaacatctctaattccaaatttgcaggatctacacaatgccaagtcagctttcgaacgatgccgctttaacctagtatgtatgaacatttttttatatagtgttgctaattttattgattttgccaagccaataattctccttggctgtaaggaattcaggtgcacgcactttcaaatattgaagcaaagaagaagtatgagttcttggaatcaataagtgcagtgatggatgcccatttgagatatttcaagcaggcatggtcactctataattcgattgattattattgtttggtttattgggttcttcttgattttgttctttatgatctagggatatgaactactgagtcaaatggaaccattcattcaccaggtttagtaatctcttatctgacctattggtcttaaaccgatgaacatttatttcaatcagcatggatccattgaccataagttaaccattaatatgctaactgtaaggttttgatacaggttctaacatatgcacagcaatcaaaagaaatggctatcaatgaacaagataaacttgcaaagagaattcaagaatataggactcaagaggaaattgcgaacttgagaatggctagtaatgtggacacatctaccagtggtgatggtatccatgttgttggtcttcaatcctataaaaagattgaagccctaatgcagtcaactgccaatggcgaggtacttccattatccactgttgagtaaacaatcataaataataggctaggatacctggacggctaagcttgctgcatcactgttcaatgttctgcttcagagggattgatgatgtttaagagcgaagcaccttttatttctaagatggtgattgcttcttcatgtattcctaaattaggtatctaggcaaagagatcgatggtgttatccctttggttcaaattctagtattataatgccctgttattcccatttataattcaccagactacattttaattatatataacatgcaaccttttttttagttaagctttgttgctttctttcactaatttatttttctggcaggttcaaataatcaaacaaggttatctctttaagcgttctgaaaattcacgagaatggaagagaaggttctttgttctcgacagtcacgggactcttttctactacgggaataaaggacaatcggtatgcaataaaagttagcgatttgtgggctgtcatggattgtttaaaatgtattatttgggaatttataccttaattgtgttacataatatacctgaaatattgaacaattgcatgttgtttgttctgtattttatatttatctctttgttcatgtgggaagcaaggagcggcatcacagcaaacagctggtgaagggactggtgtttttagtcgtttcagattcttgaaccaaaaggctccaactcagggtgacaatgcactttcgtgccacaaaattgatctaagaacttcaacaattaagattgatgcagaagaaaatgacctaagattttgcttcagagtaatctctcccatgaaagcatacactttacaggtaattggaacacttttagggtgtgttcggacccaagggttcccaacccttctccatcgtattccgcgcgcacgcttttcaaactgctaaacggtgtgttttttgtaaaaaatttctatatgaaagttgcttaaaaaaatcaaattaatccgtttttgaaaaaaaattagcaaatacttaattaatcacgcgctaatggaccgttccgttttccgtgatcactgttccggggtgggaacgtgttctagcgaacacagccttagtctgttactcggatgtcacattttctgtgacaccaaatttctagtctttgatgatacatgcattgttttatatattaatactatagactttgtcaatcgcaggcagaatctggtgctgaccaaaaggattggattgagaaagttactggagttattgcatcactgcttaatttaccattcccaagacaggtttcgatacttcctatggcaacacttcatttctagtctttcgtgctttttgaagaaaaactttgatatgctacactgcttgcaagttgcatctccattgcataataatcatttaatatagtaatagtgcttgttctgccccttaaaattagctccattttagtgcattttaatcatatattcgagctatcgattgttcaggataatttagtataatcgtatgctgattcagttaatcccaggtgtcgtatggaaatctagaggcggaacatcatggttctgcaaattctgttgattctctctctcttgaggagaacaaaagtccagagggacatgatgatatattcaatcatctcaggaatattcctggaaatgacagttgtgcagaatgtcgttcaccggatcctgattgggcatctctaaatttaggaattcttatttgtatagagtgttctggggctcacaggaatcttggagtccatatttcgaaggtgtgaactctgtcacttgttctttctttttgagtctaatttatgctacttcattgaaagttacgtttttggtgacctgaccctgtctttcacaggaaagcacttcaaaattttaaactcataaaagttataacttagccacggtagtagtataaaactgtaatataatagtggaaccatttaaagtttaatgcttatgctattgccattaatcattactgaaatgattggggcttaatgtaatgttgtaaactttgtcaatgtccaaaacatcgagtaaaaaggaatggtggattggtggtaataaatcaaattagaagcagaaagcttggataagatcataagaatatcgactccaacctctgttaaccttcgactcttaaaatgagatccaggctgtggtaccaacctaggcaattcacagtatctaattcacatgttttatcattattttctgactatatatttatagaaatattaaaaacataattgtatgaaagtgttttttttttcatgaacaatctaccaaaaccattttcacatatcctgatacttatgcatctattaccaactccatgtagttatcagtcacagtttcttgtgataatgctatatgtacttgatataataccttaatgataatttgatggaaagattaactattttattttagatttttgctcatttgtgtttcttgttgtacctttcaattgtattttctaatgcatataagatggtcagagctaagaacattaattttgcaatacactctcttgtgactttgtgatttgtagatttcaaatatcatttgattttcagatttagcagtagtgtggtccatatttaaggattgcttttgatgtacttatttgatgtaggttcgatccttgcgattagatgtcaaggtatgggagccagtgataatggacttgttccatgaacttggaaatgactacactaattccatttgggaagctatgcttccgaaagaagatcaagggtatgttgaagtgtatgtaaatgtatattttcttaactatgttttgccttcatgctttagacaattttcttcctagttacacctctcttctgaaatttgtaagtagtggtatattgactaatacaaacatcagccaatatgctttttgccaannnnnnnnnnnnnnnnnnnntagttttgtacttctgcatgtattgtttagtcattttattttcttttattttactcattggattattgtcaatttaaggagcataatactgcactaccgcatttgtaatggactatagcattcttgacttaactcagacttgaaatttccaatgggatattctgtcttgcactgaaatggatcagtttcattatggtaggtgaatataatcagtgtagctaaggaaggtgttctatcatttagaaatgttaatgctaataatttcattcacacgttcaagataggttagctttattatcttctacagatgagttggaagatctctcttttaatctgatagtgccaatgaatatatttcatacattaatggcattggcatcagacatgttcattgtgtgtggaaaaactaagtttgctcctttctcctatctattttcttcttgatgtgtatgcagaataaacgagtttaatgatgctattcttttcattgaaaagcctaaacctactgatgctttttcaataaaggaaaggtacatacagacaaaggtaaattattctgtccatccttttatatgctgaacctagcaatgctttcttgatattgatgtatatccttgttagtcatgtgctagttgaagattgaattccaatgtaacccttgccttttattttataaatgtgttgttttgctatccagcttcagttctgtagctacgactcacatgactgatatcacataaatcttttgggaggctggggatgttcacatgcacatatattatatatagttagcagcagttgtatggatcatgggaaatctttatgatgtaaccattttacactttactagcacaatagccatgcgttgcagcagtttatttaatataaaacataattatgagttctcttagtaaaagaatatcttgcctctacttgggtgaagcgatgttcttcatcttaaaaggcaaaattaaaagagtgtagcttatgtcttgctcaaatttcaaatggatggtaaacagaagagagcaatcaaattgctcgtgtggggtccaccaatctcatgggcccacatgttagttggtggtggcggaggcaaactcaccaccaccactatggtcttttataagagcatagatataattggagccagaactcagtctatggattggttcacaaccagatttgtagtttgatttatcattttattttctgactgtactgtttttttgactgaaagtactgccaggtctttgcccagcagtgtgattttcaattattgaaagaataattataggaaataattacaggaagaaacaagagaaaaaaacaaaagaccctataaagtttgtaaccaattaacaacagattgcttcaggagatccttcattctgcagagatgcagaagaatctcatttgtaaagagagacttccaagaatggaactgttgcggtcagggtacaaatactgaagataattgatagaacatgaatgaattgcatacttaacaattaacccttggtatttcaactctaaaacttgcataattgatcaatggctggccggaaaccacaagcttttgtagtgtgatccatatgcaacgaagtgtcgagtaatgcaggctgcaacaaccctcaagttcttttttgcttcaaatagtttctattgctaattttgatagtattaacttcatgtatgaatggaagatttagagctccctgttttcttgattctgatgaccttctgtttgttgtgccatcattaattactgtaaatgatctatgcagtatgtcgacaagcttcttattgccaaagataccaatcaaattaccattgatatattggaggctgtaaggacgaatgatgtgagggcagcatatcgcattcttgtgttggctgatgtgagccctaacatgatatatgatgagttaaacaatgatgttcatcatgatccttcagtaacagatgggaagttatttgatccagcatcttgtgatgtaaaggatgattctgggaaaccagaaggttgtctacaaggctgttccctgttgcacattgcttgccaatatggccattctataatggcagagcttctgcttctttttggtgcggatattaataagcaagacttccatggacggacaccgttgcaccattgtgtccgaaggaaaaatgatgcacttaccaagcatctgctaaagaggtaggattgaatttctagcagtatggaatatagataattacagctatccttccactgttgccaagctgaagtatcgaactctttacataaaggctattttttttttgtttcattcagcataaaagtacagaatgagacactgaggcatatatgatatgttctggggtcctgacaatgtctttagtaatcttatcaatataaccaaaattgtataaaatcaattggatgacttgttcgccaaacacttggattcatactagtcatctcatcccatgtctaaggtccactggtctatggaggtttgtctcattttcagtctcatcatacctatagcgcctatcaggtggcattcagttggttggcataccacttgtgctgtgagttgtgccttttcgagatcatcaatgatgcatttcaacagtttagtaggaacagagagggaaacagcaacaaaaaagcattttcctttcctcaggctattattacaatccctttaatcctgtgtttgtcctcccattttcctcaggacaacaaaaaaaaccaattagtcactgttaatttttgtttgactacatggataatgttaaatggatttctgttccataggggtgcaagaacaaccattaaagatggtggagggttgactgctttagagagaagaatggaacttggagcaataactgatgaagatttgttcattttatttgtaaggtatgatcaagattagtaaaattgcttttcacaatattatcttggcaattactagcaaatgccagtttttcatttccttttcaacgcttgaaaccttctcttgttttcaaaatatgatattgtcttcatgtctgagaaataaaagtacatctcatatgctaaatatttgatcaagcataccctaagtaaacctttttaggagatatcgatctttgcagtttcctgaaatttcatgaagtagcttgtttatgcctgtttcttgaagccttatgttatttctagtcatgaagaattttgttacttagtggtgtaataggaatacttgttaagaaaaagggtctcatttggggatggtgtcttcccgcttatgtgggttcaatactgacgttttcctagcatgaacatattagtgtatcttgatatgtaccagtaattgattgtagtaattaactttgttgcaacttctgacattataacggacatgcttgtgcaggtgaaatgtcaagaacacaggtttgtagtaagcaaatgtctgtatctgatagagttgtaccagtttttttagtttatatagaatgaatacatttgtatcttattacggtgagataaaatctctgacggtctgacctttgcgcttctgtcgtgtactcgtgtgatcttgccagtcttctcagatcactctttgtacaacagttgtagcatagcatatagcatacatcaatcattcatataccaaagtttgtatcatttcctccatcatcaaacatgtaataacacgttcgagcaatatacccgcatgccattatcgtgcgattttgaaatccacttactaattgctgccatgagttgtttgcagttgtttgtttcatctgaacctatcaattatgtgtgtatcgttagcaacttagcatcgccctgcggcactgatgcctaggcctgctggatttttcaca

SEQ ID NO: 16717 - DNA, 723 bp, Oryza sativa
ccccccccctccccgaaattttttatttttgttttatttgtttgatatttttttcacgcttagggacacacaagaaccaaccatagaaaaattgaacttaaatggacgtaatatgtgacatgtagaatttttcctctcctctctccgaactagtgcagaggagagagatgtgcaacttttttatttttattttatttttttgatatttttttcacacttaggaactcacaggaaccaaccatgtaaaaaataaactcaaacggacgaaatatgtggcatgtgaaattttccaaagctctaccgaaaaacttctctcctcgaaaacacaatcttgcaagcggaatttggaggttttaatatcgccgaacccagcaaagctgaggagaatcggatgtaactttttctgtagatgtccatgcatatattatttgcctgattccgagtccgtatgagaaagttacgcctattttaatagatgacatattttgtccgtttcggtagagttttggaaaattctacatgtcacatattttgtccgtttgagtttattttttatacggttggttcctatgttctcctaagtgtgaaaaaaatatcaaaaaaatgaaacaaaaataaaaaattatatctctatgtactgtttaacttatatatgtcatttaatgtggttatattttgaattagattaagtaatttcatatagtggtagagtgcattatgttt

SEQ ID NO: 16718 - DNA, 720 bp, Oryza sativa
tttttaaacatatttgaccgttcgtcttattaaaaacttttgtgaaatgtgtaaaactatatgcataaaagtatatttaacaataaatcaaatgataggaaaagaattaataattacttaaactttttgaataagacgaacggtcaaacatttttaaaaaagtcaacggcgtcaaacattttgggatggaggaagtatatgttaatctttacctattataaaagtttaagatgtttttgccagatgtttcgtacgtcatctgacttcgattcctactcggcttgcgcactctcgcccgctcgtgcgcatcagaatcaggtccgtgttagtgtccgacttctcccctaatacctgcgcgtgttcacatcctccatcacgagtcgttcgcacgcaccagccggaaaaaagatcgaagcatcgatatgtcagcaaatcgatcggactctaatccagaccttgtgcgtatcagaatcgggtccgtgttagtgtccgacttctcccctaatacctgcgcgtgttcacatcctccctcacgagtcgttcgcacgcaccagccggaaaaaagatcgaagcatcgatatgtcagcaaatcgatcggactctaatccagacctcgtgcgcatcagaatcgggtccgtgttagtgtccgacttctcccctaatacctgcgcgtgttcacatcctccctcacgagtcgttcgcacgcaccagccggaaaaa

SEQ ID NO: 16719 - DNA, 7644 bp, Oryza sativa
aatagcaacctcattgataaactgatctatctcagtttgttccacaatttttgattttttaatggccaccacacttctggtcagatagaatccctttataaactgtgccatgtcctccacgaccaagaacacgagtagcatcaaagttgttggttgcctcttctagttcctccaagaaaaatatccttgttttattagtggcgctttcatctgagattagttgttccaagagtaggccctgatttttcttgaagtatgctcttctaattctcttttggatgcttttcttccacttattggctagaataatcgcacctaatgcaataattatggaaccaatgccacaactaataccagttgtaatacctacagccattcattatttttgtgccgtgaagccactttgcattatcttaatgcaataagattgactaatctgtcagctatgacttacctataataagattgtgttgcttagctgatgcaacacactgtcttgtaattggattaaactcctttctgcgggggcaactagtgcatgtaaaatttccaggaagattttgacatgtcccgttgcaatagtttggcagtaagcattcatcaatatctgcaattaacgcttcagttttttttttgtttatattggtacaatataaatgcacaggcactactacctgcttaaaggggaaatgccgtggttaaactatccacataaaatttctataaaattattaaacatttgcaaattggtgggaatgaagaggaacaaaccttcacatccatcttggatatatggattccctcgaaaaccgggaaggcacttgcaacgatatcccatgaatatgttcccatgggtgacgtttaggcaattgctgtggatactgcggcatgcatatgtagcatctttttttactgcggcatcacacgttaaattggctactgcccactttatttctgcaccaccatacacctgggatattatgtcctctcccccatattctgtgtcgttcaacaagttgctaaccaccattgtcccctcttcaattgacacatcagtcacattataacgtgcgtcccgtgggttgaaaagtgtgatgttacctgttgtacaattaagttggaacctttcacttgcgaaacaaccttcttcaagaccaaaagggaagggaattgccatgtttccgcatgatctccgacagtgttctttccgcttggggttgtaatctgctccacagagagagaaaaatgaacgaaaaaccgatacggaagacttttgtttgcgccttagaaagagagaaggaatgaaaattcgatatgcaaataaagctctctatatgtgtgtgccttagtagtatttaagtggagaaaggtagagaggaatcacctcggatgatgcatccttccaaaaggtaaggactttgttctgcataataataataaagatcataattggcgcactcacaggtgtaacctccagatgacatatttaggcagttgctgccggtgctacaagcataactcgtatttttcattcgagcaatttcacaacttggttggtccatgattgcaaactgaactaatgcttcctggatattgcttgtgttcgtccaactcaagaaaagatcagtcgcattatctacataatagtcattgtatgacataaaagccataacaccatggcgcagctgcagctgatatgattgtgctgcagtagcatcaacttggactagtgttgaccgaaatccccgcagatcccttgataacttgatggagcaacatcctttcccgttacaaggcccttctgttggtaccttttcaccatcgcatctactcacgcagtaaccaacagcgtctctcgtaccatactcgaacaaggtgacatcaatattacaaccaataatgtagaaggtgttacgctgagaaatagtaactcccttcctgggagacacccaggatatgttgtaggtatcagtacctggcttcattgtaatgttgaagtgcatgggtgcccaaagatcatcgtcacctacatataagatctgggtggtgccatctttcatatagagcttaggagttttggtgctggtgttgcacttaagctcgaagccttcccggaagcagcccggcccaatcccaaagggataggcgatgtcgtcaacatccccgcagctagaggggcagtgagcgagggaatcattagaagggatagacaagagccctccgccatctccatagactgcagctaatgctcgaggcgtagtagcagccgagcacactagcactaaggaaatggcacaagctgccacaaagctcgacctcatctttgcgccagccgagacttgcctttgtggtgcaggccggtgcctgttaactacacggtcaatttatattcagacgcaccatctctttgtgctcgtccgtggacttcgtaagtaaacgcgagattgacatcaactcccacaagcggtcggttgattagtgctcgatcggcagcaaacaattttcttgcaatttaccaagtctgtgtatttgttgacgctgtatcgacgaagtccaggggcactactcccatcagatatcacgtcgttgctggggccaacgactcacccaactgtcggtctctgctcgactcacccaacgactcaccctattcatccgattttttccacgcgttcagtagctatctaccggctggaaagactggtactgcccgaatgctattttgatcataatacacaaacgtgatacagatgctattgctaccatcttgcttcatattagatgatgaaaataatggccggcgttgcgaaactgactgtactacaactacaagacacgcacatagacttgtggttgtgggaggttgttctgctatcgtacaggttagaattcttgaaagaacgtaacatgtcaagtcgttcaaaactgcagttagcactccgttgcttctacccaacttgccaattcgcccactatattcttacttaaactattcgaaattcttaatatgcaaaacaaggacaagtaatggggtggagtatatccacagataaagaaatatatatgtgattgggatgaaatgagtccaatttaggtgggaacatgttcaaagtctggttcttcgcgtgtatgtatcactcttttagagctgccaaattatttctaagcatacttgtgtatggttactatttcatccaccgatgtggggcgttgattgatccgagtccacgtgtgatcaatgtaacacactgaaatgtactgtaataatcccttcgtcccaaataagttaacctagtacgagatctctttacatggcaataggatatattatatctcgtactgggttaatttattttgaaattgagagtagaaagagattacatagctaagcaagtccacatagatcgaaagcgtgcacctcaaccagctagaatgacaggagaaaaatttttagctgaaaatcttccgaagcttttcattaactttcagtttggacttgaagggcatgactacggcatgccatgtatgaccaggtatatgtgctttgtgctcatgctaagataatatgtgccttgtgccttgtgcagttgtgttcatgctaagataatacttcctccatccaaaaatgttatataacctaggattagatggagacggaggtagtacagtacttgcaagcaattaaccagaacgttcttcggcgatgactacagctgacagcttctccgtatgtgacattattcatctcccggacaaccggggcacccaacgagtcaatttcgatgtgaaccgggtcgtgcgtgtagactggagcaaccctgactttagtcaattccacacctctcgctgtactggaatctactccctccattcgaccaaaaatagatacctctgtagggtatcatatgcctgtttagttctctcgtatacgaacacgtatttaaagtattaaacgtagactaataataaaacaaattacagattctgcctgtaaactgcgagacgaatctattaagcctaattaattcgttattagcaaatgtttaattaggctcaaaaattcatctcgcaatttacatacaaactgtgcaattggttttttttcttccacatttaatgctccatgcatgtgtccaaacattttatgttacggaaaagttagaagtttgaaggaaactaaacacagccgtagctatgttgatgggcttgtagtaaatctgattaccaacagcataaacagtcctgtaataacgaatcacaaagtgtacaactagtctgtaatataaatcgtttgagagtgacgatatgcacaaatcaactaacactagagagcctagcgcatctgtctatagcagaaatgtactcattgggttagcaaagtaacgcttgttacacttggatggttctttacagcgatcttgcttcaaaatactctgcaaaagggtaggtgccgaaggggcacgttcatcaaacacccgagcataaaggtgtttatcaaacatcagcttttccaacaaggtccggcaggtctgcagaaaggagaaaacaaaccatgagtggaataatgtaaaatatttattttttttaagaagggtatttttcccagcctctacatccaaccggatatatacagcctttttgaattcgctcaaataacccaatctgagaatttcggccctcaaataacccaatctgaaatttgctactatggatatttgaactcaagactgtctttttaaattaggtacttaacctatcaaataggaaacttagccatcaaataacccaatctgaaattcgctcatatggaaaattgaactcaggaccttgaggtgctactcaggtcactgcaaccactaggctacatgccttttcacaaatatttattatttaaaccactatcattttaatatcgaatatacaggtacaaaaggagaaagtagaggggtgacgcacctgcgggttcaacacatccatccgatggatgatatcctcctggcataattagagcagaacaatagatcagaacttttaaaatattgttgctgataatggtaactccgtaactggaatcaccactaagtaggggaatcaaacgatcttagatctgtacattcaaaataactgcctgatcaatttaagacaaaccaactttaccacgcaaccggagggattcaaataacttgaacagtaagagatgagaaagtaagtaaaaagaagaatataaatgatatagaggaagcaaacacgggagtcacattcagaaagaaaacaggacatgctaaaccataacatacacaaacggaaatttccacaacacttaaatttagacaatagttgaattttccattgttcacttgtaccgtatcgatgaatcttttaatattgtagtgctagctataactaagatttaagtattccattcagatatttagaaataaaactaaaattacaattgtcaaactaccaaaataacacgaatttgaaaagaaaaggaatattttaaaatatggaatttcatgtctcaaccttgattttgaattcttgaatttccaaaccaaaaataagggatccggggaatttaaaattcagatttatgcttgaaaagttaagacttccaaagtttcaaatactgaagttctcgcataaaattttctttttaaaatgagacatttaaagaaaacaaggattaattagtaaagaatgccatataacattaatgcaaaacttttggagatatagatggataaacaaatcacaatttcagtggcatacatgaaactttcctaattcaaaacaaagagctacaaaaaataaaacaaacacgcacctccactactcctggatattgcatggtatatccaataatacgacgacttagaccttcgtagacagtgttattcatgcttccatcaccatttatccatggcaatattgggtgatatatatgcctttcgcaagcatgacaacaatcactgcccctgttgtcttgtgctggagtaaacgaccttttctgacctacaggactttgatagcgtatctgaggagagcttgacttgctttggacattaagaaccgtcacagtgtgcccgtcaccaagcatttttacactcccttgcacatcactagacattgcatgcttctctctcagtagattttctgtatctccagtctcggccatctcaaaagcagaagctcgcaaacaactgcaatgacttgaatctgcaagtgtagttatatgatattttgacttatgtatagagtcaacaatctgcacaccatcatatgcattgacctgtgaagcaagaaaatagagtgacacctatatatgagtagggaaataaaaaaatgtggacaagaaagcagcagtaagtgtagcatcttatatgcaagtattccactcttaatcagtttgacataaatatttaactatcccaatgatgttttaaatgtttatataaaattctacaagtgcagaaaaatatgtcagtaataacaagatctgtttgttaacaacaaaaaaccactggtaaattttgacaagcaaaagaatgaacagtgcaagtattcataattaggcagatatgaaaaacaaaagtgaattaagataattatatcgataaaccagtaaccaaatagaacaaataagtaggctactaatctaccatatgcatgcttgctcacagatttaccttaatgaccagctgaaatctcttgagagtatgaacaatcagatcgacaaactggatgcctgcaggggataagaatataaaaatgaactatacttacaaaataattgatgcatagtctaacaattctaagtttaacataagttacacaaatctaaagaatacctagaggatccagtgcctgtgacatctctctcaaattaactccttgttcgccagctttatgaacaacacaaaatgcatttctgaacaggtcagaagacaatatgtctggttcatttttgttacaacataatgatggtgactgttcagcatatgtttttatagcatcccaaggccacccactgtaagagttctccaaatgagattctgacagtaaacgccgacatgaactggagttgtttagatacaatgatgacatattgtggctttctacctgtgaatcaacatccttgctccccatttcccaggctgaagtaaaaataaggcattctttatcatgtaactcttgtgtaagattacttgttttaattctctcttgattcaaagccacttgaagaccagggaaacctttctctcggcgatagcaaaagtcgctttctatcttgggcaaaggtttgtgtttcttagtcttactgcttttaagtttaaccatatcagccttgcgtttgtgactactctcatccaattcactgttatcatcaacaaacaaactagagctattaggctcatcagcctcaccaactccttcacttggcaatgagggtgaaatgaacgactctccagacaaaacaagagaaaagagctggacaatttccccacattgtagatctggatacaaacaaactccatcatccatggtattcttttgctgccctacccattgagaaaattcagaagcttttttccctgaaccaaatgggaagggtgaattcgaagcattaaaaaagaattt

SEQ ID NO: 16720 - DNA, 105837 bp, Oryza sativa
aaattaaattaacagcaagtgaaaagagaaaggagtatctctcttgttacgtaccatccacggtttcatgatgtggtactaacagtagcgagtgaattaatgattgagtgatgctagtagttcattaaaaaaaagttaataagcgtacgtcagtccaatcatctgattaaattacaatatcctagaagaagagtacagtagttcaattagtagtggtgcaacaggatgagagcacgcaagtggcatgaggagatggatggatatgcagttagtagttaagctcagagatggtggtcatggcgaattggcgatggcgtatgagtaggtacataccctcatggagacgttgcggaatcgggaggaggaggagggcttgtaggtgtttgcggcggcggcgagagggtcggcggcgaggcggtactcgtgcatgatccagctggtcttggtgcccttgggagggcggccgcggtagaagacgagggccttcttgacgccgacgctctcgccggtggcgctgtcgtggatgggcttgtcggttcccgtcgccttccagtaccccgacccggcggcgcggttcggccggattccgttggggtacttgcggtctcgcgggctgaagaaataccactcactctccccgtacaccgccttcgctgcaattaattaaccagtagcaattgaccgaacgaccaactcaatcgatccatcgatatgatcgaggaagaaggcttacatggcaggtcccatggatcgaacttgtagatgtcgacgtcggcgatgatggggacggggcactgcccggcggtggcgcggctgcggaggtagtgcaggatcagctcctcgtccgtcgggtggaaccggaaccccggcggcagcgacgtcgccgccgacgacatcgtcatctccatcgacgatctaatacggttactgctttaattagcttgtaattggctacctatagctcgatcaatcgattgatcgaatcaaagcgagtgctcatcgatcgatcgatcctccggagcagcggagggaagggccacttatatgcacgagcgaccttgtcagttagcgtgacgtggcgcggagtggcaaatgtttgtaattcttcggggtcaccaggggtagaatcggaaggccaatcgggtgattcgttattcctcgcgtccggcatgactcggcatgggctcgtgcgtggtcgtctatggcgtcagcaatgttgcaacgcatatgctcatgctcatccgtctccagctgcaactaactatatctatctatctatatctaactagttaagctaagctaagctatctctagccgtcctcactgctcatcaatctcatgtgatatctcgcatacagtttcatcgatcgttatcagctacagggaatcgatcgatcatatatagggcagatatacactcctatcatatcatatacttcatctgtcccataaatataggacagatatacactactatcatatcatatactccatccgtcccataaaatacaaactaaaactaaacgtgacacatcctagtataacgaaatctgaacataagtatatctagattcgtatgactagaatgtattacatatactacatccaatactagattggtcttttataagactggagaaatatgtagatagatactcctatgtagctttttaatatataatagcattgactttttaaagatacatttaatcattcattttatttgttttaaaaaattatgaacttattatttatttattttatcgcgacttgatttatcgttatatgttcgttaagcataacttatttttttatatatttacaaaaaaaataaataagatgaatagacaaacgcttatcaaaaagtgaacggtgtcatatattaaaaaatgatgtagtagatgatacgcgtgattatgtcaaaggtaagaaacagaattttactaatctgctcttttttttggaaaaaaaaggaaaacattattcgtgtgtaagtatataatatccgtgtgcattacaatttaaatctcataggtgaattgcacacggatattgataaatcatgaatccacaatatgagatttaatcgtaccaccggtacttttcggtaaataattcatcatttcaataaatatcagtgccaattaaagcatattcttgggtgctctctaaagaaacttattgtttatttaaataggagcatgagaagaccaattatttgtggagtacgtcacatcctgcacgtggagctatttagctgcagtggccggcgctagctagttgtagacgatgaattggatcagtcggctcacatggctagtcattatcgatcgaaaggccagaaatctctgaatagtactgaagtagacattcacacatccattgattattcccagagaaattacaactgtttggctctttgctacaatactctctccgttttctaaatatttaacaccgttgactttttaacacatgttcgatcattcgttttattcaaaaacttttgtgaaatatgtaaaactatatgtatatatataagtatatttaacaataaatcaaatgataggaaaagaattaataattacttaaattttttgaataagatgaatgagtaaatatattttaaaaagtcagcggcgtcaaatatttagaaacggaaggagtactatattgtgtgtggggctccatttcaactataattgaaccatacacagtttcggtgtacgttattattggatcatcatatctaacagattaacatccattattcatgcaccgaaactgcaatctttgtctcttcaagaggtttgcctcggcggtacaccgaagcaagctagctatatatataaaatcaggattatcctcgctcaattatgccttggaaaaactcagaaatgacactacagtaagtatgttaattgggatgatttccacttcacctgtttaactggaatggccaccaatgcacatgtttggagcatacttttatgatcggagaaaatttaattaataccatcgctaatatgtgtgagttgtaaatcaccgcaaaggatactattagctacacaagtcataggagagccactgtagaaggaaaaaaatatgatgagaaactaattccttttttttaagataattgtcgcgccccgaactagtcccgaccggaactagtccgtgacgctccaaattaacctgttaatcgataccagtcctaggaaacagtgctggtatcacagggagacagaatatcacagcaacagaggtctctttattatagagtagatgtacagtcatgctgggctgcggacagatcccgagctcacaactgcattacaaaaggaaagcggaagccaagacttggaccaaacatcacaggcgcgacttgggaactaggccgaaaccctaaaactcatcgtagccggcttgctcctggaagaactcctcgtcagcgggatccgcttcatcttcttcaacaactgggggggattatttatatagagcaagtgtgagtacgggagtactcagcaagccatgggaaataagtgtttaatgcaggcttcaaggaaaggctgttgtttttgcaattgattttatttgaactcttttctgaaatcaactaagtgagtgcttctcaaacgacacggatgagacagtgcgtctcgtccggtcggagtatgtgcaatgtatcagtcttttgaattgattcaaagttggcacccggccaacaactttcaaacggccacccgggccaacaacttttaaacggccacccgggccaacaaccttcaaacggccacccaggcctagctgatccatcagctgcagatttttcaaacatcgatcccctttcgacaacagcaaattcacaaggcagtagttaaacaaaactacgctaggaatcacctcacatccgcccatgaccgtgggcacggctgttcgaacagttttaatcacctctgcagagggggtacactttacccacacgacattactaacccggatcacccagcccgtggggatcagccacgtcgggagacctccaagatttcatgacaaggcatttcgaaagccgacacaggtttaccatatgccgacgagaggggtcccagaccaacaacaggttaggtcccagaccatactgtgccaggaagcccagggatcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgtaagagcgggaaaccgtacacccggtacgttccccggtccgcggttttggaaattcatttagttcacaagcaccgacccaggtgtcgggttttccaagtcttttgtaaaacccaagttttacccaagaagttactcagattttaagtttgaaggcgaccgtcgatactcgtgcagagtgcacgattttcgaggcgcgactaggtggttacaaggaaacatggtataacaattaacagaggaaggatcaaatgcaacaaataggtaggtccgccaatctgccttgcagacgggacaagcagattaagtgtgatcctatcaatgcataatatttttcaagcaacataattaagttcaaatataggctcaagatgttcaaaggtggcttgcctcgctcgagatcttgagcttgatcctcgaaatcctcgcactacgggtcttcgggctccgaaactacacgcaaaacgggacaactcaacaaacggcgaaaataaagccctattaatgacctctaagcgtgccattagatagatctcgagatttgaggaattttggaagttgaacggagtcaaacggatttacggtcgggaagatattgaatttctaagattattggatttttggtctaaaggaaaaaggatttatttaaatcctttttgaaaaagaaaaagaaaagaaaagaaggagggagggaaatcagactttcctcgggcggctagggcgcggcccgagaggaaggggcggctcggccgagctaaatggggccggccggcccaagaaggcggcccaaagcgcgcgcgcgggcggagaggagagggggagccggtgggccgggtccaccttgcgtggtcccgggtgggacccgcttgtcggcggcacggttcaccgtgcggagggagcacgcgacgcggcgctagggtttgggcggggcgcggcgcacgcgcgcggttcgcgggggacgcgggtgcggcgggcccacgcgtagcctcacggctcgcggtggaccgcgcgcacggggagggtggaacggagggagcggctgaccgggtcagccgactcggttgtgccgaggtggcaccgacgtggcgcctacgtggctgcctcgcgggccggctggaggaagacgaagacgccggccgcgaatggacggcgggcggcggcgacgagcggcggagcgaatcacggcgatacaggcgaaagcgagcacaccgggtggttgcacgagacgaggggagacgagccaacggctcggattcgccagagggagctcgacggcggcggattgcggcggcggccaccggcggagagaaaaagggaaaacggcgacgaggtcacgaggggccgattcccggcggcgagagcatctacgcggctacgggaatccgtcccttgcaccggattaggaggaaacgcatcgagggaggccggcgacgagagacgtttccgagctcgggcggcgacagcagcgagcacacggcgagcgacggcaaaggtcggggcggcaccagctagctatggggaggctactcgtgctactacccgagtctaaggggaggagatggaacgaggagggagaacggagggatgcactaccgtgcgggcgggcgcagtgacgagagccgacggcgcgaaacgtgatcgtttcggcctcgggccgaggaagaggagggggagggcacgcccggagtccccttccgcgtccttgctcgtgccgactcctccgacacgcgcaacgatgatcggcgacggcgaacaggggtgacagtggcgtggcggcgagagacgaaaacgagggagattagaggagggaggagcttgggtttataggggcgacaatgtcggtttgggagaggggaaccgacattggacggtcaagccggcgagctggcgcctggctagcggccaaaacgacgacaggaggtgacgccggcgatgggaggaaaaagaagaaaggaagagggaaagggggcttgcctccttgcttctttgggaaaaggaggagggagagaaggcgatgaggaggagccctgcctcctttccttggaagcacgcgcagggagaggcggggccgagtcgatgacgacggcgatgacggcggggcggtttggagcggagcgacgacacgggcggcaggcgcggcaggcgctgacggcggcggcgaccaggcggtcggccaccatagcacgcgcgcgtgggaagcaacggcggcgcggcgatttgagcggcacggctcgggcacgcgtgctggcttgcggggccgagcggctgcgtggcagggcagcggggccgggcggcgtaaacggcgcaggcgcggcacgggcggcgaccacgcgggcgcgcgcgcgcgaacaacggcgcgcgggggccgattctgtgggcggggagctcgctagggatggaggcggggagagagagcgagggagggagatgggccgagagggattcggcccatcgaacccgggggaggcgaaatagacttttgcggagggattgatttggaaggatttggattcgggattgaattcgacgatagatcggggatttgagatctgagatggcatggacactagacgacaagcaaaggaacagatttcgcaaatagggtttttaagagatagttttcccgctaggcgccacgacggaacgggcgctacacaaactcttgtctacttcgtcgcaggggatctcgagaccaacccatggcttgtttgggtccttccattcatgccacagccagcatagacgcagggctctcgtgaatttttctaggttcaggaccccgaggcctccttgcctagttggcagacacgtctttgtccaattgactttgtattttccacccgtgatgtcccccgtgccagcccagagaaaacgtcgccgctgcttgtctaggcactccaaggcttcctttgaagttttcagagcagtcagtaagtagattggctgcgccgtcagcattgattttacaagtgtggacctcccggcaagtcccatgtttttgcctctccatcctgttatacgccctgtgatcttatcaaagatgtgttgcatgtccgcctttcgcatccgcccgaggatcagggggagtcccaggtatttgatcgggaagtatgctctcactgctgggactccctctaggacgtcgtccaaatcaatgttattgtatttgatggccgcgacttgagatttttggaagttggtaacgagtccagtggccgtgccgaaacgttgcaggatttccgtgagcgcttggacatcccctcttgtgggattgacgaaaatggcagtgtcatctgcatacatagatgttctcaggcgatgcattctgcctcgaagcttagagagcgaacctaggtctgttgcctttgtaaagagacgttggagagggtcgattgctaggacaaaaaggagcggagacaacgggtctccctgccgaagtcctttcccatgcgtgattctttgactagggatgccgttgagaagaacttgcgaggtagatgtgtagaggagggcacctagccagtctctccattttacagggaagcctaggcgttgcaaaagggccatcaagtagtcccaacgtatagaatcaaatgctttcgtgatgtcgagcttgaagaggagcatcggccgattcgtacggtgaaatcttctggccatgttcctcacaaagaggaagttgtcatgaatgcttcttcccttgatgaaggcgctttggttgatggagaccaaggagcgcatgtggggcctcagccgcaacgccagctaattaagctactgtttgaactacattgggcatgttatctaaactcaacccatcacaataaaacacacacaacctaattaagctactgtttgaactacattgggcttcggatttatcatgtgattcctcagtaaaatattcatcatgtgatagagctgaatggctgacacttcggtccggcacgaatcatgaaggccttttacaaaaaattgaaattggaaactgaaagtacactacgtggccactcttttttctctctttggaatgggcctagatctttttcgggaaaggacaagagctgagtggatgcacacggatatttttaattttttttcccttgccacttgtagtacaattgtaaagtgcatgttgccatgttggtaagtgcacgagtattttctatttagggggtgtttgagagagagtgactaaactttagtctctcttcccttaagttccaacgaaaatactacccctctctccgatctcgaataagtgtatacactgttaggtacgacactttagttttaaataattataccaacacataaaatttttaaggttatatttataactatatgaaaccattgtttgcagctttcagcctttaacctgctattaaaatttaaattttttaagttgatttagagagtttcttcgtcgtagttattttctatgattaacttttaaatcatgaataacatacatatataaaagttctaccaacaattttcttttttatacactgttttacgatttatcaatggtaggcgaaacaattagcctgctatacactttgataatataacatttatttagtatttatttttttataaaataagaggttaaagtgtaattttaacagtgtcagtgtcaattattcaataactaacaaagggagtacttcctccgtcccataaaaaactaaactagtactggataagacataacctattactataaatgtctattcgtagtattagaatatgtcacatccggtcctagatttattttttatgggtaaagtagtattttggagtaaggactggcggtaggcaggaagcccctccttcgtcagccagataaaaatatccaacagtacttaactgttactcgttattgttttgttttgtggtgccaatgttttcttcttggccttattccctccactactctctctctctccgaagcacatttatttttgggttatgtttgtttatgactgattgaccagcccatctaatcttggtttataggagatactaataacatatatttagcatcaagcagtactagctaggagtagttgtctgagttgatgtatataaaaaaaagagagagctagttttctgaattttgttgtgcaagaggagcaaggaaagaccagatagtcttcatcatgtggccactgcataagttcagttgtttaggtacccaagggttaactatagagggaccagcatcatgcatggtccatcatgtgatcttgcaagttgcaaaagccagatgcaaactgtatgaacattatttcgtattattaattaattatatatattgcccaagaaatggcagcacaggaaaagatctttatcatgtggctgcaaggaagccagggtggatgtgtggatatgtgcaacactactatacatttgtgccaaaaaggtcctaaatagattttgcttgcattttgcatgcgtggatcagtggaggcagaaagaaactgaagaaaagaaataaaataataagagatgtgagatcaccagcgtatgcatcatgtcggccagcatgcatggtgctgctgctaagctaaggtagctggaaatacttacggagtacctttttttttttttctcttcagccattcatttgttcattcatagcgttatccatgaaagacctggcactatctatctgtccatggtttccctaacatgggccaattttgccgcgatatccactcttgcagctttgatttgttatactgtattttacttttacttgtttttcacgaaagtgaggcagaagttctgtaaatatattttcttagaaagaaagtctttttttttcagaggtaaagaaagaaagttttattccagagagaaatattttttttcttcggagaaacacaattcaaatgcaaaaggtcacttgcatgtatgcacactcatctctaggataagatcttgttattaagggttacgttggctacggctaaaataatacatggataaggataaggataatatatgttgcacaattttttttaaaagaaagactgagcataacgatttcttttatgcagtatgaatactagctatatgcacatgcttcttaaaatacaatttgttagtaacaggtcaggtttgtgtagcaaaaacagatcatcattctcccttaaaagaaaaacaccctcaaaagaggaaaaacaaaaaaaaagaaatggagaggggccgtgggccatgtggagctcctccaataaaaccaaaagcactaaaaaaaaagccgaaagcgccttttgccgtcctccattacttttccccctcatcaaaaaaacccaagctacctcatcaccccaccatcaaaggcactgacatgtgggccatagtatgcaccctggcccacctgtcattgaccctcgttctccaagtggcacgagacggaataaactaaggcgggcgcgtgtatccggtacgggcacccgggtggttgtacacgaccgggtgatctggcggcggtgggccccacgggagggggattcgtggcccaggatcgctctccgcgcgctgactaggactccgaccgggcacgccggtcaccggtcaccggcctgacccggtaaagtaaaccccagctgcctctttgttgaatcaaccccttcactatctcttaactacaaaaacattctgttcttcaagtggatgctggttggtaacttggtacctattcccatgatccaatctggtttatagctttggcacacgttgaaaggtagagtcttgtatgggttttaagcaatatacttgtcatttataatactatcactttataatagttgggattatatagaccctaaatattaatccaccaaaatattttttttactctactattattttctccgtctcatgaaagaaaaaagttattttgtttctatatgactaaactaagaaatgatgtttagcttaatatcgatgacttttcttttcctttattacatacgcagtattagcaaatttgttagttgtctggatggcaagtctaagagcccactgttagtaaacattgtacatgtttaatgttgttttgctgaagtgttaaactaaacaccgcttgaatttaggtgctagatgaaaagaaatccaactttctaagaggctacaaatttattatttgtgtttgttacgcatatgaagaaaaactctcgttcatttatagctaggagtataaaaatacagcatgtcttgctacaattgtttttctatgaaagcatgtgaataactcatgtgaggctaatggaggcatcatgggccaagcatggctaacacccacgcggctataactataagcaatgcaagtgagagacccatttagagaggaggactaaaatgaaatttgattaatagtacaggggtgtttgtgcaagaaggaaagaggaaatctttttcccctttgtggtagcgttgccaatggcaaactccacttgtcggatctctctctctctctctctctccctctctctctcgcccatgtaccatctccatggacgacctcgccgccgcctcccctcctcacccgccgccgccgccgccggaatcccacgtgcctccgcccccgcagacgccggagaaggtgagctcgcctcgacccccctgtttctttttttcttttctgtttttcgtaatctcctctgttttcccccctttcagttcgtgaaaatttctgttttttatagttctttttggcgacttgattcgaggaaaaaggtgcggttttttttttatattccgagctgattttgcagtgttttgttcttgcgtgcgcgtgcgactgtttgtaattggtaaagttgtttggaacaacatccatccgtgtgttagctgcttcagttcttggtcagtaaggtatagataaaattgttcgattaatactgcaatatatggtcgaattgcatagtaatatcagctaattcgtagtataatcatgtgcttgatcttaattttgtactcgttacactccaatccttcacgtaatttgcatctttctgtggtgattgattagttaggcaccgtgacaacctttttggattaagcgagataattacaaaaaaaaccgattttttgatcgggtcttatggatagtaatagcacgctcattagctcaatttctacatgaagtttgggtagccagagcaagagagaagtccaattgtttactcaactctctaaaagttcttctgctcttgtgtactagtactattttgcaagcagctttcgagtactaggtaataggttggtgctgattctaagtagaaatctctcatggggttttctgaagttgctctctggtgctactctgtagacagaaatggcttgtgtagtttgctaccgtgatgttgcttgatttgtgctcttgcttctgcacagaagcacaaatacatttcaaatgggaatgcttatcctctagattctaactcagcttggactgatctcaaacatgaagtctgacacttgcacccacagagcagctactaggtctgagaaccatatgctgtaacactgttgggattaccaaacttcgttgctgtactgtagtcatgggaaactgatgtatgcaaatgatgtgctataaaaaggatccgtcgcttgcaacaaaaacaatagtcatgcccttaatcatccttgcaatcacccagatcaacatggagaatttatgccaccactgaaatccagccatgccttcctttgaaacaaattaatcaattcttttaggccatttgaactatagcaagctccttatgctaaccaactcttaccaaataagatgatccacgagagattgcatgcttagttgccaagaatttttgcccatatgcaagtaaggcatctattatagtattctgaagagaaggccaaaagtagccatcatttttgcttcgaggcctcaaaattacgacattattcaggggggggggaagagaaatatctatgttagtaatcacgacgagtccatattataactgcaattgatcaatataattgtatacaaaatacaattgcatttatggtaatataagcaatagctgtatattaaatgcagtcacttccaaatcttatcttatcttatatagtggaagtaacaagctttcttacacgagaacacgccacatcatcaaaaacatatcaaccattgaataaagagtttagataaataatagccattggatcaaaaagttacatatgcactaaaaaatcaacaatttgataaacatatgggaatttctggaggtttctagtgcctcctcttagacacatggtacaaagagagagagggcaaagataatgaagaaaacaaaaaccaagaagcttatagtgatttctcatatagtacgatttagttaaatctatagttagctagaccaagggatactttgtaaataaattaactcatgctaagaccttctgtaactaatagatcttatacagaatcaaaagtagcgcaacgcgcgactacgtggcttgtaagcattaatgtagctttgcgcaaaaaaacgtgggaagttcagctagttcaagataaaaattgcttgtagtgaatacggtgtcgtaaattcatattaagtgctgtttttcccaatgtgtagataaagtgcttgaatttgtataccatattgtttgatctagttttctaaaaaaaaatgcttgttgcttctgcaatgcaacttgttttactgagtcattatgtgatcgtcaggattcatgtgaggatacaggagacatgaggatcagtgaagaaaagccatgcacagatcaggagttagatgctgatcagatgaatagttctagctttaatagttccagcgagtgtgagaatcaaacacctagcaatgatgaaatgactggatcagagtccaaatctgaggcagctcaaacagagggtggtggatcgagtgaagagaaggtcctgaagaagccagacaagatcctgccttgtcctcgttgcaacagcatggatacaaagttctgctactacaacaactacaacattaaccagccaagacatttttgcaagagttgtcagagatattggacggcaggtggaagcatgaggaacctccctgttggtgctggtaggcgcaagagtaagagctccactgcaaattaccgcagtatattaatcacgggcagcaatctagctgctcctgctggagatgctcccctctatcaactctctataaaaggagatcaaacagcaacggcagttaaatttgcacctgattccccactctgtaattccatggcctctgtgctgaaaattggagagcagagtaagaatgccaagcctacctcaacagcacaacccagaaatggagaaacccagacctgcccggcttcaggaacaacttcagatagtccccggaatgaaccagttaatggagcagttagtgggcatcaaaatggaattgttgggcatagtggagtccctcccatgcatcccataccatgcttccctggtcctccttttgtgtacccatggagtccagcatggaatggcattcctgccatggcaccaccggtatgcacagcaccagctgaaccagcaaattcttcagacaatggaagcacagctagtgttcagtggagcatgccaccagtgatgccggtaccaggatactttccggtaattccatcttcagtttggcccttcatttctccctggccaaatggtgcatggagctcgccatggattcaacctaattgcagcgtgtcagcttcatctcctacaagcactagtacatgttcagacaacggctctcctgtcctaggaaagcactccagggactccaaaccgcaaggagatgacaaggcagagaaaaacttgtggattccgaaaacgcttcggatcgatgatcctgacgaagctgcaaagagctcaatctggacaacccttggcattgaacctggtgaccgtagcatgttcagatcattccagtcgaaacctgaaagcagggagcagatatccggtgctgcacgagtcctgcaggcgaatccagcagctctatctcgatctcaatctttccaggagacaacgtgatgtatattgaagaaatcgtgtgacaattgtagaacatgttactactataatttaagcaagtgctacagcctgaaggatgattggcgatgtaggcgctgctgcaaacatggaggcagcgtgatctgtactattgaaacctgaagagtactattcttgacatttttctataatttgcctgtggagcatgcaccagtctactgggttcatgatcaggctgtcagcatatgttttgttgtacaataataataattgttaatagctttgcctaaaggatactgatagtattctgctgatccttcagctctgtgatcaatggcccatatatttacctgacaagtttcagaaaggaaaaaaaaaaagatctgctgcctgacaagaggttcaactccgaagaaatggttagcatttttgtactgcgtctgcgtgatgtttacttgttgctttctttggttctctaatgatcccttagttacctctatgatgacctgcattagttgaagtacctctgtccttttgttcggctgtgttgcctttatactagcatctgtgtagaatgtagaccgaagtctgaagctttcctttttgattcagtacgcttattgtggatgtgacaactgaccagttttcatttccattgattgctttgttactgaatgttaattgggcacccttgagcttagactagcatgcattcatcagtcatcagtgcactcaaaaagtttaacctacttgttggaaaacagagtactcctagtagaaaggaatctgatatgataacttgataattgtatatttaatcctgtgatatatactaactttgggggtggtgttaacacaactaacgcaagggaataacaaattaaatagtctatgatccatgtgtgggcaggcaggggatgcatcatatgcatgggtcaagctcactgttttcttggtggctgcagtcgcaagccgatgttaggcaggcagcaggtatgcatcctaacctagtcgcagaagcaagcatccattcatgattcattcaaagtatgctccaattaaactggttaaaagattgtaatagcattctgtaagtaggatacttaaaagtgtagtggtttgactgatgcttgctgctgccagagttgggcatagaaaacacatactagtacattcgatcgatgaatttttggtactaggctagtagctaagctgggctagaattaagaaaagagagggagagttttaagtggagtggagtacttggtagtagaaaaacgaatgacacgcggtagcctccttttggttggtagaggtggtgagctcgccacttgcgaccagatcgaccgaccgatcaaccgctttagttttttttatacatatatataaaagctaatttctctctcacacacggttatatatacgacgcatgagttaccacatgaaatgattttatcaatatatagctatgcttggtaattcaggttcatgcatatctgtacattaatatattcaaacggccgggtgttattcttcagtgaataaaacacaaatattaggaaatggtaaggtttcgaacccagatcggttaatctatcatctgtgaagctagctggaagacctttgttttttacagcttcaacttttgttttgttttttctctcttcccttagcatagactagtctggctgattgcgtcgtgtaacgaaatattttttttcttctaatatattgacgtgcaatattttgcgtgtttgtgaaaaaaaagctggaagacatttggacgcttctcactttagtgaataatgatctacattactaatcgtactagtagtgcattcatgcatgcgtgcgtcaaacaaaaattacatgcatgagggcgcacgcaaattaatttgcttggcgatcgagacggctatatatataattgtaaaatatacatatataaaatattctgatataaagatcgagaacgggatacatacaagtacacacagagatcgaccagctagatgaaaaacgaatatagtaattaatcccctctctctctatatatatatgtatggccacagaagtacacatgcattatctgtattataattaactagttcgtcgctgcaattgcattgtatagtatatacttgtactatcgtgctgcttggtcgctagaatgacgatcaatggatcgttcatatatatgcaggctcgtcgcagtgacaattgccatgcgtacgtgcagcattcatcatctgctagctcgatcgatcgcgtaattaaccggccggcacctgcaaagcatgcgttgcttgcatatcgatctgatccaacggacaaggggtacctaaatcttgctgacacaatacgtacgttgccatcgatcaatcaatcgacgaatcgctcaactcgatcaagacgacctcgtgacctgtcatatatacatagatgatgcaacgccttgttaattaattgactatagatcgattaattaattgttctgtaagtaagtaattaattgacagggtatatagctagttagcttagtgacgtgcattgtgatgacagaatcgaattagaggagttggagctagctagcgatcgatcagggctgagactgaccaggaagtagctctcgcccatctggagagaatggaggaggatgccgtactcgttggctggaagaagagcacccgttgaatgcaccagcatcacgtcctgcccaaacattgatctcagatcgatcggtccccttggcacctccgtcgccactccgttgatgaacaccgtcatcgtcgctgcacatatcatattcatccatcatttttctttcccaattcacattacctacatatctaatgtcacttcggacaaggactacttctcaattattgcaaaagtactactcctactacaactggagtgatatatacagtgtacatatatatgatcgatcgatcaataggtggctttacttgatgattaaccaataataagtagtactaccattgatcggctggccggtggttagaaattcagtgtcctagctagtatcagccctatgtctaaattatatgtatactcatgcatatctacaaatccatgacaaaaacatgcatgcatctgcataattaagtacatatattgtattgcgccattcacgcatgcaacaattcaactactagtattaattgcattatatatactccatatgcatataatgtagtacgattatatatgcatgcatggataaattggcagtattagtttatttagtatgcatgcatgaagcatatttgctactactaagataaaagaacaagacaaagctttgcccttaattctcttatttcagtgtagtacactagctagtactgcgtaattgatcgttcccaatctcaattaccgcaaaaatacaagtgcaaagtctcaaagacattcaacgcggaagatcaaaataaggacaaattaaaattaaggaagacaaaatatgagtttctggaagatgaaacgatcgatcaagtgtatatatgcagtaatatgatcgtatgtacatgtcccttaatactctagaagagatcgatcgaagcaaagagagactgaaaggaattttctttctctgaatttgtactaggagagcaagaattattagcaccaaacggaacaactaattcccctcatcactgcatctgcatgcgtaattaaacatgtatatatatgctaaaaactagctatatatgtgcatgtttagttagagagaaattaaaggcaaattaatcaaagcaccgacgaatggaaattggggggacatgcatcatgtatgaagggctcaccaggttgacacgagtagtagagctgctgctgctgatgctgaccggcggccgccgacgacgacgagccgccgccgccgtccatgtaccccatctgcctcgagatggcgaacaggtcgtcgccgccgcccccgtagtccacgtcccccatcatcatccccaccgacggcggcgaggacggccacgatgaggacgacgaggagctgtacccggcggcgccgtgcgcgaacatcccgagcgacgaagccggcgagccggcgtggccaggcgcgaggccaccggacgaagcagtcggaggagatcccgacgaggcggcggccgcggccgcctgcgcctgcgcctgcagctggcgctggcggcggcgggagcgcgagcggcggttctggaaccagtagaagacgttggcgtcgccgacggcgccgaagcgctcgagcagcttgcggatgcggacggtctcgtccttgggcgggttcaccatgccgctgttgaagatggactccaggatgagtatctgctccggcttcggcgtccaccgcgacctcaccggctcccccgccgccgccgccgcatgcctgtccgggctgtggccgccgtccatcgccactagctagctgccttgttcggtgtcgaacacctagagctcgctagctcgagagagatagagagataggtttggtcaattgatgtgtgcttaattcgcttaattggcttgctgcgagagagtgagatcgccctacttataggagaagaagcagctagtagcttagctaagctttgatagttgtgatgagtgagatggaatctaagtaaatttcactagtgatgagaatatgaatgaacgaatggcacacatgcaaggacgacactagtgctgctagagaatctttaccgccgctcttagtattatatttgcctccgaggctctccgatcaacttgtgttggttaaacatgcatgcattgctgtataaatttatatattattaacatgttctagcttgtcactctttactttttggatggaactgaaaatggtgcctgtcattttcaggagagtccatggaagtgacaattaatatgcatgagaagtgtgttgttgttaattattagttggagtacatgatgtactgtatatgtcattttcaggatagtcctccatatgggactataagaatatgaagagtgtgtgttgctgctaattattatttgttggaatacaaatatacttagttgaactccatatatatacacatgtaccatgaattgtgacttgtgagtatgaaagcaatgtatgcccttaatcatgcgtgtggctgcagagatatatttaggatgtgtgtgatgtgttgatttggctttggtatcggatatataattgaaggcacgtgtacattaatcggaatatccctagtatttggacctaagggatatgagtgagtccgtacatgtacggtgagtatttgttgactcgctagtttaaccacatcctttcaatttttgtgaaaaggtgcattttttgttctgaaatggagttgtggaacagtctgaaacccgcttcatgtcgctagttcattatgtgatagcactttagtccctccgctttctttttaggtgaaattgaaaccgtttgatggactctagcttcagaaaagatgaagctggagctgaagttttaccaatcagacataaatgaaaccgcccccagagtagtacttggtgatggagcggtgtttaaaacctgccgttgtctggtatgtatatcttatgtggcatgtgcaggcacatattgataaagatatgatatgtacaatgccttttttttctaagataatagaggttttattaagactcagtcaattacactaagatgatacaaccgcactgaatcctcccctggtctctgcatatgatgcatacagccaaatgaaccaaaacaccctttccaagcataaaagaacatgtagattaatgactatcaattatccgtaaactagatcgccacccatattcatatgtataaaatctcttgtgccacctgatccaactatcatgatgccaccataatagtattgaaatcccggtttatagaggatagccacgtagtcagcggataaacaatgtaataacatgtaaatgagaagacatcatcttgttatatataaaaaaacacaccaggtacaatggcgcttttgtgttttagtagcaggcagctagttagatcatccctgcttccgtgaggagagtgagggggagctacagacaatggcaaggcgaaagaagaaggagaagggagcgtggtggaaacaaaaagcggctaaggcacatgcatgtggccttggaacggggaacacatgtgccccacggtttggccccctgcattgaccctttctttcctctctccctcccctgccggccgccggcatctaccttaccccttacccttagctgcattgatctcgacgtccgggtttgcttcggtccgcgtgtgatggatcaggcgagcccggagaaatttctcctgcatatatatgctgccgctttaattttctcctgccagctcgatatatcgatcgatctcagcttggttgcttgctgctgctcatcatcggcacggcagagcatttgattgggccatggatcggttttgcttggctgtttgtgacccaagctaatctatagctgcaatatttctccatcagctgcatgactgccctgcggccgcgagcatcacctgccctgcccttggcgccttccgccggccggccgtcgtgtctgctttgcggtgcggtgaacagacagcctccactgcatatgctcctcgatcaaggaatcactccactccgatccccacttcatgtcttcatgcatgcatccatccatccatccatcagagacacacacacacaccatagctatagccgcctgcggcctagctacatccatcgtcttggcttgcttgctccctgacacctcctctcgacccttccttccttccattctttactctacttaattctttcatccatgtaatcggataccctgccctgcccatgtcgatcctcaccacgtacgtgtcttcaccaagacacctacataataatatgagtaattctacggttctcgaagaggtaccaaaaatttaatgtaaaatttggtatctcattgtacctcatagtacttaggtgtaaagaggtatcgaatttacaatagaaaaatggtacctcctcaagaacgataaaattgctctaataatatacttatcatatactatgaaaacgtacgatagatagatagatgcaccttaagcaagtgtcaacctaaaccatgaccattaaattaaatactaatatacacattgataggcagtctaaagttagcagctgctgcccgctgccacatcacatccatccggatcgatttcggcgctggacaaaccgtcagtggccggccgaaaaaaggaattcccatctccttcacctccagcttcttcagctactactcatgttaccaaaccgaactaaaaccaatcaggggaacctgcctaacacctccactttaatctgcctccctccctccagtccccagtccttgtttcttaattactgaaaactaacactgcaacttactgcttccgctcttcgtaaatatatacacaatataaacatttttaattcatggaaatctatgcatttccagccaatcatgtgcttaattataagagaaattcaaacaattcagaaattaaggtttgaccatcaagttaactaaaaggaaattgttttccccaatttaaaaactttgctaaataacatagaatattgtatttatgaatggagggagtattcatttactacatgcacagcttcattaggagatattttttttagaaacacaatacaatcgcatacgctcacaacgtactcacactgcactagtagttaaaaaggccacacatttcattttggatggtttaggccaaacttatgacaacttttgagaaaaaatgtagtgcaaatctcatatatagtggaaatctggaaactatcattggatcttaaaaatgaacgcataggatttgtccatgtcacccagagcccaaaaaaaattttactcatggttaaattcaggagttaaatttttactctgggtaatgtgggcaaatcttttacaagcaatagtgcaatagaaaatcaattagaacctgaagaagctgtccattttgatatccaatggtaatttttaggtttttactacatatgtagtttgcactacatattttcctcttttggtatgataatacattagaatttttttaataataaaaactatatgcaccttctgcttctactgttagacacagggtcaatatatatattggcatttgcatacatcgtttatacaataaaaatattgtgtgcacagaaacgttatgtcgctagcgccaacttgtttctttaaaaaaaaatctcttgagacgggctaataaatttagcaatatatcgtataccaggttcatccgtgcaaagaaacccacaatgtttttctaaaaagaaatcaagatgtgacatgcagtgccatatttaatgtctaataattgttgtatcgcaagaggctactctaatttctgatatattttgagcttgtcttcctggctagttgctgacagagagaaccgttacacatcacctctgcttttctgccgtgcaaaagcccgccacggttgctattaatcaactagctaggctttaatttgggcaaatgcatcgcaccatctctatacaatttgtcggcttaatatttaacaaactagcccaagaacccgctctgctagatttgacaatataacgaatgtttcttgaattatttagaatacgttcacagtacatgtacatcagttgtacccacccatgaatatgtcttggtaacacgagcttaatagattgatactcacaaaatacctattgagagtgtgatcgtcactaactgtataattatattgtctcgaggtccatcttgttccctgtcgttaccagctagctaaaaacagagcaagaggataacattgtttggaaattgcacttgcaggacatgcctatacatgtagagtaaaattggtcacagctattacaatcattgcccattttcgtaataaaatttgtgaacaaaaacagattgcaaacaccgttgcaaaaatgaaataaatatatatataatcaccgccctctctttttgtccattacaagagtgtgaaatgactggactgcctcatttattctaggaagagagcaataattctggcccatggtaggccgattttaacaaattagtctgtgttcttccccttctttctcaactcaagctcttccgttttcagtgtgcatgtttttcaaagtactaaacggtatatttttttcttttttacaaaagcattctattggaaagttgctttaaaaaaatcatattaatccattttaagttttttagctaatacttaattaatcttgctctaattgtttgctttgtttttcgtgtcaagagacaaggttggaaaccttacctcccgaacttagccttaagctgcaaggacattcctggtgaagagttttattttttggttttcaagaattccacacaatctaaagaggtttgaaatggtgaatgaaacaaacgtcttcaatgtacggtttcatttgctagcatttaaatattaaatggtgtgaaactatttggttacaataagttttttttttcgttttcaagattatgataaaatgatttagtcccaatgaagtttcattctattactaaggcataggtaagtgtgtaaaccgagtttcatctttcttctctctcttcataagtttcttaatatgttactcctccgtcccaaaatataatagtaacttgtaggttgctatattttcactagtacaataacgatttttccatgcggtcgaagagtttgcgaaaatccgattttttcgtgcggtgacacacccgcacgaggaaataaaaaatcgaaacaaaaaaaagaaaatcaaacgccaccctggaaccctaatccagccgccaccgctggcctgccgccatcgtccttgtggtcgccggtgacggatctagacgcccgaggctaggagaccgctgccgccaccaccgtcgtcaccgccctgcccgagacccgccgccgtcgtccctgcggtggtcggcgacggatccgccctccccacggtggctggcgacggatccgctccgcccgccaccaccttagccgatgccgccgccgctctcaccaatgccaccgccaccaccgccctagccgaggccgccgccgtcaccgggagtgggtagagggggagggggagatgggaggagtgggaggagagatgggaggatgagagggaaagggatagggagagagagtgggagtcagggtttacgttaccgccggtaaccgcacggttaccgggcttaccgcaggggtacggtaatagaaataccgcgataacctccttaaattcaaataaatttaaaaaataatttaaatttttgataaattttgtacggttttgtactgtttttctcggctaccgcagttactgtgcttaccgccggggcgctgtaaccccgggcccggcggtttgggaaaccttggtgggagtggccaagtgggaggatgggaggagattgagtggcgccgggagataaaagggtgggtgagctatttttgtgtgcgggtcactttataggtccgcacgcaaaaataagtctattttcacgtgcaaatctgttaagaggtcctcctatgaaaatttatttttctatacggtcattttaaagagccgcatgcgaaaatggagcatgatttttgcagacgcgaccatttacggtccgtctgcaatctaaagtgagttctgtacaggaaaatcgtttctgtactagtgtttggatggaggtggtattaatttagcctatgtggtattttatttaatgagattgaaattcttgtgaaacctgcattgggaatgatttaacctggcctagctagagaaatgcattccctctgtacttaaatatataaaattgttagattttattcaatctttggtgtgcactgggaatgaaaattttcagaataaaacgataatatctaacaaaatgatataattttttactttctctgttttttacgatacaatattacaactcttaataattgtttaactgtgacgtggtaccgaccaaaatcgctcgacgccacaagtgcataactgttggagtgttggacttgcgccttacatgaccgagatgaaataattcacgagtgcaggaggccggagcattaaaccacatgtgtgtgtacacttagctttaattgtcggtgtgttaggtaatggagtatcctttaagctgccacttgcattcttaatgaactttaggaggcatgatgatgcttaactttaatccaggataatattttggtggctagcggattaatgagtgtctcgtactaaacttaactgcacacatgcagtgtcacatcgtgtatatacacagttacgcacacactcctaatcctaaatattgcggtggaaaatgaccggtgcaagtatatcaaacaatgatctatctcgatcgtgtgcactgtgtatatagctagctaattattagggaaactattttaatcacttgaggagatatccactcgttgtttgcatgtcacttaaatggtcatgaaaaaattgaaaaaatttgagaagaagtattaccatgtgatatattactctacaaatatacaagttcaaatttaacttctatatctcgtaaaaaaacaattttgactatgagaatacgttaactagctatagtttaattttttttcgatgcgagatgtagaagttaaatttgaacttgcatgtttgtagagtgatatatcacatgttaatatattttcttaaatttttttgagtttttttataaccatttgagtaacattcaaacaatgagggggcatctcctcgagggatcaaaatccactcccctaataattatggtgtagctgagttgctggaacgaataatccgtactggcacacagtggcagatcaagaatttgatcacgttgggctttaggccctgtttggttcacatggactaaaatttagtccctgtcacatcggatgtttgaacgctaatttagagtattaaacatagagaaaccattgacagatagatagtgcctggaccttcttttatacctcaagggttaccacatgggcccaacaacctaacttagtggagaagtatgacaatcttttcattcaatgcatgtcttattccttgactcggaagccatatccacgagcgtcacagcatgggtcccatcaaatcacgctacctgacacgggggatgcccgtgtcgctcgccatttaacgggtgaagacttctgggctgatgttacatcagaaaacgggaaccttgctttgatcagagaggacggaccgactctggctgggatgagaggatgagaacctctcaccatcatgatttgatgggacatggcaggctgcacgccacctgatacacgcggtcagtgagcaggcacactaacccggtcccatccgtcattcgaccggtcacacaccggttaggcgtgcagcacatcacattaaatgcggcatggcacgcccgctcaatccgccttaaatgctgttaggtgggcgttggggctgcccacctaatcccgtacgcgtggcgtgctgtggagggggtcggggcagcccgacctccagccatggagggggcggccgaccctaccctgggcccgacccccttcaggagagtgccacgtgagtatagggggcagcctcctcatccattaagtcttcataccctcgggcgaggagggggcagctgccactccaccctaggcccgaccctcatcgagggagtgccacgtgggtatagggggcagcctcctcccttaagtcttaataccctcgggcgaggagagggcagccgccactccaccctaggcccgaccctcctcgagggagtgccacgtgggtttggggcggcctcctccctccaaacatgatatccctgggcctatatcaccgatacaactctatttaaattcgtagtactagaattaaaaaaacacaaatattaaaagatctaatatcaaataaatagaatagatgagagacttcaaacccaggccggctagcccaccatccagtggagctagccggaagacccctgagcgtttctcgtagaatatgtcacatctcatattagatttatttattttgggatatagtgaatatttaacaatacatattcaagtgagtttcattaggccttgtttagttcccaaaacaaagacttttcacccatcacatcgaatatttgaagacatgcatggagtattaaatgtgtaaaaaaaccaattacacagtttgcgtgtaaattgcgagacgaatcttttaagcctaattgcgccatgatttgacaatgtggtgctacaataaacatttgctaatgatggattaattaggtttaatgaatttgtcttatagtttcctggcggaatctgcaatttgttttgttattagaatacgtctaatactttaaatgtatgtctgtctgatgtgataaacaaaccctaatttttttccccaactaaacaaggccttatttggaagacgttgcaaacacagaatctgtcgtggtacagaaatctggatcaggagatggaagtagtagtccctctgtcccattttaagttttaactgtaactaactataagtttctgtatccaacgtttgacctttcgccttatttaaaaagtttatgaaagaactttaaaaattaagtcacgcataaagtactattcatattttatcatccaatagcaataaaaatagtaatcataaaaaataaataaataagacggatggtcaaacgttagcactgaaacccatagcagcgtttattatgggacagagggaatagaagtgtagaacagttggacagcaatgggtaacggtaaataggggttaattagttggcgacatatatgatgctgcagcctcaactaacagacgacagatatagattcccatggatggatagatggatggacagttccctgtacacacttgtgcagtagtagagttgatttgtgtaggaggtgatggcgcgaagacaacgggaagtcgcgggcggatcgatcagatggagctagtgataagcactggacaagcatgcttgctggatccaggatccatggatatggcaacgggccaacacagcacgagctcgctgtcgcgtccagatgtgcacagacgacgccacacccttgtatccataatgcgtgcgtgaccctgatctctctccggaccatggattttcaagccgttaacacaacggaaggcactagcgtgttcaggtaagttaggcagagcagaggacgctctcgtgtcgctcggccccagagtggcacggccagcgatcagcttgttgtacgggtaaatggtagaaacgttaaaaatgaaaaaaaaaaaatggatcagatgaagtcggtctgatcgatcggattgagcacgtcggtctaaccgtctcctgttgctagtccaatctactacaagtcatcaaaagcaccaccgaccgaactgatagcccgatacacatcggtctgaacgttttcgggtctcagaaaaacacaaattgaagagatcgtgctgagatatcttaccatgacctgcaacaaaacagcttgagtcaatctataataaattaaatgcgatggacaagccccaaagctggtacaccgcaccaaaagatgtgggccgcatagagtacaacgacagcccttctcagatagtcgaggagttcccggagcaaaccacgtggaatgtgggtgcatcttcctccccggataaggacacacgtctagcccaagaaaggatgatccacttgattcagccaactataccgtaaatacagaacatgtggttgttcctggatagactatactttggagctattctcgcaaaaagcaccgtgttagttttcggatcgtcaaccgaccacttccacaccccatgaacaagccacatccgaacatccctggctcaccgtctaggttctcgggtgttttagccctatcgtggttccgtggttatggtagcgaggaggcgtgtggaccttcccgctacgtggtaggttagtgcctttcccgggaagacgttggcccactgactgcacaatacgacacccttccttcggaacaaacaaaactggtcaaataagtttctccttggctaggatgctgacaactatggctctagacaacaagatctacattacgtatattgaggcggcacgatccgacaaactctacgggcatcgcctctccacctctctccccctctccctctccacgcgctacaatgataagttgtactacggattggacgagggggcttagtataacaaagatctagtgacaaggagcttgtggcttagatgaagcatggcggtgagcgaggatggggcaaggagctcaatgatagagtcgtgctagctgcgagctaattagatctgtctagatttgttgatctttctagtcattgtttgtggttataacgatgacaatataatccccagcgccacttcatcacgtcggctaccgtttcttcgtgtctctcctaaatccaagacatatgcgagatgatgtccttcccaaccaacgcggctcgctgccatggcttcacccacggatggtctcatcctgacaagacacccgtgctctctgaaggacacgaggagccttgtaagggaaaaaaaactcagttgaattggagccataggtctggtttagtttccaacttttcgatcacatcaaaacttttctacacgcacaaacttctaactttttcgtcacatcgttctaatttcaatcaaacattcaattttagcgtgaactaaacacacctataatccgatatggcgagctagagccacttgctacttcggtgcactaatgcactatggatagcctcaggatggatgcgttgaggagtaaatcaggcggaactagaggacgaaatgacaatatatagctagcaaggaagcaaggtagggaatcaaatcaaaccatcaatctcagtggaaatctcctagcagaagcggtctaatggcagaggaggaggtacgtacaacaccctggtggccagggcaccggttgctccccaaaaggccagcacactagctgctcctggtgacccagctgctactgaaaatttatttatttgttagcgagagagatctaacgccggaggtgagacaaggaacctgagggccgacttggtttttgttttgctccctgcgagacgacgcagcaagaaatgctcatcagtgtagagagcagagacaaaacaaggtgacccctcattgtttttgctagtgtacgcgcgtggcggggcatcctatccttcgtcctgtgcactgcttttgcgtgtgactatgaacagtctagacttgtactcattgataatgtacagcttatcatcatatctgcatgctcaggtagtcagcaaatgctgcttggcctaatccgtgttgtgcccatatgctatcagctggagtagctccccctttttggccattaaaacgtaggtacgtgagccctatatacctacttaggcctctttgaattggagaaaaaacataaaaattttggaggatttcaatcctatagaaaaatttcctatgaagccctttgaaacaaaggatcaaatcctatccaatcctttgaaattcctatggaatggacaatcctatagagatttttgaggaaatttagcaagagcttcaacctcttgataactttcctttgagtctatctctctcatccaattcctacgtttttcctgttgttcaatcaaacggttattcatgtgtttttcctacgttttgcaatcatctgttttacacttacattcctatcaaaatcctacgtttttcttattcctacgttttctcaatcttgcgattcaaaggggcccttactatctactagtactcactctatcctttaaaccatagtgcaaaaaaccggaccggtgagtaacccggacgatgcctcggttcaccggtccgacggtctgaccggtgaaccgccggttgaaccgcggctcaataagttattatatacaacatgtatatctctaaaacaaaacgaagcaaaggtgagatggttactcactctcaatgcgcagacccaggttcgaatccccatcccaacacccttttctatccattttgtcaaaaaaaaaaaaaacagccacgtgggcctgtagggcatggactgggccttaacgtggcccattaaactcctttgtccggtccaaccgactcctttgtccggtccaactgagccggtttaatggccggttaagtcaaaaaccgcccggttcagccggttcaatccgggtcgaatgcatgtccggtctttcagttgaaccaagccgtggagacctctggttccggtttttttgatcgaaccgtcggcccggtccggttttttccactatgctttaaatacaaaattcaacttatagagttttaaaatttattctaaaataaatcaatttctactaacttactacctaccaccaatctgcaaatcaaaaaaaattattaattcaatatcttttacctatccattaacaaatataatttcttcattaattaagggcattgtgatattttatttctctctttaaatttttcttgggaagttaggatttaagtgtttatgagacggagggggcacttcttttttttttgtggtagcaggtgtacaatcgatcattgttcctcagaaattcaatgcatgtttgtaagttaaacaatatagtgacaatggtacagacagacagagagacaacgtccagccgggtgtttggaacaaggatagatatgtggcaagcatgcaatgcattagctcacaagctgtccatgttattcctggaacgatcaaattcatgcatgcatatgcagcagcgctttacatctcatgaaaaagaagagagaaaagagagatgcttcagcatcagacagagagagacaggtttgtgagatgaacatactcctatatggagtagctagcttgccgtgagctagctaccgatcgaggccgatcgagatagatagatagctgtgtcgcggtgtcgcttggccgcttcatcatccactcctgacgccacgcacccatccatgtgctctgcttctctcttgccgtcggcgcggatacctatcgctgttaaacacttgcattgacatcgatcgatcttaattcgttggtttcctgcataattatattaaaagtgagcaaatgaagaacaagcttagctaggcagggtgcagttcagctgtgttgcagggccggaagttaagatctaaaagcaggaaaagaatggactgcttgtcttgtctgctttctcgctgcctgtgagcttgtgaccacagtccacaggtagcaagcggtaccgttcattctcgtcgtagaaaataataaaaaaatgtcagttttgatcggttgtcctacgtaaaggattagccgctattcaaaatttaaatttaaaaacataatattggagttgattttaagatatactcatcctatttttattagcatttaagttgctaaagatctatgcataaaaattatactcataaattattttttaataactaataaactatttcgtttataattgacccatagtcaaccgatgaacccttagacctccgttgaactagtacaattttaatcactagttttgatgaggatatcactcttttggatacacatgttactcctcaagttgttttgcaatgtccaatcagtagagctcacgcctgacaattaatttacaggtgagcctgttcctaagtacttctttatgtacttttgagaatagattgctatctaatgatttaataatggttagaaactatgaagaaaaccatagaacacttggagagaggttaggagatggataaggtcatcatggacgttcaagacaagatggaaatccaactcatataaagttcgagtccacttcgggctccaggagcagtccacgataaattcgttgcccatgttgcattcggactccgatttcgacgttctacatatgtatgtaaagctaacgaggccacatttccaatagatctagtcccatgttaaaactccatccaagtcaacggaatcttcgaaacaagaaagcgttcagaatctgtccgggtgttgcgtcaccatctttgggtccattgggccatgtatcgtgtcggagtctaataaggacgcattcagggctctaaggtgaccctagaatctatatattcagtagccgtcattgagttagggttgtgttttgcttaaattatttctgccttcgtagtttcgtcaatagatcagtttgtgaaaccccaactttgagttcttgaataatcattcatctacaattgattcacacacagggattagccttctcgatgagatcaatcgagtttcgccatggttgataataagaggagacgtggtgctgcaattgtagggttcggatcgtgtgtgtcaaattttcaccaaatcaatatttatcttcacctgatcaaagatcgggcatcccgttgttatcaagttttatgtttttaagaacccaataaaattatggcactttttcaaatgagcaattttacggtactttaggatgtaccattttttctattataaaatttagtacatcttggtatctaggtattaaatttttagtacctcctcaacaattgtaaatttgctcttttcaatatgatatacttataatggcataaatcaaatttaccttattgcgttggctttggtatgatttcttttcagccttcgatttggcagagtagcaaggagctggataagaaaggaacgaacagacggtgagaggggaaaaaaaagcactgaagcagaagcatggagcagaccgccaccggcagagggtagtaaggctaaagctatttagattaggctctcctctcctctcctcttcttctttcttggcatgtctccaaactgaggaacagcccgaggtccacaaccacctgcatgcgatgcgcacgacgtcgtttccttgttttgtttttcttcgattctctcacacactattagtattatagctagccctaggtctcatggagaattttttgttcttaattaagcaaaagcaaattctttacgagtatctgtcactcgcacgagtcgaatcgatctccccttgccaattattcgttcgacctcacctttacctgtttttgttttcagccgtcttgttatatactccctccgtttcaaaaatgtttgacaccgttaatttttagtacgtgtttgaccattcgtcttatttaaaaaaattaaataattatttattcttttcatatcatttgattcattgttaaatatactttcatgtacacatatagttttacatatttcataattttttaataagacaaacagtcaaacgtgtactaaaaagtcaatgttgtcaaacattttgaaacggagggagtatattctactactccctccatcccaaaatgtttgatgctgttgacttcttttaaaatgtttgaccgttcatcttattcaaaaaatttaagtaattattaattcttttcctattatttgatttattgttaaatatacttttatgtatacatatagttttacacatttcacaaaatttgttgaataagacaaatggtcaaatatgttaaaaaaagtcaacggcgttaaatatttagagaaggagggagtatatgtatgtatattgctcctcaagcatgcagcagctaatgcgtcggtaacacgacaattcaaaataaattattgtttgtggataaaaagtggtgccggggaaaagcataattgtcgggcagcgtggctcatctcatactagttactccctccttgcacaaatgtataatgttggttagttcgtttttgagctaaccaatgtcaaataaaaaaatatggagggagtactttgcaagtttggagtttcatcctgtgtctggccgtatgtgcgcgtggcgtagtcagcgggggcttaatttggccgatgtaattttcaactgcgggttggttaatttcaactttgtatacttggccatttttatttagccttgagggcaccggtaaaaatgttaaattatgtattgtacacttttaattatgtagccacttaattgaaacaggtcatcgatcaattaggtactgggcctcgaatagttaacgggcctgttttcgtctgaaactgggccgtgacgtcattccactccgggattaagtccacttggtgtcccttatttttccgtcgagtttaaatcgcattcctaaattgcaatacgagaaatcttgagccaccaacttataaaaccacgttgaattagatcccatagcaatatggatggctagtttcgttgatgtacatcctaatcaacaagaaaaaaaaaaaagaaatatgtgtgggcccacatgtaagtagccaccaccccaccttcttcttccaccatctcgtccatcaatctcagccttgtggtgagctccgagtgttggacctcagcctcgtgagcgagctggagcagcgcgacctggcaaccattgcaactaactcatctcatacgtacggagacaagcgaatgaaaacacgaacccgaaaatctgttgcaaggcctagcactgggccgtaagatgctacagtctgctgccgcaagccatttctccaatgggccaatacattgtacaatcccatgatgggccgaaattatgccaggattaggacgaaccgttcatgggcctttggtgggccgtcgtaacatgtcctattgggctgtggaaaggatttgcttcaaatccgtcggtgccccacatcagcaacactacaagctagtagctagcacaggttctgttattcgttttttacgaaacgcggtggtgattgcgtcggtggcacatgcatatgcatacgaattatcttctcttctcccacaaatcgtgcatacaaaggtccagctgctagctagcgatctgaccaaaaattcttccatattggtcttgctttttggatccacagatactagtagatactccagtatgagtatgggtcaaagattgaaacaaatctagcaatggcgtccaatttgtctgcagctggcacacgcacacgcacgagcccaaccgtccaaaccgcacaagtgacggtcaaacgcacgcacaaatccacgatattacgggcattatattgctttccaggacgcgcgcacgaccgcaccattctccaatccacgtacctacctgctgcttttacgactacatactttgggaatctcatgatacccatattcccggcagattactactctttcagactgtcacagtttcatacactttatacaatctgatgtaagtatataatagtaatatatactagtatactactcctactactgctaatttctgtcagtgtagcacgcagaattgcaaaccacaactatacaataatcctgcctgaaaacgcgacactcatttataggccggtcaccaactaacatcaatcctagcctatactactttattagttattaactgcatcagtgtgtgccacggataaaataacatcactcagatgtggagtactagagtcatcaggtagaaaattccagccccaggacaaaatgtgtagtactaacaaatataattaagggaaataaaattccgaacaatcttatcaaagatgacacgagcgtaccggtggccaacttccttttattgacctgtgccatatatgtgccggcccattcaggttcactcaagtcatatcaatatatatttgacaaattttgttaggtagcataaataatatatgggcaagttgattaacaaaatgacgacattatgatcaatttttatatgttccgactaaactaattatactatagcgcgatgcgtattgtggcgacaatgacgcactggtttgagagaaatgtcgtgtcaatgcctcaatgccacgtaacttcaatcaagcgtacaaccaacctaccaacacgatcacgcctataccttagtaattaaaaaatgtgatggagataatggcaaagagcaaacatgtcattgccacatgtatacactggtattactatataaagaaactaagtgtccatctgcaaaccagcagctataatatgatgcaaatcaagtgctttaattttactaatttatcttggagtatatatattgtattcctttttggaaattgcagttaaagggtcgtcatgtttaattatgggcagcttcaggcataggttgttttcagttaactattccatctttctaataagttgttgcggtagcatacatattgaaagatttgaacattgttgctatctgccaaaaaaaatatattgttgtaagctccccaatgatgcactgtttttgggcattataacacatatataatatttttcatacaaattgtggtacgtggaaaaatatagaccacacacgtacatatgcatgtttctgtagttagctgttgcgttcatctcaaagcataggtatggaattgtacgctgattgcaactgtattcatttaatttgagctactgttgtgatgacagaaaaagaaatctctgaatactgctgcccaattatgcgtttgatgcagacattatcgtccactttgtttaattccttcatccagaacattcattttgtagactattaatttgtcacgcgccgttttttagtaggacgcattatatatacatgcatacacgggacggattgaggcgtacaagtttggacacaggataatatcccttcttatgggtgacgttaagtatagtatatacatatttgtgtccagatcagccatatcatccacaaagttcgaggcgctgaaacatgaataaatttgcatttgtgtgaaacaagatatggcaaagaaatatcatcagtacatgcaaataaattaaaagcattttttgtaaggtccagaaacgtataatatctagctaatgttcagaaacttcagagatagtgtgacacacaacaaacagatatattagatgctcgctagcctgttacgcagatagaaacaaagtcgagtacagctcgatcgacacgacgcacattatattgtggcctagctaattaagctttgcaacgacacatgaatttgcatatagctagccggccaaggcagcgtttggatgtgatatataagaattaaagaaaaggtgtgtacaagagatcaatagcttggtgcgtcatggcgttagctaagctagcttagctagcttctcttgttggcaacgagttgcttcagtgtgttggtgaagcacgtagatcagctagcccatttgccaatttcttttcatactaattagcatctactacatatataatagtagcagtgttaataatgtccatgactacgacatgcacaccatgttgtgtatatggtaattagctatagaggatcaattaattgtttaaacagaaaggggttaattaattgatactacgagtttagcagagaattagggcggagacttatgcgtgtttgcagcgcgtcacatataatttgggcgcattatgcagctatcgagctgaatgtctgatcggacgagatgatctggaccgttggatttattcccacgcaacgtactggatctgatctgatctctatatgggacgatcaatcatatcgcttgaattattgctggtggctagctctcatatatatccatccaaaatattgaaagcgaactaatgttgtgttgatgtgagtgtagtaataattaagaaatttatatatatgtatttacagatgcaaaagtaattaatggttactagctagctaggtgatgagtccatagatcgaaatgcagctggctgaattaacaagctacgcgcaataattcttttttgaacagagaagggaagatggaattggaccatgcattattatcgttgaatatatactgtttgagtgtcagagtgtagcagtatgaactatacgtgagatgagcatgcaagcgagagtgaattatacatgcgtggatcaaggaggactaatacttctctgggagagaagtggcaaattaaaacccaacacgtgtgtcataatcatacacatgtgcatgcttagcttgcacatagccggcagatacgacgacgccactgcgagtccttcttagttagccctctttaatttggaacaaacgaaaaataaaagaattttaaaagatttaaatcttgtaaaaaaaattctacaagactctttgaaaaaaaaaagatcacatcactaaaattccttaaaaattcttatgttcaatgggaatttcggtggctttatatctaccgcgtacctctctcttctaaatattggtttttctatgctgcgttcgaacggtttcttatatagttttccttttatttattatacttaagaattcaatgtttaatgacatttgaattctgtgttttgagaatcctatgtttttatacatttcatcggtccttgcctgcatgcacacatcaaactagagctagctagctggccgcagcaaaaaccactacttgcatgatctcttgtgccacctgtatgcaggccgaccgtcagtaatattttttaggccatgtgataaatgttaaagaaaaccttatatttagaaaatactaattgtataatatatcagggctatatatatattgagatgggactctactaccagtgccattttctttatatgtattgcagccggtggccttctaaccatattaaaaaaatgctaccatatattaacctaatgcttctttcttttatgtcatgctaaaaaacaggaattatttgtaaccaataacaactagagccatgattaaaaaaaatactaacacctacatatgtagtggcaatcgggctaagtagaagaaaaatcgttgcaacaattcagttttttcttactaaatgaaaaaaaaggggaatccttgttataagtaaaaagtaagttcacaccatcatcatgaaataaaattatttgatctagtaatgattatcatctaatactgaaataatatatagctcgttttagctgattcagtaaaacagaaagagtgatttttttatagaataatagaatccagagattctatatatatcggaacatattgctctagatcgaaacacaacgttgctgctcgatcgatcgatcaccggcaggcatgaggctagctataggttttggttttctgtgtgctgcatatacgcatactgctagtctgctactagcctactattactgtaataaacggtctaaccgtctaaatcggtttgtttggatgcatatggatatccatcctacatacagtacagctaactgcaaaagacacatgcatgcatgtagatattttgttggtttggcgattcaacacaagctgcatgtctcaacggcgaacctttcaatcgtcgtcacgcttggaccaaattttggagctgtgtttttagtgcaattattgccatggttccttcgatgataaatgctactagtaccatgcactagctaccctccaaattcaattcaattcatccatgcatggtagtatatatatggctgtatatgtatgcaaaagagaatgttgtatatatattcggaattgatctgcttgtttatgatctgcttgccgatcgacatattccttttgcagtgtgtatatatatggatggccatgtatacagtaccgaataaatctattcaatgaaccaacatatacttattgatttgatgcagcagagcacactaaatgtatagtactactatacatatgcatgtacatttgcctgtgaaatgtgacaagcgtgcttggcatgtgacgttgcgtactagtagtaatataataaaataatccatctactataccactgtgtagaatgcaggtacgcatgcatgcaaatggctgcatgtttaactcagaattttttagaggagtaaaatcaacaaatgcggggaagatgccgtgacttgattgacacgtgttgagctctggcgtgcccgcgtactactactgtttattaattgcgtgtgccattccattctctggctaattaagctaaccttaattagactgccttaaaccgcagggttaaaatgaaaacagcgagtccgcgcgccatcggttttaatttgatgcatgacttgtttactttgttatcgaaattaatcttaagattaataaaatatggtaatgtcaaattttagcatgttatgttttggtggtatcaaatcttagtagcgttagacgcgtttagttaaataaattgatgccttttcaaattagtagtgcatcaaaaaatgtgcttttcttttgccatgtaattcttttacacgtttgcgaaaaaatagtagagcatcaaaaatatcaatttttgataaaactataaaattggtaagattatgtttagtttgttattctaccaaatgttagtaacaccactaaagtttgatacggtattaaaagtgacagtatatggtgacatggcccacgcgcgtatatatgtacagaaatccaatgcaaaatgtattagtacgactagtagttgtagtagacaataacagcagggtaaaagtaaattaggcctgagcacgcagttagggcacgtcggtcataatcacgcatgcatacttaatgatatccttaagaagagtccctgacgagccaaccactagttagtggagtagtatatatattaattgtgttagataaacaaatgggtacaaacatgcctctttgatcccatcagcgatgatgattagtcccggattaataatctacctatccaccgaagcaaattattgaccgtcatctcacttaaatttgtttaagcaagtacgattatcgaggttgatcgattgtcaactttttgttcctgtacgtccgtataagttatactactacctacttaaaaaaaatactccgtcccaaaatactacttttgagtttttttaaacgtttgaccattcatcttatttaaaagattaaaaaattattatttattttatttgagacttgttttattattaaaagtattttaagtgtgacttactatttttatatttgtattatttttaaataaaacgaatagtcaaacgttggaagtaaaaaattaaaacaacatctaatttaggacggatgtagtacgtgttaggccactcccaacacaagacactagatatggtttctataaactccatattatcaagaaactaatactagacactatctttcaatgcaaacatcaatgttacatacttaaatttaatgctacttatctcacatgatgtcttgcatgttgtttagaaactatgtctcaatgcaagacccggttttcttctctttccttatttatttacttgacacatcattctagatgggagcttatttaatgttatagacaccatcctagtcattgggttgaaactggccttagagcatgtacaatagcaagctataagccggctgcaaacttattttaagaagttaaatagggagagaggagcagcgggatacagatttgcagccagctgtagcacggactctaagacacagtgtgaatgacaggtgggaccagatattaatagtgtagtatgtaagtattgtatgaatgagctattagattggctatagatgaattagagctagtagttggctatactattaaacttgctcttagtaggatgaaagatgatgtggcaagtgaataaatgaggaaagagaagaaacctggtcttgcatgagacatgatttctacataatatccgagacatcatgtgagataagtagcattattaaatttaagtataaaaaatgatgtttgcattaaatatgtagtgtctagttaatgatgtagagtttatgaaaaccatgtatagtgtcttgggttgggactgtttctcttccagccaggccacaagcacaatagtactaatgtagaatcaatatactactacagtgtcatgcatgtggcatgtgcacgccgatgtattcgtgtcacgaggcggcgttgcatgcctatgccgggcatcgcgagaccgccgcgcggcgcggaacgcgcgttcggtggagactaattaattaccgccacgcaccggattaactatgggctggcatgcagttgaattaaccctgccaccccgtacgattttcacctaaccgatcgaacagcggttagtctagctattgcagctgatcgatgatggtaattattggtgcacaggcagcggcatgcgacacgtactacatactccatggaaaagttggatgatccatcgagtcggtgcgcatgcatggaccttaattacctttcggacacgatcgagattatttttgggttaatcagtcgagcctcgttacttgctcctgcatatatatagataatcaggtcgattaatgccatgtgttgaattactagtgctactactagtagataaagttaattagctattattggtagtaggccaaggggatgaattcactgatgatgagctagtcatgtctcatcgatcgaattcttttttgctactactagaagcatgcatgcagatgctatggagaaaattgcgaaaagttactggatgaagctagggttcttcgttttattcagacacaatacgcatgcgtgatgcttgaccttgaattactagctactagctactagctagttagttcccgtaggtcacctaaaaccattgactcgatgcacttaaaatgtacttactatgtcccaaaatataagcaattttagctataagtatagacaactatatatccagattcatagccaaaagttattatattttgggacgaaagtagtatacatcaagggtgtgtttagttatttgggtgtaaagtttttaaagtatacggacgcacattttaagtattaaacgtatactaatatcaaaacaaattatatattccggctgtaaactgcgagacgaatttattaaacctaattaacctgtcattagcaaatgtttactgtagcatcatattgttaaatcatggcgtaattaggctcaaaagattcgtctcgcaatttacatgtaaactgtacgattggtttttttctccatatttaatgccctatgcatgtgtctaaacatttgatgtgatgtttttggccaaattttttttatctaaacaagaaccaagatgcatgagatgtcttgggtcagactaggaattaatctggttaacatcagggtagagctgcttgcagtaccatctatcttaacataaatatctagacagtgtacatgttagtagtgtgttactataagatcaaagctggtcagaagtactggtacctaaactactatagtatgtatttttaaattaaaatagaaagatgagtctggctaattagaaacaaataataaatgtcactcgcgtggaattaattaaatgacgaaaggattaattgggtgtttgtactttaatttgttgatgagccagctttgcagcagccgtgacacagtgacactagagtagctactaggagcacggggagaatttactatttgccactctctcaaaataccagtgctcaaatgccactctcccaaattttcattcccaaataccacccgggcccacatgtcagcctcactcagtggcaaaaagaaggagaattgtgtggtgcgagtaaattcaacggatgagataagagggagctaggcgcacgcacggttggttgggtccgttgcaacggaagctatatacagggctagctaatcgattgattagttgatggacgcatcctaattatctcacctagctgcgtcatccatcgtccactcccgcgcgcgaagaagaaatgaaaaacaaaattaggccccgttaagttccaaaaacatcacatcgaatatttaaacacatgcatgaaacattaaatatagataaatgaaaaactaattggacagttagggaggaaatcgcgagacaaatcttttgagtctaattagtccataattagccataagtactacagtaacccacatatactaatgacggattaattagtctcaaaagattcgtctcgcagtttccatacaaattatgaaattatttttttcattcgtgtccgaaaaacctttccgacatctggtcaaacatccgatgtgatattcgaaaattttcttttcatgaactaaactagtccttaatccaagctactagcaaacctaacctaactgaatcgaattgaattgaagcttcttccgttccgtgtcagggttggtgggcctatctaagagagctcaagattttaaaaaaaaaacagccgcttgataaccagtttttaaatataaaaaaactgagttttctagtttctgactcctaatttattttctaaattctataactatagtttttgagaatctaaactaaaagccggccggttagctactgctcatccctaccaactccagctagctcctgatatctctcgtgtctccactctccacaccagattgatgcttgtaatcgtatatgccggtcgccaggttcaacgtaacgtacgtgtagctagcaacgccaggttcaatgtacgtccatggaatggatatatatatactgtactacatatgcctgcaaccagttgaagctacgttgaggctaccaccagagaaacatccagggttttttaactagcttcacaagatgatgggctagacgatctgggttcgaagcccctcaccccttataatttgatattagatacttttctaatattcattttttttaggctacaaccataaggtaattaattttccatgcttactcactgaatgaggtaatttcatttctggagatctatcgagcttatccagctacagcccaaccgacggcgatagctactgcctctgcttgaccacccctgttatcacctaaacaaaccaacacgttggagtgagctggaagcttgccgcctcctgtcctgtgcactacaatgcacttcactaccagagcacaagaggccggagggaggaaaatatataatctcctcgcatgcatgcgacatcaccacactttaattcttcctcccttcgcttttagccgaacctttaactgaccacatgacaagggtattacactctaacctactccctccgtcccaaaaaaaaagacaaaccatggttttcgtgcccaacgtttgaccgtccgtcttatttaaaaaaaatatgaaaaaaattaaaaagacaagtcacgcataaaaatattaattatgttttatcatatgacaataacgaaaatacgaattataaaaaaattttatataagacggacaatcaaagttggacacgaaaatccagagtttgcctttttttagaacggagggagtagatagctctgcgcttttaatttgcatccgtccaaatatacacacttcatgcatataactgaaattatactctgctgctacttcaagagatcaacatattctgatcccaactgcacctgtactgtattaatttgcggcaaaaagtactttaaactggaacttacggtagaatgactttcattgtgaaacggagggagtaattgccatctgaatcgagatagtgatcgatcatcatgctttttttttagaattattacacacacaacgcacgtacgcacgcaaacccgctgtaaccactaggctacaagccctttcgcgatcatcatgctttgggtgtgtttaatttacgtcaaaattggaagtttggttgaaattagaacgatgtgacggaaaagttgaaagtttatgtgtgtaggaaagttttgatgtgatgaaaaagttgaaagtttgaagaaatagtttgaaactaaacacggccttttggcgatgctagaaatgtgaagaattaatgtcacgtaaggattaatggccgttatcgctctgctcatatccttaggggacaaggctttttcatctgccatgtatatatatataatttacatatattccctgtttgtttctgccctttgggatcaagcaaattaaacgcacttccttttgtctggccggccggccggtgttcaagccaaaccacagaaagcatattgtgtactattaaattgcccgggctttggagtaaaacatttccagagaatattctgccgatcgattggattttaaatgtcacattgcaaattttaatacccctgcactgccccctgaaacttccatttcaattcatccgtgatctttgagcagctataggacttgtttttaatgaggggaggaaggtacagtgttgctgtcaaagaatgataaggaagacttctctgctgcttccaaactgataatgttgtggtggtggtgacagagactctctcatcaggtccaccaaaaaccaccattcatttgcagattattgtctcttcattgcagttgcaggcacaggcaggcagcttcttctggtactactagcaaattaggccacgataattgttgtctacaatcaccaattgtagatgcatgattactattcttaatttgtccatatatgttatagtttgtactagagtagactagtagtaaataaatcttcaattctgtttctgattaatattacaacatgcatatcgatccaccgttttctgaattgtggtgtggcaggaagctgctaggttgcatcatgctattggatggaaaatgtcggtactaatttagctattttactctaaacaatggacttttttctattttgtcgtagtactcaagattcatcaaaacacggaatatttctgttctaaacttctaattaacaagtggctcgtttggggagaaattacctacagctacaggtcattgcttatatgtgtcaaactgtgatagtgagttgccttagtcatcacaaaatttgttgagcgagctaatgtcacaaaattctcattacagtcttaaatatatgagataatgctctgtatgtaacaaattaagttctgactgctggagctgacaaggcaggaattcgttagccaaatgcatgacgaaagactgaattttttcctgcgtcatataacagaattgatgactgaattttccgtagagctcactgcatcgatctgaaaataaaaaaatcagataagaatgttttcgttcgtggatgacattttcctctagatttggtctttgcgtgctaaaaaatggacgcgtcgggtaatcaacagatatactaatctcctcaatgattagattagcttgcaattgattaattatttacttcacccggttatccttttcccatttggagatctacctagtgctacttgatgattaagtattaggcaacaacttgacgcgaatgcagtggccgtattctccactgttgaatatttcgggttttaaatgcgagctgatttccattttattgccaccattaattttcgtaattaatctagtggaaacaggagtactagtagctaacttggtatgataaaaacaaagaaattaattaaattaagtcgtcgactctgcagctaacgtttcagtcgccttctttctgtatagcaccacttgtagctgataggacagagctagctaggaagcttaattggtgagaaaacgatatgtagaatttggatttattaaccttgatatatcgatcgatgcctcatcataaagcttaatagtagcaggcggcagacagccacagcctttggtttggcttcatgcatacatctcccatcgcatattacactgaaaatctacagtggccattaattggccgttgaaattttctcgccgcgaacgaagataagcattggagacggaaatttagaaagggatgaagaaatcaacgcggaacaaagtaataaactcttttagttagaaaactaattaaaagagcagcatccatgttcgtttaatttggcaggcatgttcgagtgaagaatattctaaaaagaagccctttcaaagctagacctcctccactccaacccgatggatgaggaagtgtcaaacaatgggaaaaggagaatgggatcggattagtagattagattggtttagcgccaataatttaacctagttagtcgtatcaggatgagtagcatcattggcgcgttaattaattatagcaacaatattaggacatgaaggcaaaataattaccaggcagctattactgcagtagtaacaagtgagagatggatggaggaggcgatcgaggttaattagcaggaggcttatgcagcaagttggcttctccatcacggcactcgatgggagagaggaggtcgagtcctcttctatataagagccacctctcctccatttccttcttcctaaacccatctcgatccctacctagctaagctatttcattcacacctcgatcaatctcgatcgtctctctcgtctactactagtactagcttcttctcctccatttctgacctgagctagctcagaacagagagctgagaatcatcagctagctagctaggcgtctggggagagagcaggagccatgtcggagtcggaggtgtcggtgatcaaccagctggaggaggaggagactcggctggagctgccgccggggttccggttccaccccaccgacgaggaggtggtgacccactacctcacccgcaaggcccaggaccggagcttctcctgcgtcgtcatcgccgacgtgaacctcaacaactgcgagccatgggacctcccaagtaagtagtagtctctcgttcatggcggcctagcttcctcatcgtctgctagctattcgatccgattcgacgatggagctgcatgcatgtattgcaggcaaggcgaagatgggggagaaggagtggttcttcttctgccacaaggaccgcaagtacccgacggggatgaggacgaaccgggcgacggccagcgggtactggaaggccaccgggaaggacaaggagatcttccgcggccgcggcctcctcgtcggcatgaagaagacgctcgtcttctacatgggccgcgccccccgcggcgagaagaccccctgggtcatgcacgaataccgcctcgacggcaagcttccccccaacctcccccgctccgcaaaggtattctctactcgccgccggccatggcgatggctagctcacatgtcgcgtcgttcctctttctcttttattgaatactagtatatggttgcgtgcgcgcaggaggaatgggcggtttgccgggtgttcaacaaagacttggcggcaaagattgcccaaatgccgccgcctcccttcccgcgcaacgactccttcgacctcgacctcgacgacttcctccacctcgacgccgacctgccgccgctcatcgacgaccccttcgcctccacctccacgctcaagacggagccacctccgccggccaacctgatgcacaaccactacggctacttctccctcccggcgtcagcgaccaattataaccacagctccggcgccatggcggaccaggcgattcggaggttctgcaaggcggaggcgtcgacggcgtgcttctccggcgccgacgctgacgtggatccggtggtggacgagctgctctccttcccggactccatcacggactactcctacatatggaaggcctgaccagattaatttcgtggttaatttgccatatgatcgatcagattaatcctgtttaattagttggtttattaacttgattactgtcaaaggtttgggttaactaggagatgatgatgatggagtttgtggtgatgcgagagagagagagattaggtcgcgctgatctggtctgatcaaggtgtgcagagcagatggagcggactaattcattaattagcttaatcaaattagttatataggtttgtttgtcttaattctgtatgtatatagttatctgattggggataatacatagagattactagctagctagctagtttggtgattaggggggtgatgagctagctagagagagatatctcatcaaaattaaggtctcggttggttgattaatctgcagattatatattgccttgtgtgtgataggccatgtggcctctttctgtgtatgtgtgtgtgtggatggaaggagtaaattaactaaaccccttgtacatgtaccatcagttgtgctttacttacatgatcaattcaaccattgatcgattaaccaaaccgagatttgcatccatctgtcgcttaattcttttcgctcagtgcatgtgtgctgttgatccagaataagcagctgttgcgcagaaaaatatattgatggagaagagaattgaattaaatgggtttgtatgtatgttttgtttggaggcaatgattggaacggcaggcaggtccttgtcgtggaatccacttggggaattgaatggaatgggattgagcatgcatcaggtaaggtaaattaccaaggcatacccttaattgctcccttgcctcttaccttaaccggctgagagagtggagtaatccctccgtctctcaaaataataatctagaattttttttataaacacaacacaaacacagacgctcgtaacatacgtgcactcacccctgtaaattcatacacacaccctatccttatgaacacctccttcgaatgactggaccaacatatcaccacgggcgtcttgttgtcgacggatatgttgtctaccacagaaagaataattaacagtaaatacgagcaaccgtgtcaagtataaaacttgaacctggatggattgattccatcatatcataagaacttaactagttaagttacgttcactttgcctaatatacctatttatacttgataatatttttttgttataatttaatttattttaggacggataatttattttaggacggatggagtataacaagtctattgtgacgatgaatccaagtccaagatttggaggggtttttttttaacaagcggcttgtgaatttgcttgtgggcgtgcggtgttgcatgcgatgcgatgcgcctcgctgtcgctaatatctggatggatggatggatggatggatggatggctttgccttgctttccattcgacgcaacaaacacaattaaaggctagttgcatttggcacaacacaacacaaggagaggctgaccgggttttgcgctcggccgcctcgcttcacttctcacctcgcctattgtcatccaaattaaaccccaacaaaatacactgcacttgttaatttgcgagtagctaatctgaagaaaaataaaagaacggaagtcaggagatcaggatacgtaaaactttagctggtcgcccgggactgtgtttttttaaaaaaaaaacacgaacgcgcaaaaggattgcacgtcaatagagtttttattacacaacgcaatcagccagatcggttctggagctctgtgttttcatgtgcttggccttgtacatatgtgcaattggactaactgcctgccggtcagtaacattctactgctggatttttaattactctcctcactctaaaataagtgtagttttgcactgttcatgtttaagtttgaccgctcgtcttatctagatatgaggttatctacatatattgttttaggagtggtcacaggttaatttttttttgatggaaggagtactctgcactagaagctagaatatgaatgtgcgccaggtgcatgcattggcgcttccacgttagttgctttcagatggatgatcatccatgatcatatacatacatcgatcgatcatcatcaatggggcccggccggcctgcatgcatgggagaaatctagctagctggctagcttaattagcttactcctaatcctagctagctagctactcatcacgagttggatttcgtcaggtctacctcgtgattatacaatgataatctgcatcatatcatgcatgtggggtacatcatataggagtagtatgtactagtaatatacggcatcgatcgatcgactttcgttgtgcttagatccaaagtgtgtatccaaacttcagtccttttctattatatcaacctatcatatatacataacttttcagtcacatcatctctaattttaactaaaatccaaactttgagctgaacacagccttctttgattactcaatagtgacaacctttttgtcgtcgttgacagcatttaaattcccgcactactgttcgtacgtacgaaggcatgcatatcaatcgatccatccatcattctggaagaatcaatgcatatatatcatcattcgatcgatcgatcccatgcatacatcacaaatctttatatatgatcatgcatatgcatgtctatctaggctaacggctgcagtagtagtacgattgttgattgatcatcacaaggggaccaatctatacatatgtacatttatcggaacaattatcaaagagctagttactataggatgtgtgccacgatttgagttggcagctgatatatactgatagtactcctacttaaaatgccacgcatgcagctacagcccatccttttgttcaagatacaatgtgcttaattactctgtctcaaaatataaggatttttaggttgacagggttattaagaaaatacgtgtgaatgattaaagaatgattaaagaaagtttatcattggttgagaaaagaaaacatgtgaagtagaatggttgtgattagttaagagaaggtatgtagagaaatactagctttattttagcacaaggtactatgttagaaataactatatattttgagacaatataatgtacttaaaaatagctatattttgatacagacgtagtagtatgcatggcaaattgttctaattaatcacttaggggatgatgtacactcacttttgcacccatcaaatggttaaaaaaatgaaataataaaaaatgacatatcactataagatatatatgtcacatcacaaacaaataagtttaaatttgaccattctagtttaaataaaaagaacaaactaaacctctaaaaatattaatttttagtaatttgtgtaagttgaatttaaacttgcctgtggagtttctaaacttttttttaacttcaaaagttatttagggaatgaaaaaaaatcacaatactggtattattgcacaagtgcagcaagacaacaagaccagttgcagtctagctgccatgcatgattactagatagcttggtccgtcctctcagatgctacaattttgcatgtgtgtcgacggctacgccttcatatatggctatgagcctgacatgactcgctaacgaccacaccaaattcgccaaacttatcacaagacaagagcatatgccttacatatgttatgtcacgtttcagtatcgctccatgtcgcgctgaaatttcagagctatatagcacaacgtttattaattactcctagttgatgtatgatcgaccgacatccatgcgtatgcatactctctccgtactcataaagaaaatcatttaggataatgtttaagtcaaaccttgggaatataaatcatgaataactctcaaattgttaagtttaaaaatgtaaaaattatatgtatagatttgtcttgaaaaatactttcataaaagtgtgtgtgtatatatatatatatcacttttcaataaatatttttaataagaagtcaaagttgtgttttagagaccgtgtcgttgttctaaatgacttcatttacgagtatggagggagtatatacagatgaatatgaacgtagtacgaaatagcacgacccactgacccaaacctagctagcttgtaattaactcctcctaaatcacaatggtttttaatcaggttttcagctatttaagttactcatgtcataagtaagtaatactagctactagataattaagtttgcgtattgggcaatttgcagacagctaagagttgatgtcttgaagcagaggactctcgatcccgttaatctcggtactaggtatgtatctactataacaactcatacatgataacagtaatactacttaaacacgttaatttgattcgcaatctagtagtacttgttattttttcctgttgcattgtttgatttggctaaccgatcgatatatacggaatactagtacgtaccagtctcgtacaaatatacctgtagatcgatcgatccgtatatttatcccaggacaggagggagaaattaaaggggaaaaagaaacgcgcgtgctcccaattaatcgcgtaataaacacgagatcgatcgatgcatgatgatcagggtgtaatagtatcttccaggttaatctacgcgtttcttctctattccagctgaggctaatgatgaatgaattggaggagtaagctaagtgtcaattagtaatattcctgggatatttatgtctgtccgtaggcaaactgtaccccagtacaagctatagatcgatactgctcttttgatcgtagtacttaattaattacctgtaatccttgtccgagaagacaaatccatccaacaacgactttactttgatgttgctttaatttcgagattcttaataatgtgtaatataaatcttcaatgatacgaatttcctccgatatatagtatcctctcgttctagtctagaggccacaaacgcacaatttgttaattacgtggttagtgctgaattcaaaagtttaaggcttaaggttttagaccatctaatcagatcacacataaaatataataaaacaaagtactatgaatgtaaccagagaggtaggtgtgtgtgtaaaaaataaatcaaacttatttgttactactcgatcgaaagacttgtggttttgattagccttgatgtaattttcacgctgtcgtcagcgtagcaacggttttaatttgacgaagagggctaaacgagtagggtacatatatactacaggcagcaaaacgcatggaggattttggtagctaggcgacggcacgggaaagttgaagcctggacgtatcgctcatgggccagccaggcccaggcgtgtcgacgtgtccaggcctaaaaccacaaaccacgtggagcccagggtcccacgtgtcaccacttattggtcgttgttgtctcgaagaaaaaaattgcagtgatcgatgtggacgccatctggacgcatgcatgcgtagtatataattgcatatgaatgcctccatctccatctgtatatatcggattaatagaagacgacgacgacatcgagggaatgtacgtactacatacggatagggatctgtcgtctgtgtggagccccgtcattcccatactctagaacggaagattcatctcagtcaattatttttctttttagtaataaaaatgtattacatcacatcggtcctctgtcatacggccaattagttcttactaaaataaattaaaagagtggtaggataaattcctagttacccttaagaaataaaaaaaataacatgctaaaagaaccacacatattttaataattaagccaatatatgttacatcatccataatgaaataaaattctcttggcaactgattccaacagtgtggtgtcatatagttaaataattaattagtcctcgtaatatataatgctgaaaactttatggtataacttgtagccgtcatacacggggaactaggatatttgcagaaacttatgtgaaacaactcccttatatatgtatccatctgcccaataatgtgggagattaaattgatcaacattaattgaaagcagagcagttgcttggttaacaaaaaaggagctgagatagatagatcagataggtgtgagttgtacagtactccacatttgcaggaccgcaagcgcaagtaccatgttggtgatgtactagctccatcgatcatactgcaggtacattccatgatctttttgcaatcaatgcagggctagcaaaaagtgcaagataggaaaagtgcaaagcatatatctatatctccaagatatttctagtttcaagcttattgtacactttactaggaattcaatcaccaaacacacacatgctagctattatatcttggcttccatggaacatctaactaaccataaagcatgcattcttcacatgccttattacattgtaccaatctcatttttatatgatgacctggatagctaactagcttgcacatcaggaccaaccatttatttatttatatttattagggaagatcgtatatagtggacaaagcctttactatgtattagagtataccccaagtccatgtactgctagtatttgtccttcaaacctacgtactattgcttatctacggcatgcttcactcacctttattcctggcttttttaaaaaaaatttgccaggactaccaatttagctagctcatgttttcccattttcagataatactgtagttaatatacaggttatggtacattagttggagaattatgtgaacaaactgatcgatcctcagctaccgacctgatatatgtcgtccagtaattttccatgctgtttggtttgcatttttgtcactgtcggccggtttaattgggagaaagaagcctacctagtgaattgatatttttgtccatgtaccgatgagaattgaatgacggctaatttcagttctcgagtcctagtcaaatgctgctcaagtaaaagatcttgaaagcaattgacgagggcttctgaaaagaaagaaagaaaagatcaagtgcacttgtgaaaagtactcgctagctagctaagctagtggctcatgagctaaatactgatattttttcgcaattactactcgtagttctctattgactgcattccccagcgtatttaaacagagtttcagagatctgaaatgctactgcttcatcattaattggcagtatattgggagaagaaacatgtgccgttttgctgtgccacgtcagctgttttggcttggtatagtatccattccatccacatgttccattgccaaatcaaatgggaatcaaaaattaaattaataaatgatttgtttctttccccgagctgtagctagcagccatgcatgtatgcatattatgaggataaatattcccagtcctatgatatgatccaatcctgataaacagtccaggtgcatgggatctctgatgatgcatgattcatcatcagtcatccaaagagttggggggttgatcgatcgatcgatcgatgtgttgcaggcatgaatgccacgtgtgatgcttcttgagtgtgccacttgggcacttcgatccctgacagctccctttcgtggccatccggttaacaggtggctcacatttgggacgttgcagataacatcagcagcagtagtattcgagagtttgacaagcaaaggttttaatttttctgaatttgttttttctctatccaaaagcaggcgtgcagtgttcttctgtaaacacgggcaagcaaagcatactggatgtttccaatattttttttaaggcagttgtttgcttctgtgctgtgctattagagtgcgttgctgtgataaatccctttcgattacgaagtgttttgatccaggagtttaagattagccagacacagatgcaatgggttttgatgggtgcctggcttgagagaggtgttcagttcagccaaggcactcaaaattttacttacagaaatggacaacaccaacctttcccagtttccggttcccattaattcaaacaaaaagaatatgcatgcggaggatcgaatatccttgacacaagtcaagaactgatgattatttataagtagtgtgattaaatcaagttgcagtactagtttttaggtaattaaggagatagatataaaattgttggaggtgcaagttcaatcaacagcgaaagaacaatttgtatgtggaagcagcaccagttttagtagcagcatatatataaagctgctgcagttgaggaagacgcatgatatataagtgcaggccagacagaagattacaagagaaggctttcctttggagatagatctatcttgctttattagtttagtactgtggagtagtgctagactttgtataatacagttcgcacttgtgaaaccggatatcgggatatgatcgatatgcagtgacggtgatgcatgcatacatatgggccggttagtagggtcagtgatagatatatatgcaaggatttggatttggtggtggctgcaacgcggagatgatgcgtgcagtgcgtccagaaccggaatattggatcgatgatgatgatgatgatgccaaattgccaatgccacccgtatgcagatagatggatattatggatcatggataaaggagacgtactagtattaatttggagtcaaaagagtgagcaatctccatgcggattgcagtgcagcagctagctagctatttgcgttgaatggaatcattttaagtaagcgtaaagtgagcttcaattcattagctatttgctcgtcctgtctgtttgtctctctgttgaagtatgtactgatactggatattgtagttgtaaaggaggctaggctagctaggtatggaacgagaaatactccacatgagagatcaagggtggccatgcatcactgccggtgtctggtctagcagaaagcaatcgagatcaatgtatctctttcgatcttagcttgatcgatgttcagttcggttgggtggtgagccgctcaaaagtatttctgcctgcctgattgataaaagcagtcgacgcaagaaacaaatcgcaagtagaaaagaaagagagagagagagaggaggaattaggccaaggaatattaattgggcagaccaataatacaccataattagattaggttagatggaacaagaatcatttcttcatcgtcgtcgtgcagacggactgcaaagaaaatactgtataaaaagaagaaagtggcaacagggtaataaggcctattttgaggaagcccaaatagtacgaggcccagctcatctcgttggactgaagcccaagaaagcaagagagacgaggcgaggcgggggcctgcaggcgaaggcgaggcccaagcatcaggaggaggccactttgggcattgaggtcaggcccaaagacgatgaactcgctctccgagagcttcgtgctgtggtcgtcccgcacggacccggagccacagatgagagagtagacatacggttgttgggcaccggcgtagtataaactcatcagcagtagtacgtagtgcctagagatggcaatggggcccattcaccgtttccacgcggtgaattcacctattaggtgacggggataattaatatctattcaccaaggggaataaaatggttaaaaacctctcaccatcggggatgacaggcccctaacccgactgactgtactgtaccatggctttttagatgttttggtccataatactaaagcccatttaacaggcatatctatatctatattaatataaaaaggaggagttgcccccctccaatgctactggccaaatcattcggattaatctgaaccatccatccgcgcgcaacttatttccaccatacgatttcgcacccgaggattgcacaccgattggccgaagacatcgctcatccgtcctcatccacccgctactgcgaagacatcgctcctcgactcctcctcactcgctcctcttactccccgctgccaccgctcctccgcggccacgccggagccactgccgggtccttttcttccccaccgccgggtcctgcttcttccccatccccaccgacgcggccggcctcttcgctcgcgcctcctcctccccgctgccgccgctccgccgcatcctagacggagctctgccggagctccgccggactcttactcggagccgccgccggagcaggcctcggcccctcatcaagtaagttccttaaatcctgtctctttccctaatccctaatcttctccgtacgaacacgatctgaaaacaagtgaccataagtttccttttttgttgaagtttgatatgtttatatgcgctcagacctcaatcgcgatctccctcgctcaatgcaaagcatcggacttcagcgatcaacgcttgattgccaaatggtctgatccggccgctccgctgccaaggccaccaccccgagatcgcgtggatctggctgctccgccgccgaggccttcaaccctgagcccttctgccatgagtccgcagcaggctccattgttgtgttcaccgcccgggcccctcaccgccagatcgcagtccactccaccgtgtagtcgctgcactgtgccccttcgcagctttgctgccgaggccaacgcccaggttgctagaccaccaccttcttcaacaccatattgtggcccttgacttctgcctgattgccgtcacatagacgttcatcaaccctaggtatttaccctaacaatctcttggtttagtgtcaattttgattgcaaatcttctacaaatttgccacgatgttgctcataattgctgtcacccacaggtggccatggtaccacgatgctgcggtgactgctgatacgattcctgttatgtcatgtttgatgctgaatcacgaggattctccaagagttggaagctatcaaacagcaccaggcagtcaagttgtacagatggtgaaaagtatggagaagctgcagtcaagttgcttgctgctacattaggagtaacaagtgatttttcatctgaagaccaatccagaaatattgggacaatctgactgaataactgctaattataaccaatgttttgctctaagtgttattggatgttttcattactggtacaggttgtttatataatctatgtgagttttctctaggtgatttctttgtatttctttcaaacttgatattttcctttactgtttaatattgcttgccactaatcatgatgtgaaaaataattgaggcaaagaatcatgcctttctgctatgcaaaaatgtaagcctttattctgcgcaagggcgcaagcatggttcatgcataatggtcaagagccgaagagctagaaaatataatatgcagctagctaatttgttattgtcagctgtatttgagtagtacttaattttgttttctaatgcatgaattgcaggatcaatgggtgcttgctgataaaagaatgcatataaataacaattggtggaggcggataaggaggctggtcaagtcagcctcctgcaattactagtgaacatgcacgtgcaaggcacgttttcgtaatatatattattgcaaataaaaacatattaaattgccagtttatttccactctccattgaatgatagttacaaaataactttcccttcttaaagaaaatgttattatagaacaatgccatcgccttagcaatcagcaagcagcaaattagtatctccatgaccctattgccaacatgtgagacccctagttagatttgtgaactaaaaacacctcattactgtaacaacaggaatgtatctctcatggcaacataatctctagtactaacaaatagaacatacaaagattaaatctattaaccatttgatcaaactggatgatgtaggatttctttcataaacatcacaaggaaaataaaattggatttgatccttatgggctttcaccttgtcaaatagcagtgtgcattaaaagtatcttattgttgctgctagcaaatcctgatgcacactccatttcttgagaatgtcagaaatatatgcaacttgatttactaaacaagcaaataattatgggtttgcaccttgtcaaattcaatatctcttcatcagctttgtaactcagcaaataaaatcagaaagtgtagttcttaccaaacattcccttttaagaaaataatcgacttggcttttatgaaccctcgaataaattaccagagacttgaattttaatttaagatatataaccagagcccagaggcaacttttctcaaccatgtgaataataattctcagtccaggttaaggaccagatgaataataggttgggggtttgttgaaattttgtataggtgagaaggcatattagaatagagctttagacatattcccaagtcccaacattcaattaagtgagtgtgcagagagaagttcacaggaaacataagacgcagactacttagtagtgctatgagtcaatgataaattactttactaagaatataatattgacataatcaaacttatatcagtttaaaggcatcaactttccaggtaatcaatgagcatcaagaataccttaacaacaggatgttatacacctgtactaatctggagtagtatggtcaatatgcctaaaaatgatccaatgagcatactaaaattatactattttttttgcttcaagcaagaccagtgaaaaaaaaagtcagtgcagacatgtaaatgaacatatctagaggtgcagtgtggaggcggatgatggcggacttgaggtgcggaggaactattattaggagatactaaatcaagttataacatatatactcagaatacgatagaaccttacgaacattttgttgagcagttcatgagcagaaaaaatggttactttgagtaaaatgtcttgtaccagtttagttcaacaaaagcagcaagctaagatttcccagcaaactcacgtgtatagctaaaaagatttggaacaaacatacctatatggaatcgatcaatcgctcaagcttcaatgcttaaaataagcattgagtgtaggtaagagaataagtagctaagaattatagaggctggatttagatgaatcatatctccgaagcgcaaatgcctgccagattccttatgaaccacaaggtaaccaatacaaaagcaaactggaaaaaatatagcgaaacataaaattggggctaaagtgctgcactgtcagtgtctattgctattccatatggcatcctgcaggtattgaacaaattgggcaatttctcaaacttgggaagcacacataagagagcagattaatatgctttttagtgcatgtacaattcatacatcagaagttaaacaccactatatttatcaatgtattcttgagaagttaaataccatttcttttgtatggaatcccaacttcgcctaagcatttgcagctagaagtgctcatctcatccctttcttatgtggtctttctcaaaaaaaaaaagaagaagaaaaactcaccagagatggttgcagtagcgattaactctatgaactcatgtcatatcttaccagcaagctcattttgccacatcattcctcagagctccctttggtgcgtctgcttgttgccctccaaatcttgtggctagaggtgctgccatcccaagtaggttgcctcctcttgcatgcaaagaatttttttttaaaaaagggtctattaagaactcgttgaccaaagagtaatgcatataaaaaaaatctatattttaattatactgatagcactcattgtgccaccagttaaagaacacagaaagtaagtgggagaatctctaaatctgtgatgttgaacttgatcatcacataattctcttatatttatactgccaattagattctccttgactgtccaataggatgagactgccttcctaatccaaagcacgccaatatactcgtgaattgacagaggagttatcttggccgactctatcacttgctatggtgtcattcgagggcaccggcctcattggggtgcccggactggcagcagtggtgtcaggtgttagagacctaggggcatggaagtgaggaatcatgtgcatatatgtaaatcgaaagcaatatcattttaatgacaatgtgagaataaaaataaaataaatagaagatctagattatttgacaaagtagagatgattgttctttccttaacaaccttgttgtaggttgtcttcagtagcgaataatcattccgaagctgcattgttttaaagctaaacatgttaagcagagacaattgaaaagcataagaagtcctaatgctttcaattacaaaaaatatcgttgatcatggactgaacatacaggaagcaaaacacattctataaaacccaaaaattgtcgcaaatgaaaaggataactgattcaaagacaaagcagtaactctttttgaaagttgggttgacatgaatctatattgaagaactgattgcccatgggcgcatagtattgtctaagtgaaggcctttatagttttacattgcctaggtgaagcagactctgaattttaactaagttgctaaattcaatttgatctcaggctacaaatcgcaaaaactctcattgactttcagcattcaaatcataaaaactctaattgatttcagcaattcgagtttttaattgtttcaatcaatctttggatcttgatggtgctgatcatggaggcacagctagcagaccatggttgtaactaacacatatgcttgactgtactgattaatcaatgagagttttttggttgaactaatgaaatttctactgtagtcgagagaaatgacagctaaaagaacaaagtgaaatgaagaacgggctgctgctcaccgagtcgaggaggatgttagatgccttgaagttgctagatgaccagcgggtgagtgtagtggaggaagtcaagccccttcgccgtgccgcgggcggtctgaatcatccttatccatggcatgggaccatcgagacctgcagaccattacagcgcagatcagcttccccaagtctttctagaattgacacagaggtggcggcaacgaactggtggctagggtgaagcaatcatcaatttctgttggtgaaccttactgtttgtgtagtgctttagctgaaaccatctgaaggtggtcatgaagtcctttcaaatgatcggtgctcattttgtgaatttcatgattgcttcacaagcatgaacatacactttcccttcaataataattcttttgagtgacaagagatgaactgaaagtcgtgcattcatacagaatcatcaacagaaattgaaaacatataagcatttaggcttccattcaatcatttcgcaatacaactacgtagagtactaaattaggtaaagcattgcacacggttacctacccattgaatcatttcatcgagcagtaggggagcatgggcacaaagcaatgtacctaacagctgtcttcctcaatgctgccacgtgctccggcctcatcttcatgcttttagtggtggtgactccggcgctggcttcctgcttttagtggtggcggcttggaggctgcagatgacggcaacagaggcagggtcgtgagctaaattctaggggttaggccgcagtagcggagaggaggacgatggcggagtagagaaggacaacgacagcgcgaggaccctcccacagatcgaagcctcacctcgtgcagtcgtagaagtctcggtctccggcggatgcaaggggattgagggctggcgcccggcagcggtgatggcgtgcgaacatgaggctaggtggggaggcatggatgcgaggttgagtgcactcggcggattggagtgcgaccgacggcagtgggtgaggcgaggggcgggtagaacgtggggtggagtgcggccggtggcgtgggtgaaccggcggtttggaccgcggcgaagctgggggtgcggtatgagggattgaggggggcgtcggggagaaggtttggcgaggcaaggcgcggcagcgagggcgctggtccggcagtggagtgcggcgacggcgtcgggcatcggcggtggagcattagctgatcggcagcgtcgggtgagttcgagacagaggagggcagaggcagcatcgggggattggggaccgcggcgatgggcgatgggcgagggggtgcgtgagaatattcgcaagagaaggggcgcgtgagtgtggcggcaccggcggagcagatcgtggcgatgagcgaggggcaagggcgtaccggcggcggtagcggggatttgggcggagccgcggagcgaggaggagtgaggaggcggagggattcgagcggcggagtcatcgcgcgggcggaaagcgcggtggagaggaatcaggtgggattggtgatgatgatttcctacagcgaggaggataggggatagcgatggacggatgagattagatgagatggcggatggacgaatgagatgagatggatgatttgtccggtaggattgctagaggtgaactcctttttatattagtatagatgtcactggtaatatgctttcctatagctgatcttttccctcttcggtcatgttctgttctgcttaccacacctctcctccacccaaaaaaaaaaggtatggaacatcatcatgtagaaactaaaatttaagttgactcaaattaagtagaaaacatgctagaaagaagtatccctccctcactgctgacaaaaggaatgagggcttcaaaagaattgagagtacaggtagcggtcctagcggaagaaaggaagcatatggagcaatgaattggtctgcctctactactattagaggtaatctgaaaatgatttataatctcatttggatacagttatcataaatatgtaactcataaactcccagtggtgcagtataaatttttttatatgaattttgaatagcaactagatatgacacccatgcacattacatttacagagagcatatgacatgcttgcaatgatcaaacttccgaagaaatgtgcggttgttgttgttatgagctgtgaggcccagcaagcagagcagattagtgtgatttattgattctatatgttaaaattgatatactacatcatgtttctattttttgtagtgcagaatttttctagagataatttgtgtatccattcaataatattttttttctacaactaattcaggcaaacaacaatgctgggatgatttttataagcaggacatgaacgctagaaagctaaattgacaccctggtgcctcccgtttatagatgtcaccaacaagtaagagtgttcctctcgtgtttatattggaatattgttattgcttctatctgtaaaacctgaaaaatctgaaaccattcctatactgaataatagaagatataaaatgaatatgtgttgccattgcatccttatatttatttcttcaatccacaattaactatctaaaccacttttttttattttaattcacataaattattttcgttgctggttttagtatgaatattttgatatatctccgtgcaaaaaaggattttgatatagctatatgcatgtgcattgccattcgattccttttccaatatgtaacagtagtcattgtaaatatactttcatattgtttctctctgttggggcaagaactctgaaaaatgatatttggggtggttgataggctcaccaggtaaaaaggtacttcatactatatatgtctagattcattgacatctatatgaatgcgggtaatgctaaaaagtcttataatatgaaacggaggtagtagaaactatgtaaagaaaacttccttcaatttagtttgtatgggcattattaagttacctaaaacaaatactaagaattttgggtcaaaaggtatgttttctccacataattttgatgtaagagtgatatggttcaacccataactctttaattttgatatgggtgttcagttgctacttttcttctttttgcgggaaatttatttgcaaagcactcaatttactgctctgcaattgcttcacaggtaacattcatgctttcaaatctgtactgttcattcatctatgaacatataaatgtgaattttatactgcaaaaatagctcaccattcagtttcaatagtttatgttaatgtttccgtataacattggaaccatgccccatgcatccttttattagcaatattaactgctcagatcgggctgggggtgttatcttcagagggaggaaagtgtgaggaaaaagttttcatggcatcattagttgttcccctaagaaaaacatatgtattcacctggatatttacaattttttgtttatcagaaagtaaatgatgagtataaccctaatcctctcattttagtcctcattttagatcagtattccttattgaatgtaaaactgaagttacactgatgcatgatcacagaattattctatgggattggttgttatttgtactactgagtactgaccattctctcatgatatatgaacagagcatatgctcctagcaagaaatgtggcatgggtgagtttatagtcttgctttcaccatgtatgaaatgtggcatgtgagtttatactctttctttcaccatgttgactttttgcacatttatagaatcttttggtataatgctttgtgtcgattcacatgttttattaattattaacgaccagctgcataggaaaactgaggatgtacatggttgaaaagcctataacattattactatgttcatttatctacaatcgtttggatttaagagtttaaaggataatttactaaggtggttatctctggtaattagtttcttgtcttcatctactccttttgtaccagaaaaaataatttttggatgatgataatatactaaggccaactgcagatgttgtgactaatattgcacatcttcagtgcatgcttatctagggtggacactatgtttattcccgacagttcttaatcacttagaaatagggttatgaaattcagcaacatatgtgatttgatctgaaagaatcatcaaagagttcatctttgtgtaagcttatattataaaagattttatgccaacattttatctttccaacacgtgtcttgcacgtgcacgattactagtatataatctaaccctaagtcaacaggtcaaactccaaatcctctacccatccagatctgcaccagccaccaaccaccacccgagtcagtccgccggctccgggagcccgggagccacgcgcgccgccgttcgccagtccaccgggagcccgggagccgcgcgcgccgccttttgccagccaccaccgacgccgttcaccagtctgccagccaccacgcgcgccgccactcactgccttctctcgccgggatactaaagctgtcatcgccggccgtcgccatggactgaagtcgccgtcgccggccgcctttcatcaatgcgccgccgggccggcgcggcgcctgcagccatcttcaccgggagccgctatctgccgaccatggcttcggcctcccccccccccccataagctacgacagcgacgatgcaaggagcatttttggagcattgtgatctataatttgctgatttgttgaatggagcattttggatatatatgatataatgtgactgtgaatatgttgtttaaccgaggataggttcaccacgaggaaaatttcactgtgtggtgatcggggctgaaataattatagccccgtcgtggttgacgggggcgaggacggtgaaatattttcactgcggtgacggggacgcgaacatgacccccgacggtgaattcaccgttgccatctcagtagtgcctgtgcctatgctgtgaatcagctggggcaaggcaaacagttgattgatttacagtgctgcatccatttttaccggccgatggagtagtactgcaggtacaggagcaagcgaagcaaatgagagctaaatggtgctgactaggctccgagtcagagccaggctgcagctgacgtggtggggtcgaggggaggagggccggcgcggcgggtgcagccagtggccgacggggaaggagtgcggcgaaggctccctgccgctgaacctccagcgccaccgcagccttggccacctcgcgccgctattgaggttacccacagccaccggagtcgcacaccctcctctgcccttcctcctaagaaagagagaaaaggaagaaggggatcttcaagtgggtccaccattttttttccagatcaaactgttatgtaagtgccacgtggaatgaagacctagtcaaagaagtcacgtaggtgtcacgtcaaccaaaatagcggacaaataccactgagggacctcgtttgcatcgtttctgtaaattgagggatgtgttatatttggtattttggtttagggacgatttttgtaattcggtgaaaagataaggaacctcggtgtactttgtccatcgtataagaattagacggtccgattaaactaaggtgaagcccaataaagcaagaaaggcaaaggtggccctgcaggcatgacacacgacagcaggcgaaggcgaaggcgaaggcgaagcccaagcatccatcatgagagagaaaaagaataatatgccactccattcgttgggtttagacaaaatgtcacccactaaaatgcaaaggataaaatgccactgaatatattaccttcaggatattttgccacattaaaggatttgattttaagacaaaaataccctcgactgtggaaagaaatggaggaagaaagggaacggctctactcgctagtgacggaggcgagcacacgagcacgcgggggacgcgctacgatgggggaggacggtggtgacgctgacaagagggagggggacaccggatggtggcgatggggggagaaggatgatagcgctaacgggagggagggggatggcggtgttgacgggatggctttgcgcgctcgtggcttgtctcctccggcgccgcccgtacctggcactcactgctcgccgcctccggcgtcacccgcacgccggcgagcacgaacgccgttcagcttgaccttcttcggtgctgctctctcccctcttttttcatttctctccccagtcaaggatattttgatcttaaattctttcaaagtgataaataattatgaagatatcatattgagtgatattttatcctttgtattttagtgggtgttattttctgtaaagccgatgaatggagtggcacgttgtcactttttgtagcgcccattccgtcgtagcgcctagcgagaaaactatctcttaaaaaccctatttgcgaaatccgtttctttgcttgttgtctagtgtccgtgccaactcagatctcaaatccccgatctattgtcgagttcaatcccgaatccaaatccttcccaaatcaaatccctccgcaaaagtctatttagcctccctcgagttcgatgggtcgaatccctctcggcccatctcccccccccctctctctctctctctctctccctctcccccgctctgcccgtgcgctgctcacgcgtgcgcgtgagccgcgccgagccgagcgccctccgccctcgctgccgcttcccgtcgacgccgccgaaatcgccgcgccgcccgttgcttcccgcgcgcgcgcgccttggtggctgaccgcctggtcgctgccgccgtcagcatctcccgcgcctgcccgcgcctgccgcccgtgtcgccgctccgctccacaccggccccgccgtcatcgccatcgtcacgacccggcccccgccactccacgcgctagcctccaagggatggaggcagagctcctcctccctctgccgcgtcgcccccgctccctcctccttttcccaaagtggcaaggggcaaactccctttctcccttcctttttccttttcccctccccgccggcgtcatccgcctctgtcgccgttttggccgcgagcgccgagcgccagctcgcgccttgaccgcccaaggtcggtttccaaaccgacatcgtcgtcctataaaccaaggcgccctcccatcgattcctcctcccgtttcgcttgccgccaccgcgccattgccgcccctctgtctcgcctccgccgttcatcgccaagcaccgggagagccggtgcgttcgtggacgcggaaggggactccgggcgctcgccttcttcctcttccccggcccgaggccggagagatcactcccgtgccgtcggcctctcgtcactgcgccccgtcccgcacggtagtgcatccctccgttctccctcctcgttccatctcctccccttagactcgggtagtagcatgtgtagcctccccgtagctagccggcgctgccccgactgctgccgtcgctcgccgtgtgctcgtcgctgtcgccgcccgtgctccgtagcgcccgctcgtcgccggcctcgctcggcgtagctccgcccaatccgacgctagcaatgggttcccgtagccgcgtagatgctctcgccgccgggaatcggcccctcgtgacctcatcgccgtttcccccttccctcgccgccggttgccgccgctgcaatccgccgccgtcgagctccctccggcgaatccgagccgttggctcgtctcccctcgtcctgtgcaacatcccggtgtgctcgccttcgcctgtatcgccatggttcgctccgccgctcgccgccgtcgtccgccgtccgttccggccggcgtcgtcgtctacctcccgccggcccgcgtggcagccacataggcgccacgtcggcgccacctcggccgcgaccggatcggctgacccggccagccgctccctccattttccccccgtgcgcatggtccgcggtgagccgtgaggttgcgcgtgggcccgtcgcaccgcgtcctccgcgaaccgcgcgcatgcgctgcgcctccctccccaaaccctagcacgacccgcgtgcacctcgctcacggtgagccgagtcaccgacaagcgggtcccacccgggaccacgtgggatggacccggcccaccggctctctctctcctccccgcccgcgcgcgcgccctgggccgccttcttgggccggccggcccattaagcccggccgagccgcccctttcgctcgggccgcaccctagccgcccgagggaagtctaatttccctccctccttcttttcttttcttttctttttcaaaaaggatttaaataaatccttttcatttagaccaaaaatccaataatcttagaaattcaatatcttcccaaccgtaagtccgtttgactccgttcaacttccaaaattcctcaaatctcgagatctatctaatggcacgcttagaggtcaataatagggctttattttcgccgtttgctgagttgtcccgtttcgcgtgtagtttcggagcccgaagacccacagtgcgaggatttcgaggatcaagctcaagatctcgagcaaggcaagccacctttgaacatcttgagcctatatttgaactaagttatatttcttgcaaaatattatgcattgctaggattgcacttaatatgtttgccccaactacgaggcagaacggtgagcatacctaatttgttgcatttgatccttcctttgttaattgttataccatgttcccttgtacccacctagttgcgcctcagcaatcgtgcactctgcacgggtatcaacggtcgccttcaaacttaaaatctgagaaacatcttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccgagcatatgatagtgcaaccacatgggtggaatgggacacccctggctgagtaattagctaatcaggggagccttgatgctgagagacaagtggatttgccggggtggtgtcggggaggacccctgggcttcctggcacagtatggtctgggacctaacctgttgttggtctgggacccctctcgtcagcatatggtaaacctgtgtcggctttggaaatgccttgtcatgaaagcttggaggtctcccgacgtggctgatcaccacgagctgggtgatccgggttagtaatgtcgtgtgggtaaagtgtacccctctgcagaggttattaaaactgttcgaacagccgtgcccacggtcatgggcggatgtgaggtgattcctagcgtagttttgtttactgccttgtgaaattgctgttgtggaatgggtttgatgtttggaaaatctgcggctgatgggatcagccaggcccgggtggccgtttgaaagctgttggccgggtgccaatcttgatcaattcaaaagactgatacattgcacatactccgaccggacgagacacactgtctcatccgtgtcgtttgagaagcactcacttagttgtttcagaaaagagttcaaataaaatcaattgcaaaaacaacagcctttccttgaagccggcattaaacacttatttcccatggcttgctgagtactcatgtactcacccttgctctatataaataatccccccagttgctgaagaagatgaagcggatcccgctgacaaggagttcttccaggagcaagccggctacgatgagttctagggtttcggcctagttcccaagtcgcgcctttgatgtttggtccaagtcttggcttccgcttcccttttgtaatgcagttgtgagctcgggatctgtccgcagcccaacatgacagtactcctactctataataaagagacctctgttgctgtaatattctgtcttcctgtgataccagcactattttctgggactggtatcgattaacaagttaatttggagcgtcacgggctagttccggttgggactagttcggggcgtgacacttttctgcgtcaggaggagcccagtttgggggccaaagacgctgaagcggcggtcgctctgcgctgtggttgtcgcagggttgttgggcaccggcgcaagatgcaaccccctacccatcatactgtacagtacagcgctgtgattgtgctgtgaatcagccggcgcaaacagagaaacagttgattgatgttttacagcgctgcatccatttttaccggcaaatgaaatagtagtactactactgctagtccagccagacgtccggtagagatgaaaatgaggtacaggagccagcgaagagaagggatgaatggtgctgactaggctccgagtcagagccaggctgcatctgcgcagcagcctatccaatctaatccacacgcagacgcaatactggtagtactgtgcacaaggacgggagaagcagcatgcctgtacaagagttttgtcccttgcgcggcggtccatctcgtcgcgcggtgcggtctctgggtgccgcgcgcggttttgcgaaatcggtttcttggctttgcgtcactcacatgagatgagatgagttgcccatgtgcaccctgctgattctctgattcgccctacgcgatggccggtgctgccggctcctgctccgtaaacagcgcttgcatttttccctttaaacaaaacataggtatctcttccgctccgttccattttctgttactcctactgtagctactctaatctcattctgcgtgccgcccaactgaatgagtaattaatcctcctcttccctaggtgattctgctctctcgtcttccaacttgcatcacgctcgtctcagacatcccgcaactgaccaccataccatacgtcttcctatacacatgtctcggatgattcaatacattagggcaagtgctataatgtttcatatgttgcttctacaagtgccacattatattgggtgatgaggtggaggagaaaagtaaagagagagatgatgagccacccctaaatcaagagacaacctccacacaaattttaaaaaggatgtgagagtattagatatattggtatttgtgaaataagatggtaaattgtatgggttgcctcttgctttatgagtgaataaaatagataaatttagagatagtagtcacatctaccatagcatttgccttatacacgcacaactgtggcctgctcttaatcaaacgaaaaaaagaaaaaaaatacagtactccagtagaaagagagcgatataaacaatacggtacgctgttcctgtgaaatctgcttcaccagcaccatcaccgcgatcaccttcccagacaggacagcttaactactgcagtactagtagcttatggctggcaaaaccgtgctatcaatagcaactggtgtactgtacaccctttttctgcagataagtttgctatcaatagggaaaaatcagtcgtacatatccacttattttgtccaacaataggctcgccgcgcttaagctggatacaaaacacaaagtgatcttgtttgttactccatactccgaaatcgtctccagatagataacccgaatagtaaaatgcgcagctacaccatgtttcccaggctaattgatctgtcccagcaatttccaaagcacacgaaaatccgtggagctaattgacattaaaaataccctacagctaggttctcgaacagaaaatcaaagcaccgactgcacctattccaaacaaacccactgaaaattgtgcgaatagtcaatcagttttaaattataagtcgttttagcttttatcaaaatcaaactacttcaaatttaattaagtttatagatgaatatagtaatattcacaacactaaattagttttattaaatctataattaaatacattttcataatatatttgacttgagataaaaatatccttttttttctacagatttaattaaacttataatcgagacggatagattatattataggatgaagtatgtaggagtagtttattaagggcatgttcactttaattttattttcaatcttaccaagttttgataaagttgtcaaaaaagtggctacatttagtttgctgtcaatttttagtaactataattgccaaaattttggtaactatactaaaattttgataattttaatgttttttttggcatcaaactgaacatgacatcaagcttaatgcagcttgactgttaatgtggtatgataactcgtactgtcgtacaacccgtttaatactcgatgtcactatcaagtcttttacagtggtaaagtacatttattacgaaggcagattgggggtggtgggtcacccatcaacgctccctttcgctgtaacgtggtccccaccgagacttgaccaaaaagcacatttgccacacgtcccccgagcgtgcaccaatacacgtggcatctcaacccaccaatacctatatacccaaccaccgctcgtgaggcccccagcttttaatcttatccactcacccccccaaccctttttacccacgccaaaaaaaccgacgcgcggcaaccgctttcctccacgtgtcccccatccgcaacgtccagtgagcatcggacggtctccaggatttaccccatgtgaaagccgttgcggtgaaaaggtgaaaggggtaaaaggagtgcgcttttttttcctttctgtttctccctcctctcgtgggcattaaaaaggcgcctcttttctccttcgccgcatctccccatccgccattgttgtgttctcatcctcttcttccatctctctctctgtgcgtgctctccgacgtctctcctctccctctcgcgtgcttggtcgctgtaggagggggttcaattgatttgaggtagccatggctgaggcactgtgcagcggcagcgtcgcgtccccgtgcggggaggtgggtgtggggttcgccgccggccttgtgaggggcgccgcggcggcggcggcgctcgcggagtctgtgccgattggtgggtacagcagcaagagcacgttcccgagtgggagggtggcgctcacggagaggaaggcgaggcccctgccacggaatctcgaagcggcgcatgggcaggtctgttcgtcagttcttcaggagatttttcagcacataatttcatatttttagttctaggcttttggataatactgcaagcatgctatttttaactctttttggggttgggatttagttcgagcagttggagaagttagctgagttcgcgtcggatgcatgctaacgttttcaagttttgttgctttttacagatgaacctgacgattgggaaggccatgaggtggtgggagaagtgcctgcagcccaacatgagggagatcgagtcggcgcaagacctcgccgactccctcctcaacgccggcgacaagctcgtcgtcgtcgacttcttctccccgggctgcggtggctgccgcgccctacaccccaaggtagaatccacgcccaaatcctcttcagtttccaataactgcaagtgttctttttcctttttttggttgctgatgagaatctgtttgattgtgccgtgcagattgctcaactagccgagaagaacccggaggtgctgttcttgcaagtgaactacgagaagcacaagtcaatgtgctacagcctccatgttcatgttctgccattcttcaggttctacaggggagctcagggccgtgtcagcagcttcagctgcacaaacgcaactgtaagctcctccccaaattatgtttctgcaaccaaaacaccaatccatagtagtgggttaatgtgctaacatgcattgctgcaaatgtgattgcagatcaagaagttcaaggatgcacttgccaagcatggtccggacaggtgtggcctcggcccggcgaaggggctcgaggagtcggagctcatggcgttggccataaacagggacctgaacttcacctacacaccaaaccaagaccttgtcccaattgcagacgccctcctgaaggaagctgctgcacctggaggtccatggctgccattgcccgcaacggcgacgcagctgttcattcagggatctgagaattcgctgttgtcatctggaagatagccggtggttcgacggcaagattggcttcaatttgtacatatttttccgcttgttctagcctgatgttatgacatgctgatgcgcaggctcatgatttttgtttatgagcctgctgagtgctggaggcatgaaattccttgcctgacggacctgtatgcgtgatgcacgtctgcatcgaaaattgaacatgctagattcattcatgattgaatcccgtaatccctgtagtattcaggtcttgaaagctttgagttctgaatgagtgtacttggttgtgtcgaaaatgtcggtacttggatctggatgctgctttacaccatgtcatgattcaggaagaaggttactgctgcctaatcaaaatgagagcaatacgaattgcattgttgattgttctgttccatcaattgggtacagcggtgccaatttgtagtattattgagagatcatgggtaaggtagagcatgattcttttgtcatggaagagtaggcaacggcgtagtgggctcaatattgcgagttggaaggtaacgcatggctgtagtaggtccttgtcactgcactcacatgagggtgtcatctttgtcttgtacagacggatagagtcgttacggatattgttacgcaggaatcagctatacacttgtttaccatcagaacaaaacggtaaaatcctgatagggttgaatttggaagtgaattgcagaactggacaattcggattggtaaagaaaagccatgtcttgacagagagtttggaaactcaactacagaacttgacacgtcaggttgggaaaagaacagcgattgaaaagagtagttcagcatcgaaaaaaatatctagacacaacagaaggggagcaacctggatgaagatgaagatgaagaagagctatccaattcgcaagggcattgtcaatttctgatgcagtcatgcagctgacgcttttggccgtctttaacttgtggcacaatcgtcgtcgtctttttcctcaaagtgtctggatcatccatgaactgacttgaaaaatatctgaggtgtgataactaccagaagaatggataaatcacaagtacataacacaaaaaataagatcgataaattgggtgggaagcacaaaatttgcagattttcatggatcttaccagttaccactaacctcacacggttggaaatgatgaaaagatggaaggacaagatgagaggagggagggcctgaatttcaattgggatggacggaactggtggcgaacttgtgccgcgtcgaagtcgaaccggccggccttctctccggcgggcggcggcgatcgtgtcttgaggagaggagagacgctgaacagaaggacactccgcttctttcctcggatgcgatttgtcccagttacagcccaatatcgaacagagataacaactgacggcccaaagtggggcctgttactaggtgatggcccaacagaggaccatgaatgttctatcgtagagcttggcgggcccattaacaatcagcaaccccgggctggtcttggaccacacatcctccaagaatagcccgttaacacaacacgagtaattcggaaggaataagtaaccccggcggcgagtgaccggagaaggcgggtgagcacgcggccggcggagcggagtggcgacagccgtgccatctgctgccggctgtgcatcgagaagattggagaggaaaggagaagagaagagaagaaagataagaaaagagaaaaaaaatagaagaaataaggtatgtgggacggtaagtgaacttattccaatatggaacggtccgacgtcacagcccatatggcctgttaaagcctgcttgccatccattaacatttctttagttgaaatccggaatttctatctagcgctgtttttgaaattaatgtttctaaaaatagtgtgcgtagtccgatgacctgaaaaattcgtgcgcatatgcccagcatatatgcaagttgaatcaagccccaactgtatgtgtttatatatgtgtcgcccagcgagaggagctcttattgccaggtaattaattaacttgtacaagatacaagcacaccacacgataatcatacggtacggacgagcataagttactcttagctacgtatataggtgggtagctagcagagaataattattctgcaccagattcgttgatatcaacttgagccttgatagagagctggatcgatgtatcgatcagctcagtagtagggctggatcttccagcgctggttgtcgccctcgcaccacttccagagcacgatgtcggtgccgtcgcggacgccgccgtggtacttgtcgccgtggaaggcgtcgaagttgaggtagatgttgttcaccatgcggatgcacctgaacccgttccccacgtcgcggctctccgtccacagcaccgactcgtccatcacctccgggttgtacggcaccagcctcacctgcacgcaagagcatcgtcgtcgatcgccatcaatggccggcggattcagattcagagaaagaacgctgagactagcttacagggtgtgactggccgagggagtgcttgatggcctggccggtggccttgttgacgagggcgaaggcagggtagccctcctcgtccttgatgctggtgctccacctcatgtccttgatccaatgctggtactcgtccttggggttcgccggcgccagcaccaccgcgccgttccgcgccgtcatcgcgtagttcgggttcgcccggcagtacaccttcaccgtcggctgcggcggcagcgtcctgccacacccgttcccctcgatgttcacctgcgacatcccgtacggcgccgccggcgcgtaccccggcgtcgccagggcgccgccgccaccgtacccgccatacccgccgtactgctcgcgccgcccgtaaaagtccatggcttcttgatttatgactcgctagctacctagctaattaaacagagattgtatagctagctgcagagtgcgttgttcgttcgatcgttgatgtgctgcctctatgcatggcaatgggatgggggatttataggggatgatcgattgatcagtagcactgatcgagatgctatctatctctctctctctctctctctctctctctagatagctgatcgatgtgcattattcgtgcactgcatggtcaggggcttaggaacttggtaggatagatgatgccattccacacttgcgctttcctggggaaaaggtgattccatccatccatggtgctttacgtgattccgtttctagtcgttttgggaaccatctcgatctggctgccgtattattgcaggcgagcgcgacgcgagacgatagcaaagcacacggtgcagctccatcgcccggagaatctcacgtattctcatgtccttgctgcgttgtgatcaagcagagaaaaagtgctgcaattccgcacaagaaaagattaaaaaggaataacgggatcgatcgagaagaaaaggaatcagccaagcacatttagaaatttattagggattacctatacaatttttcgacagaaaattccccgggcgtgcagtgtatccaccagaaatttgaaaatttggccaaaaaggaagaaaagaaaagggagttgggggtgggactaatgggtctaaattcttaacgggccgatcatgaacggaagttacacttattctccctcaactacaataataccgagcataacactaatcatgtcgtaaagtgaccattgagcagcttgaaaaaactaaaattttgattacgaaagtcgataaagataagagtttcatcaagatactcttagataggacaagaaagagcaaatttgattgatgccacctctattagtttggaacaattagaaaagtctaaaaaggaaaccctttagtttgaaataaaaagagtgatgaattaggtccaacaatgagttttccaacgaggtcgtacaaggagctctagaaggaagctaacctagttctcaaaaaaaaaaaagaaagaagaaggaagctaccttattggcaagttgtacggtggttttctacaacatggcgttaattgcatagtggaaaaaaaactggaacggactgacagtttaaccggaaaaaaatcggaaccagaggttggcggccggttttgtgatgaaccgggcaataaaccgcctttggtccagccggactaaggcaagtcaatgaatgaatgggccacacgatggccggttcatccctggtcaatgggatgcatggcaactcccgtggccatcctaccaatcggatgtactctctccgtttcaaaatgtttgacaccgttgactttttagtacgtgtttgatcattcgtcttatttaaaaaaattaagtaattatttattcttttcatatcatttgatttattgttaaatatactctcatgtacacatatagttttacatatttcataatttttttgaataagacgaacggtcaaacatgtgctaaaaagtcaacggtgtcaaacattttgaaacggatggagtatgtgttagcattgaaatacatacgttacatgcatgcacttagtaaactgcggttcgatcggctggttcatggtcaaactgtccgagaccggtgaaccagaagggtgactgggtcatctaccggtccggttttttccactatggttaagttgcatccggtaaggaaaaaaaaggtgggactcatcttctcccttcacacctccacctctcctctcctctcctctccctatccccccgctctctctctctctctctctcggacgggcactatggctcgtttgtgggcatgtgggcatgctttagcgtaacactatggttcattggctaggttggggtctctgcgacccatcgaccaaaggcgtaaggtggagagtgaggaatgaggaaggaggagggacatgtttagattgtagccaaaataaacgttaccaagttttggcagtgccaaaatattggcaagatgacaatattgctacaattttagcaggatttgtgatcaaatttggcaacaaactaaacatagacatattttttggcaactttaccaaaaatggtatgatattaaagtgaacagacccgagattataacatctgggaccaatgattttttttaaatcagacatgtggatcctattcttcatatgtttttttgtttttttccgctgattgtaattacatgtaagtgacttatcaggtgaagactaggtcaatattttttccacatatgatacaactgccgtctaaaccaccgcgggactcgatatacaatgttttgatagtaggggacgctctatacccattacttgaggtatctaatgtgaactcttttctttttgtggctacctgcactgtttgtacgtatgggccatgatgcagcccagtgcactaaagcccaaccaggactgccttgccggcctcctgcgcttggtgctcttcgatcgtgtgtcctcctccgtggcctagccctagccgcccgttccaatccaacggttcgcgacggccagaaggggttcgtccgggtgaataaaaatccgaaccccttcacgagatcgacgccttggacgcctctctgcttttcgagttcgacgaaatcgggtttcgtcctacccaaattcaaagcattttgtttcatcattatgacttggagaacgtgttccagtaccacgccttttttttcagcaaaattacacgtcacaaacagaagaaggggaaacaacagggtcgagacaaatgagccattcataattcattcattaggcatacgaaaagtagagagtacaggggaaagcaagatgagttgcatcagatttctgaatcatatggcccctcctcctgcacttacatcacccactgtttcatctcatagcaatcactggctcgcaaaaggacacacactgacacaaactcgaggacggacggacaccattgactgccatactccgatcgatcgaacgaacgaacacggtcttatttcggtagcagatcgatcaaattattagctagagtagaagcagagcagacgcgacgacgatggcaatgcaatgcagctccccctccccggaatctctgcagatgcaaagaagcagcaatccaagtgtcagaatctctgatttcttcagaggatccgaaggaaattaatcgatcagcgatggcattgtgcattgttagcggtggaacttacaccaggggaggatcttccagcgctggttgtcaccctcgcaccacttccacagcacgatctcggtgccatcgtggatgccgccgtgatccttgtcgccatggaaggcgtcgaagttgaggtagatgttgttcaccatgcggatgcagcggaagcccttgcccacatccttgctctccgtccacagcacagactcgtcctggtactctgggttgtagggaaccagcttcacctgcatgcgcagagaaaatcgttcgttgtgattcagagattcgttgcatatgtaagaaaatatttattttgtaagaaaagatttgctcaccgggtggccctgtccggtggagtgcttgatggcttcgccggtgaccttgttgaccagcgcgaacgccgggtagccttcctcgtccctgatcttgttgctgtgcctcatgtccttgatccagtgctacaaaccacaaccacaaatctctcaaggtttttctctatctgaatagtagtatataattaagaggagaatacgtacctggtagtcgtccctggggttcttgggggcgaggcaggcggtgccgttgcggacggtgaggcagtagtcctcgcctgcggcggagaagacgcggacggtgtggacggggacgccgccgatggtgcaggcggtggcggcgccgggggaggaggagtgagcctcggggccccaggggaggatcttccagctctggttgtcgcccttgcaccactcccagagcacgacggtggtgccgtcgcggacgccgccgtggtccttgtcgccgtggaaggcgtccaagttgaggcgggtgttgttgaccatgcggatgcagcggaagcccttgccgacgtccttgctctccgtccacagcaccgacgcgtcctcgtactccgggttgaacggcacaagcttcacctgcacacccatcacccgccatgagtccatgacatcgaagtcaacgttcttcgatcttccatggcagcacgcacaaagctagcagcaaaatagaaatatagtattacggggtgggactggccgagggagtgcttgacggcgagtccggtggccttgttgacgagggcgaacgccggcatgccctccccgtccttcaccttggtgctgaacctcatgtccttgaaccagtgctgcatttcaattcattccatttcagtatacatcaaaatccgatcgaatatagaaacaaaagaaaaggcatatataagaagggggacctgacctggtgctcgtccttggggttgacgggggcgaggacgacggcgctgtcgcggacggtgaggcagtagttctcgttggcgcggcagaagatcttgaagatctggttcgggtccgacggcgccgccggtgcctggttgtggtggtgcccgaacccaaacatcttcgacccttaattcgatcggtgcaactcgcgactcgcgagagaaatgtttttgtgctgcgactgcgagcgatgatgcgaggaggagcgagaggtgccacgttttatagaaggccaaggccggccactctcaccctcacccactgatcgatcggctcggctcgatgacgcgctctcctgtgccaactcccacgttcgctgacagctgggcccaccggtggtcctcgactggctcaaacgcgtgacatgcgtgcgtgtatgttttgcattctagccgtttgatttgaatatttgatatgatatgatatatctttggtgtttaatgtactctcagattcggttccatgaacttgacttggatgctagtaccagtaattcattgtgctgagatttgcattactaaatgtgcgagtaaatgcaaagatttgattactggtgcacagttaattgctctacttactcagtggaagactagagcagtacaccaacttcattgagtatttttggagcagcctgatttcttacaaccggataacataatatcactaccattaccgtgacaggtatgtgggtcatatactcctattgttccacacgtcagtgcttgtaatggtagtgctgccattatgatagagaatgtggatcccttccaacttgtaaaacaacactttctttttcagaaaagcataaactctttcacccgaaataaaaattaaggggaaaaaaacaatctttgcttaagaaaagaacaaagagagatgctgcttgctcgctttccattgtccgggaatttcgaccattgttttccccaaaatcgaaaggtatgtcgccacgaaggacgaggtgatcgaaatgcatgccgtggcccaggattgaagcgtgcacctgacgcaaatccataaaacaagctaagagatgtgattccagctagagatgacccttgtgacggtcgttttgtacgtttgcatccctgtgctacacaagaaacaaaggcagttttacttttctgaatcaccatggatcgcccatggatggatggttcgatcatccctgtccgtttccaatgagcacatctaatctgacctgaatgatgcatgatgcatgaaaggtggtaaaaaagttgttaactgataagagaataatctttttacccggcaagctgctctatatcacggccacgcagcgcctgtatggccaagaacgttccagatttcaacacctaattaatcgacgcgtcgcctgccttttgcaatgcttttacaggcttaagctttgttgttgtgcttaacaacaatgcagcaggcagaaaacgggttagctacatgcatctccctttgatttttgttgtcacgtactactctctcaacttgtcaggatgaaaagtttcgactctttaactttctcaaacgaaaacaagtcaagttttcgcgaacatttggagtgctgtgcagatagcaacgcgttgctggtttgtagtagtatagtaccgttgtttcaaccgttctacccttatagctcccgcaatggtaaaataaggtactctctataaaacatatacatctcagcaatagactcgattaatagtaaaccaccttaatagtatgtctacatttgtatctatagctctctcatgcattgcctcgtttttctctatagattatctctaagttagtagatagctttactctctctcttcatttaataccttctaagtaggaaaatatactgacatagatcttttgtagagagcttataaataaccagtgataactttagaggagtaggtgaagcctgtccttaaactcaccttacaattaggagtagtaattgctatgtgtaggttgtcctgtggagtttgtggacgttggagcagatgatgttgcatttgctaaattggtaatggtgaatttattattgtcttggtgtgattaggtgaacacttttgtcctgtctagctagtatagtactccacaaaccaaccttgacgatttcaacagaaaataaaaaggctaatctaatctgttagctaagcttggctgggtttatctggactggatggatcatgggtgtgtgggtttagctcaggtaggcacacgttttgccaccctgctcgtatactccctccacccttaaaaaaaactcaacctactgatctcttctagttcagatttattgtcttaggatgtaacctcttctaggttaagttttttagacgagaaaagtattactctatgatatctccctcgtcataatcgaaaacaagggtgcttatctcatgaagtgccatgtggatgtggatcaacaatccctagctcaaaagcattttagcaggggctcggtttaagaaaaaatgttgttttcgcaaagggttactaatatatattactccctccttcccatattgtttatcatataataaaatttaaaatttcttaaattaatcatcatataaccgtgcgcatggacacgaatttcatcggaatacaactaatgtagcaagagagaatgtgtgcatgctaaaaatgtaattggcatggtattttaatcgatgcatgtattgtgaaagaatatgtgtatggtgtctttattgatgcgatttaaattattcttgttcttggtgtataaacatactatttatggttaatctatttgggatgaagggagtactatttatggttaattatttttaaaattagaacggaaatggataccttgacctttccattcgcatggcaccgtgttgccttgtgttttaaagttttgaactcaattacatactaccttcttttcaaaatgtatagcgcctttgatttttttataacatttaatcttattaaaaaataatatgtaaaagtataaggtaagattatattttatttgatgataaaacaaatcacaataaacaataatatttatataatcattttgaataagatgaacgatcaaatgttatgaaaagtcaacgacgtcatacattataaatggaggaagtactacttatagtgtagtcacagtataactaggctgtaattacacccgagttacatcgatagtttttttgtttaaaatcgatcgatagcgctacaggtagactctttttttttttttgtagacgacgtattcatcaacaaggagaccgtgagtgcttttttatattggcacaatctttgggtgtgctttatattggcacagtctgtaaaggtaggatgtttgtgggtgcacggaggctgtgagcatgtgtttagcaaagaaaaaaaaagcagcttcaatgatgccttcattttctcttgaggaaggatgttttgggctggtgaaattcacgtactgaatgtttggatcatcgtcgtcatgtacagctaataggtgggccattcatattacgaagtggaggtccaataacaaaacttgggccatatttgttcggaaaaaatggatgtatttaggggtaagcaagaaaaaactgaaaccaaagaccaagctaaactgaccataccaagaccgagaatttcggtatctatactgaactaaccaaattttgttcggtcatgggcttcggttgaccgaatcaaccgaaataccttctaagccctataagcccactaagcccgatagagaaactctaattttccacccctccaagtcccaacaaaccccacatccacaccacccaccctgccaccccggccttttggttgttgcgtcgccgtcacccgcttcttcttgccttcgcgtgttgaccaagccagcgcccccctccccctccgcccaacaagaatcgcctcagcaccatcgcgttgtgctcgcgcctcctcctcgcaccacaccgccattgtatagcctacctccgactcccctccagtcctctactcagacctcctttcttgctcatgctggcagtggcgcctcgactccaacgatggcgacatacagctggcctcccctcaacctctctgtccactcctgcacgtaccggcggctactcctcgactccaacaaagacgatacatcaagccgtcatccccttccctctagcagttttcttgatttgggcacaaggtggagatggcggcggagcaggagggcacatgcaatagtcggtggttggttgaggggctatcgacgaagattgcaacctggcctccccagcccccatccactctgattttttttattttggataattttcttgtgattttcttaatttatctcctgattattttaatcatgatcaagatcgagaccaaatttggtggtcttgataaatttctactattgtccagtctcttttcaataaccgaactaaccgaaaaaagacaggatatcaagatatcaagatcaaaattttcaatctgaccaaatgcccaccccttgatacatatgggccctattacacttttcactaattttggcccgtttggaaccttgcttcttgtctccgtctatactctagtactagtctactcttccaaagagaagatgcagattgttcgtctgtacttgatacatcagcttctcaatccaaactgtttgcttagtttggacggtttttggtgcacatatggagataattaacgtaggtttgctcaactgctctttgactaaatctgattgtgttgcgtgtgcatctcacacccaaaagtgcattgccaatcctatatataagaggacgagcagttcatcattttttttcttcatgtttagctgttcggccttgttgaaaaaacagcactacattgttaatttcgtccgtgatgtaagacttggacgcttgggagttaagagttagaccaatctgcatttttccaagataagaattgaattggacccatcggcatgcgaacaaacggtagtgtacctgcagagtactgacgatgggctgacttgatggcaacctagaagtctctagtccttaggagtagtagttcttaacaacaacattagactcggacttttgcaagcccttaatctgaaatctcgattctgttataaaattttagttagctgattttacgatttttacaatttttatgtatatatacaattttatgattatggccttacacggaaatttttttgcgaacgcgcaaaaggattgcacgtcagtatattagcaggaaaagagtttttgttacacaaaacaatcagccagactggcttatgcctaaaaggggggggggacttgaagctaggaactactacgacggttaaaaacacaactccaaacagcgggagggggcagagccacgctacatttccaagaaaaccccaaaaaaagtaacactagctaaagaccacagctggccctccgagcggatggactccagaaccactgcaaccgaagcgagcacagagtcgaaaaccctggagtttcgttccttccacagctgccaggagactaggagtaccaaggagtcgaagccgctgcggaggtgctcaggtaaatataccctggaggatgaccaccaatcctggagccaactgccacgagggggagagagggcagcccagccaggaggggacaacacacggagccagacctgccgagcgaacacgcaatcaatgaggatgtggttcgctgtctcaagctcctgagcacaaaaggggcaagcagagtggctatcgataccacgcttttggagaagatcggcagtccaacagcgctgctgaaatgcaaaccaaaggaagaacttgcatttagcagggcccttcgcgtgccagagtaagtcggcacaggcaaaagagtgttggccaaggaagaacgcctgatacgccgatcgcgctgagtagcactggtcacccgtccaacgccagacgaggtgatcctcaacacccggcgagagctgggtaggaagcaccgcgtcccagactaacaggaactgagagatgactgggacagtgagggcgccacgtatgtcaccaacccaggagttgttcgctaacccagcagtaactgtgcgcgatccccggaagcgtggaggcacggcgtggaggaggtcaggagctatagaagctatcgagcgaccatcgatccaccgatcagtccagaagagcgtggactgaccatctcccaggatagagaaggtggatgctgcgaacatgtcggagacactccactcaataggggccttcagatcagaccagtaggggtgtcccgagcgctgaagccagagccagcgaactctcaaggcaaagccagccaccctgagatccggaatgcccagtccaccgagatccctaggacgacaaaccctcgtccaggacacccggcactgtcccccattggccgagtctgtacccatccacaagaaggcgcgacgcttcttgtcaatggctttgataacccagcttggcaagccgatcgccatagaaacggagaaccgactagactagaaccgagcgacccgccagagtggttagacggcccttccagggggggagccgatgggagactttatccacaagcagttgcagggccgcttttggcagcttgcgaactgacagtggaatgccgaggtaggtgcagggaaactccgagatcgagcaaggaaaagaggactgaaccagctccaggtcaagaaccgagcagcggatcggagtaaccgagcacttggtgaagttggtccgaagcccggaagcggcaccgaagacagagaggatgccttggatgaactcaaggtcttgccgaacgggggaaaggaagagaactagatcatcggcgtagagggatgcacgatgtcgaatagcacggtcattgaggggaagaaaaccacccgaatcagaggctttgcggagcatcgcattgagcacatccatgactagaatgaaaagcatgggggaaagaggatctccttggcaaagacctctccgatgggggaaccatggacctggcaccccattaaccagtacccgggaagaggaggcactgagaatgagggagatccaatcacgccaacgttgactgaagccaagctgggctagcacctcaagcaagaaaggctagctgaccatgtcaaaggccttcgcgatatccaccttgagaagaagtcggggaacgcgtttggcgtggagcgcccttgcctcaatctggacatagcggaagttgtcatggagagagcggcccttgatgaaagcgctctggttaggcgccacaagctcgtccaggcgaggggagagacgagaggccaagatcttggagaacagcttcccaaagctgtgaataatgctaatcggcctgaaatccttaacatcaacagcctcgtccttcttcggcaagagggagattagggcgtcgttgagggaagcaaaaccttggccgttggtcaggaacaaggagttaagggccgccagaatttcgaccttgatcaccggccagcaagacttgtagaaacggcccgtaaaaccgtcaggactgggcgccttatcagagggcaaggacttgatcaccgcccagacctcatcctctgtgaagggacagtccagcccctcaagctgcgcagggcggaggccaagagagtggaggtctagggcgagttcacgctcgaagctcgtccccaagatggcgcaaaagtgagaggaggcaagctcttgcagcgcatcatgggagacgacaagctggtcaccatcacgaaggcgcgtgatgaagttcttccgcctacgagctctggcgtgcaggtggaagaacttggtattggcgtcaccctccttaagccagaccaaacgtgaacgttgacgcgcgatagtacgctcaagcgaggcaagaccaagacacttcaactttaaatctcgccacagccaggtctccaagggggaaagagaccgactctcctgcgcaacatcaagccggaagacaagttccttcgccatctgaagctgcagacgaacactgccaatgtgatgttcactccagctctgtaagcgcttggccgtggtagagaagcaccagggaagagcagcaagagggggtaggttggtagggggatgccaggcgtcctgcacgacttgaagaaagccgtcgaacttgggccaaaaggcctcaaaacgaaaacgatgcgctttcggggaggtgacgcaggtatgaaggagaagagcacagtgatcagaggtgatagaagaggccgcttggaggaggcaagaggggaaaagctcctcccaatccgcagagaagaggacgcggtcgagcttaacaagcgtaggcgactcgcgctcattgctccaagtgaagcgacgtccgtgaagcagcagctcctggagttccaactcgtcgacgagtcgacgaaaacgacccatcatacgacgattgagattaaggttgtttttatcccgagcttcgagaatgaggttgaaatcgcctacgacggcccacggccccgtgcgagaggagcgcagcgaacgaagctcatctaagaaacgaagtttgtaaggctcctcctgtggcccatagacgatggagagccaccagggggcgacatcagaagagtgtcgaaccaacgcggtaagagagaaatccgcaaggtgaacatctgagacagaccagacagtcgtccgccaggcaagcaacaccccccactccgaccgaccgcagacaagaaggaataatcaaagtcgaggcctagcatttccagaatagtacgagaggggattacatccataatagtctcctgaagacagagaagagagacatgctcatcacggactacatcacgcacagcatccgggcgggcacgcgagttcagacctcgcacgttccacaccaaaacgttctcattgcatgatcccattgagggggaccacaccgagagtagaagagaagaaaccgatcagccgcacacgaccaacgcctccgcagccttgcccgggggcaaggagccggagaagagcgaggagagcgcgatgatgtgctcctgggaaagtggcttggagaagagggcgttgtaagccgcgatcgcctcggccgtgaccgggcccctctccggaactaggccgagcttccgcatcaggttgcgctgggcgcgcgacactgcgtggatcggcccctcaagcgcctcaagtgccatcttagcagcgatacgctcactgcacttcggcacaacctccaccgccttggcggcgagaggcggcagcggcaaaggcggcgggaggagcgcaggagggagtggcctggagcagctggtgaggaaggcgcgaagagcggcgttgttacacggaaattttgatttaattttatgatcacaacgatcttaacaaacctgctctgtgcaataatatgacaataatcttcagtgttgacttaattactcacggccttttatagctagcggaattaatcgcgggtattaggtgtggtgtcattgggattaaccatttgtcataattgagtcgtcgaagcagatgtaccaaacatagatcaaccgcatagtactgtagtagagtatcaaaccggagcagtactcatctcgccagaagcaaactgggcagagtagacaggcatctcatgacatgaactagtagaacttcgtacaaaagatgcgcatatacgcatggatccacaccaaatagcagggagggggtcatctgatctctgctgacagcgagaccctgatttattctgcagtgacataaacacaggacacgcaacagtaacacgacatgcatgcatggtcgaactcgaacagtgccaaatgcaagcacaggtgacggatcgatcgatgcttttgttgacggtctctcgatttctgcgtcagaaggaacaaaaccaaacaatgtcagttgaaagattctgactaattaagctatatatcggtgataattacttacaccaggggaggatcttccagcgctggttgtcgcccttacaccactcccagagcacgacggtggtgccgtcgtggacgccgccgtggtccttgtcgccatggaaggcgtcaaagttgaggtagatgttgttcaccatgcggacgcagcggaagccatggccgacgtccttgctctccgtccacagcaccgactcgtccaggtactccgggttgtatggcaccagcctaacctgcgtgcagacgaacgtgtcagatcatcaactactagtgtagtagtggttttgcgacaaattcacatcatgtgacgccattccagaaatcgtaagcgttgattgctactactacgacgctccaaccactacgttgactgattttttgacatatatgaaacagactgaattaattatctaatgaagaagatgtatgtatgtatgtatgtacatacagggtggctctgtccgagggagtgcttgatggcttccccggtggccttgttcaccagcgcgaacgccgggtagccttcctcgtccttgatgctcgtgctgtgcctcatgtccttcacccagtgctgcaaatcggatttgaacatgattagaatagttagacaagatcacgatggagttgatctatcggtgttaagaatttgagatggaattgtatgcaacggaaataacctggaagtcatccctgggattggttggtgcaaggcagacggcgccgttcctgacggtgaggctgtacgcctcgtcggccctgcacaggatgcgcacggtgggctccgacgccagcgcgcggggcagccggttgccgtaccctgcaccgggtggtccgaccggcggtggacggtagccgtagcccggctcatcgtggctcggtggcggctgcggcgggtagaacgcaggtgcggggtggtagccgtggccaggttcacggttgggcggcggcggcgggtatgcctggtgcccgtatgctggcggcggcggcggcgcgtacgcctcggggccccaggggaggatcttccagcactggttgtcgcccttgcaccactcccagagcacgacggtggtgccgtcgtgcaccccgccgtgggacttgtcgccgtggaaggcgtccaagttgaggtagatgttgttgaccatgccgatgcagcggaagccatggccgacgtccttgctctcggtccacagcaccgactcgtcctggtactctgggttgtacggcaccagcttcacctgcatcaggacaggagcgtcgatcgatcatgcatgtaaaacagttaagatggcgcgcgaagactgcatgcgtggatgaactaatggtgattgacatacggggtgggattggccgagcgagtgcttgacggcgaggccggtggcgcgattgacgagcgcgaacgccgggtggccctcctcgtccttcaccctcgtgctgtgccgcatgtccttgtaccagtgctgcatgccatggtccggattagagagaagctagtaattaagagatgagcacagagccacatagcatagcagaagaagaaaatattatggtggtggtgcctggcagtcgtcgcgggggttggttggcgcgaggacgacggcgtcgtggcggacggtaaggcagtacccctcgtcggcgcggcagaagatcttgaacgtcggctcgtgctggggaccagtcgccggaggctggtattggccgtggccgtgcccatggtggctgaacatgctagctagcttccaagggccggcgtctggttgtctcgctggtattcgatcgttgcaaatggcacctcccgggttatatagaacaaattaagctggaggccggccggcgagacgttcgttcgttgagaccgaggccgcgtacgtggtgccgatcgatgagaccacacccaccgtgtcgtgtcatgtcatcttctggagtacatagggcctgtttagttcgcgaaaagaaattttttagtgttacatcggatgtttgaccgaataacggaagggttttttggatacgaatgaaaaaactaatttcataactcgcctggaaaccgcgagacgaatcttttgagcctaattaacccgtcattaacttatgtgggttactgtagcacttatggctaatcatggactaattagacttaaaagatttgtctcgcgatttcctctctaactgtgcaattagtttttttatttatctatatttaatacttcatacatatgtctaaatattcaatgtgatattttttaggaaagaaaatttgagaaacttgtcgtttccgcagccaagtccccgttgcccccacggggtcaccgggtgggtagtctcttctctgtcaaggcaccggttaaatgatccacgacagacacctggcgtcacacctttcaactttcaactattacatgaccacaaaggatgttgattttgattcgtgaggggataaccctcgttgtcttgtctttatgtcagtcaaatggttataaaaaaatttgaaaagatatattaacatgtgatatatcactccgtaagttcaaatttaacttctatatcttgtaacggaaaaaacaaatttaattgtaaatatacgttaacaagctgcggtttaatttgttttttcgttatgagatatagatatgaatttgaacttgtaagcttgtggagtgttatatcacatattgatatatcttctcaaattttttcataacagttaagtaacatgcaaataggatatcccatgcagtgatcaaagatagtttccctgaccacaaattcattcgctccggcatcaaggaattctttgggtttgggcctgcacgcacacaagaggagagagacggggcccaggcaggtggtatttgggccattccccgtggtggtgtctcatccttgaataagttcactttaggtccctcaatttgttgtcgtgtctaaaattcatccctgaaacacaaaacgggtacaacgcatccctcaacctataaaaccgtgcaaacaaggtctctcagcagtattgtccttggttttggcctacgtggcttctttgactaggttttcatcccacatgacattgacgtggcgcttatgtggcaattcatctagaaaaataataaaatatgtggggtccacatgtcagtttcacacacaaacaaattaaaaaatggtggggcccatgtggccccacatgtcatcctcactactccctcttctctctatccctctcctctcttctctgtatcgtctctctctccagccggcggcgaccggagcggcgactcccggagcaagctggtagagcagggcgggcagcggccggaacgggtgattggtggggcggagcggcgacggacggagcaaaggggcaaagcggggcgggtggagcagagggcaaaggggccgcgggtggagcggcggggcaaagcagggcgggagaagcggcagcgaacagcggagtggagcggattgtcgtcgtcatgtaactggcctaccaatgtgcccacaccgacgccagcggcatcatcctgctcctctaggatgacatttcaatgtctccgcaagagatgaaaaaatcccatctcatgaggacgtggagacgattaatttggcggcgacgagctcccgggcgagctcgtggacacaacactggtaccctcgcacgagctccacggcctccacctccgcctccccgagttgcacgcacagcgccacagccgcttcagctcggcgcgccaccgctcggactctagctccgaccacaacgccaccacctccgctctagctcggcgctccgccactacaggaccttcacctccccctcctccttcgcgcgccttcttccctctggcgacggcggcgatgctgacgaaaatggctagtgccatatatgaatcaatcgagcagcagctatgtcgagatggcataaaaaattggccacagcaaatcaaacttgctctgcttctgcttggtgattgattgcgggtagctgtatttaaggacgagttcgtggctgggaaggcgaccagttcagtgcacctgggacatgagcggttgcagccctgctcgtgcagcaccaccgccgtcgcccactgccgctccgcctactccagcagcgccaccttcccaccccgtgctcccacgtcgctgccggagcaacgcgtggagtggtctccttcgacgacgccggaaaatggatggtgctcgccggcgaccgctcgagctcctcctccggccacctcgaggaggcgaggggggtggctgctctcgctctagccggctgctggaggcgaccgctcagcgacatggccggatgggcgatggccccaccctcttttattattttgtgtgtaattgatatgtgggtcccacagtttttaaaattattttttatccgattgccacgtaagcgccacctgggacgagacctagtcataccaaccatgtaggcgccacgtcatctcaaaccgggcacaatactaccaacggacctcgtctgcacagttttggtaagttgggggatgcgatgtatctggttttgtagacggaggatgaaaatcagactgggcgacgaattaagagacctaaagtgaacttattcctctcatcctccatccccgctgcttccggcggctgccgccattccatctcccacttccccgtccattgccatcaatcctcacgccaagctagctatagctacgatggaacgcccttccactcccgactccggttgggtcatcctcagcaccatcgccgtcgccggccgccgccacagcaataatggtagcaccgccattaattggcaccaccaggaacggaaacaccatcgatcgaggtatgtatccctctagatctctcgcccacccaccaccaaatccctccatcgtcttcgtgcacagctccgacatgaaccccgccctgttcccgaccatcgtctgcgaggccggcgacgccctcctcccctctgtcaacgtgcggtccgaaccctactgtcgctccgacgaccgcgcgactacttcgtataccgcatgccgacgcggcgacgcctgcccgtaggaagcctgatcgtctattgggcctagaacctacaactccgtattgggcctatgcttgacaactccctattaggccctcctacgcataacccgagcccatctaagggctcatttagacttttagagcccaacacaagcatcggacgtgacaatggaataagttcacttagtgaccctcaaaagtgatcgaaatctaatccatgaccctaaaccacaaaaccggatatctcgaccccccaaatcttaaaaccggtgcaatttgactcccttagcggttttagagggtggttttgctgacgtggcgcctatgtggcggtattgaccgggtctcctttacacgtggcgttgaggtggcatttacaattaaaaaatatgtgtgggacccatttgtcattgacagaaaagaaattgtgggacccacgtgtcccatctctctctcccctccctcctcgccgctccctctctcccgcggcgggcagagatggcaacgatcggcggacgcgcgggcgtggcgcggcggcctgcgagcggcggagacgcgtgagtggcagcgccaggcactggaacggcaacggcggtggcaatttccctcttggtttgggccctcctctccctaggaggcccagacttgaattgaacacaagtttagcagcaccaacacttgtacggaataaactcctctcatcctcagcaacaatacgggaatctaaattactttcgcagtataattctcgtattgctcttttgattactgtcgaagcacggcccaggagtgaacacctccagcgcagagccccgtagccatcgagattgcagtaactaacagtgctactttgcctttgctgaaactgacagggacagtttaactcttctgtccgtccaatggtaaaaactagagagagatacgtgaggtaaaactctactgcctgggtatgataagtacattgagaggtaaagtgccgtgcgaatttaaccgacctggacccgaatatactgccctgaaagcctgaacctgcagtgaaatggttggtctttgaccattccaacggggtcctatcttcagaagtcacccgtaacattggtgatcgacaatcaacttttagtattttcgtcatcggtgacgtggtggttgctgctgacgaaagcttttacttttgataagtatgatgagtacagtaaataagcaagcttaacaaaaacgctgactgttaataagttgaaaatcttcagacttgagtttcagtctctcagactgcatctttgcctcttcctgaaaaagtatgtttccagtaaatctattcctcctttatatgtgctctatccataatccatccaatccgtccttttcaatctacagccgcctagcctagattatactagattatagtacttggaaacaacttctttgctaatttaagaacagaagatgaaagtttgccgttagactgcatgcatgctccattgatattacacctacttcagccaagaagtaacacatccatgcaatttccatttcccagatcagagccagaatctattgcatttgatatcttctacaatcctgtatactagtagtatatcaattggctacagtaaagtattattgttctgtatatctagtaatctttaattgtacaacattccctctctacggtgtaaagtactatcaaggctccagcttgcttttgcactgtgcctgaaatgaatacgtaggagaaaaaatcgcatacaaatgcctaattgttcaatactacaataattctataccgtaccccaatcatcatcgtcgtccatgcttccatccgatcttaatatcgtcggcaagattgttcatgccagtacgtagcatccgtaaattcgatcgactgcgtttgatcgatttccatggccattaattaagctagttaagaatatattcagaatagctgaggaggaagcatctggtggttgagtccggcgaggactgacgacggcgtcgcttgcaagccgcccaccacggactgcggcgccacgtcgaagcatgagccgttgagcctcttcgccggcgtgtggccgccgccggcgtagtctccggccgggctcgccttgcgcttgccgccggcaacggtggccgtggacgccgtctacgggttgcacttcgcgaggaagttgtccccgacgccgaggagctggttcagggaggggtggacggcgagggcatgctgatggtggtcggccggcggatctgcggtggcgtcaaagatctgggcgagcgcgtgctcgtcgaagagctcggagatggaggggatcttggggagcttggggatgagcgtggcgctgatcatccgctgcgcgta

SEQ ID NO: 16721 - DNA, 619 bp, Oryza sativa
ggaatgccctggtccgtcgcgacttctccgtggcttaccgttggggtgggcaaggaagaccgcggcccggcggttggagacggcgagcgggcgcgagggaggcgactggaggtcgaagagcgggagcggcgaggaggtggtagggaggagggggatggggtccccggcgaggcggaagacgaagtcggtggtgccgtcctcctcgccctcgacctcgtcggagaggtccagctcccgcggcggcgccatggccccccaccggtggtcggaggagcctagggttttgggcgggaagcgggacggagacggcgcggcggcgagggagcaatagcaaatggggtttcgtgaagcgagagcgctagtagcggaggccttggcgtggagtgtaagcagagcccagcagcgtggccggcgggcgggcgcacgcggcggaggggagagggagaggcggaggcggccgcttcgcttgccggcggtgatggtggtggcgctgaatacatgggctcttgtcgttgccccgtgggcttaattgggccttctactgggccgtcacatatattaatttggacttctttttattgggcttgaccttgacggtgagtaagaacagaaggcgcat

SEQ ID NO: 16722 - DNA, 8887 bp, Oryza sativa
aatactcaagctttataattcacacacaggccaccgccgggctaagagcgttgggagcagaaaaatcagaggagattttgcaagcggtaaattttgcttttattcacctttgattaattgttgtttgatcgatcactgaatttatattggttgtccctaatattgaatacactcacaatttttgcaggtcagggatcttcttcgcgaaaagagttcgttcaagacccaaccggattgggttacagttcttgatggacctcaggaaggcgcatatgaatgggtacaaaactggcctgatttattcatatggttcagaacattactttgtgctcctgattattagaaatgcctcacatttgtcagattgacaatataagttctttttgtttagaaaaaactattttgttcagcaacaaatctgccaattctcttagagctgacatctgccagcttcaaagatataagttttaaaggacatgataaaaaaagagaaattttcgctttcatgagtgaattaggcaaaataactattttcatttttgaaaaacaaaatttgggcaccagaaacaaatgacgaaacaaaatccaaatgacgaaagctaaacattgaaagtaagggcaccagaaacaacattttccctgaaaatagatgcagatcatctgaatccatgtggtgcactgttctgacagttaattcaccttttgagtgtttaggatctgttcacaactagtgattctatgtctagcttttagtccattaactgataacaagtgttgctcttctctatccttataggttaccatcaattatctgctggggaaattgggaaagacttacgcagacacagttggagtggttgatcttggaggtggatctgtgcagatggcatatgcaattgcagagaaggatgcagtgaaggctcctaaaccatcagagggtgaagattcatatgtgaagaaactgtttcttaaaggaacaacatattatctttatgttcacaggttagtatgaaataccgttgagcttttggctgctgctacattgtcaagaaaaaagttattcagttgtgatacgggaacaatcttcaaaatccatttaagcatctgatggcatattgtcatgcctatttctgatgtctgcctatgccaattcataggttatattctttgcaaagcagacagctgttgtaatcctctaagatactatctcgtattgataaaaatgcaagaatagcgtattaatgcaaatttgagaaacttaagtccagaccaaacgtaagggtacttttatgtgtaaagattctacctaaatatcacgtggtattctatgtaatgttctacagcaaacacttaatctgacatagccacaaacttaatactccttacttttttattatctgctgtataagatgacatcacatgacctgtttttagtctggagtctttgaaccacatatataactgtacacatttcttcacagctatttgcattatgggttgctggctgctagagcagagatcttaaaagccggcaatggcaaaggttacagctactgtacattggaggggcatcaaggtactagtaacatacttctaccatattcttctgctatcatttaactccctgccaagtagcttatgtttgttcctaaaatttcaattgttgttacccttatgcatattttggtcaagggaggaatgtaatgcgtaggctgcattcggaggtggaggttgggaacttcacctcgccacacgcaaaacaaagcgacccattagcgcatgattaattaagcatgagctaaaataaacttgaaaaaaatggattgatataattttgtaaaacaacttacatatagaattttttttgcaaaaaaaaaaaacaccgtttagcagtttggcaaacgtgtgcgtggaaaacgagaaatagaagttgggaagaggtggtaaggaacacacccttatagtggatcgtaacctggtttaaatgaggttaccctcaaattctctatgaaacaaataccttactggtttccttgatattctttccaaccatcagtctgcagttagaattatttatagtgatgtgtataaatctaaatcctcatcaacacaaatgaccaatctgtgacaatagttggagatgcaattttatcttttctatgttggtaagatagttttgttctaattgcattgtgattgtagggcaatacaaatatggcaatggcaaatttgaagcgtcggcttcaccatctggtgctagttattcaaaatgcagggatgatgtagtgaaagctcttaaagttgaccaagcatgcactcacatgaaatgttcttttggtggcatttggaatggtggtggtggcgctggacagaagaatttgtttgtggcatcatttttcttcgacagggcagctgaggtaaggttgttgaactactgaagatgtttgcttttgttgccatgatgatacaccagtaaacaattttctggtctctgctcaggctggatttgtgaatcccaaggcacctgtggctaaggttaaaccttcagattttgaaaaggctgccaagcgtgcatgtaagttaaacttgaaggacgccgaagctgcctaccctggtgtccaaaaggataacattccatatatctgcatggatctcgtttaccagtacaccttacttgtggatggatttggtatgtctcgttaaaactaaatataatcaagaccgcattacagattttgcacaaatttatcactaatttgttttgctcttgcactctcgcaggtgttggttctcaccaagagatgaccttggtaaagaaagtcccttacagcaacgcgtttgtggaagcagcatggccactgggaagtgccattgaggttgcatcttgatagacagacagcagaaagttcagcaagggagctacgatcagagggcgtcatcgccgtaaagttttggatctggagggtgttcgcttgctcggcgctgcgcacgccccaagtgaccattttgttactgaaatcgattgatttaacctgcttctatacagtagcctgataatgagtgatacacaaggacccgccagcttgcatagttgcatacttgcatgcaaggggtatatacattttttttttgtaccattgaaagtaagacgagcctgtcattcttttcttgatctatactactccagttctgtacctctgttaggggcagtacagtagagaagaagattgaccatgtgtccatgtggtgatcccacatgccagcatgactcagctgatatgtgggtcccacactttgtctctgctgccatgtcagctccttttgttgttctccggattaaattgtcgtgtaagcgtcacgtcaattccacgtaggatgaagcagcctagtcaaaagagctatgtatgaaccttatttgtataggttttgtaagttgagggattgtatttttggttaaggacgaaaatctggcgacaaattgagactttgagggaataagttcatccaaggtcccttaacttgtcaacaaatccaattttcatcccttaaccacaaaaccagatacaacgggtccctcaactatcaaaaccggtgcaatataggtcccatggcggtttggatggtggttttggcttacgtggcacctacgtgtctaaattgacctggtcttcatctgacgtggcatagatgtggcattgacgtggcaatttgatttggaaattaataaaaagagtaaccccacatgtcagctacaccaaaagaattaattaaaaatggtgtggtccacatgggccccacttgtcattcactctcctcatcttcttcctcctctctccctatctcccctctcctctctccaggagctggcggttcggtgatgcggcaggccggcggcagcggagccagggatgacctcggagacgaggacgccggggagctgcgcctggacggggacgccgacggcgagcgcctgggtgtagatgatgaggaaggcgaagaggaggttggctgcgacgccggcggagacgacgaggagccggtcggggacggggcggttgcgcaggaggtccgggtcgtcgggcgagaagccggagtccggttcgtcgtcggggaaagctgacggagaacttggagacgtggatgccgcaggaggtggcggaggcgaccgactcgacgctggcgaggaggtcagacggggggtcgccgcggcatcgttggccgccgaacctcccttgacgccgcatcgccgaaagggaaaaagaagagataaacaaaaacaccatattttaatctgatctgatatgatcaaatgcacctcaagctcgatcccattagcagcaatggcgatatcgttgattttcacgacctgctcgctgaggaatggaggtccagttgctggtgccatgggtggaggtgtacgctagcagcttggcgcgcgtcctcctccgccttccatggccccttcttcacgtttgccttgtcgcagcacggcggccgccccatctctccttctccccctctcagctcctaccacggtgagctcaacaacaacaacaccaactctgagtccagtaacaacaatcaccgccggcgtccccgtccaggcgcagctccccggcgtcctcgtctccgaggtcatctctggctccgctgccgccggccggccgcgtcgccgaaccgccagctcctggagagaggagaggggagatggggagagagaggaggaagaagattaggggagtgaatgacaagtggagcccacgtgggctccaccatttttaattaattcttttggtgtagctgacatgtggggtcactctttttattaatttccaaatcaaattgccacgtcagatgaagaccgggtcaatttagccacgtagacgccacgtaaaccaaaaccgccttccaaaccaccatgggacttatattgcaccggttttgataattgagggatccgttgtatctggttttgtggttgcaggatgaaaatcgaattcgttgacaagttaagagaccttggatgcacttattcccactttgagcgcaagttgttatggtgtatcggcccatcaaggcccaagctagtgtcgtatgggcttgagatacacctgggccatcaaacagtctgaacgggagtgagacccaagtgtttacggcccaatgggctgtatatctgactgagtgaagtatgcccttgtcagttgtcactgcagctatgctaattagtggtttggctttatcaacaatttatcattggaaggtccttttccacaaaaaagaaagcacgtttttacgtagacatagacacgcgcacacacgggtgaaagaaacatcaatcgaataataggcagtagctaagctagctagctgggtacgtacgaaaggaatacgtagatctttagtactcaccgtattggactcggaagagtggcgtatcttacggtttttaaccgtctcttccacaaccagcctacacgtgtcccgtcggcagtaactagtgtgatctgctcctcgccaatgtcgacacctgttagatcccaaatcaagaaactcaccaaattaatcttcatctctctctcttttttttaccagctgtgatcaacacgatttattacatcgatcacgttggtaattaccggagccaaccattcaaaaccatgtgtctggctggccatctttttcttaggaagccaggttgtactacactactgctagctgctgatgcttaactgaccttgcttcctgctagcttagtgcttagccttagtatctcaagatggatgcacttacagaacttccctatctaacttggaccctctagttaggttcaaaagatagttatctttaaaagaaaagttaggttcagaacatgcgttcgttatcagctgttaattcgtagaaaagttcagtttaatttgtttaccgtttccagaacaagttaatttgtcagatccgtgtaaacatgcaaacactcatcgatcatgctcgtaaattaaatcaaattgttccatatgaaaagcttgcaaaatgaatgactttcaagcatgccctagctagtaaactaaattacacaacacctgcccttatatgaaggtatttttcttgattgaaaataagaacagtaaatgggagagttggctcaagttggtttaaggatctttacaggtacattgaagcttcctctacacgacattatatatattatgcgcatatatatatgcaggccttgaattcttcatgtcacaatctaaactggacgcagcaaacagtaagggaatggctgtattcatcattgagcacaattaatctaaccgtacgtccttttaccttggaagaccataactgtactaatcgacattagcgatgcttcaacggaacgtcggactctggtgtccagctgatctatctatctcagcactattattaccaaatcaattaccagctagagattaatccgaacacgtacgtggcgcccgatctagagccgtatatatacgtacgctaataattagctggccaatgagagaaaataatatatatggtcaatatataggagaggataaacatcacgttgttatctcccatgaaagttttcttcttcttattctcgtctatcttcttgagatgaactacttattcagagtgtacagctagttcactactttgtctgcagctagctttcctaagagatcaaaagggtttccaagtgcatgtcacgataattaaaaggtggccaccatgcatggttcatctttcgatcgagatcgagttctataaattgacctgtcaatggtatgtctgccagtagctagctcgaggttaatctattcgatacatattccatccgtttctaaatatttgacacagttgattttttaaacatgtttgaccgttcatcttatttaaaaatttaagtatttattaattcttttcctatttgattcattgttaaataatataccttttatgtatacatatagttttacatattttacaaaagtttttgaataagatgaacagttaaacatgttttaaaaagtcaacggcgtcaaatatttaggaaaggggagtatatattttatttgaaacacatgttaattgttttgtcgtacgtcctctctcaacgtattactactggtcagttggtttgttcttatcgtctaattttagatcgaaccggccgggtagtctgtccttttacggcagtcatttggtcaagtcatccgtgtacatgcatatatgtcgtcgcagccgatcaaagctagaacgccacataataaaatcataatcaactatatatatggtggttaatcatatatacacgtggattttccttgtttaattgtcgtcttgtgcaaagtgcaatgggctatcagcaagttgcattttttttattggcagatgattgcaatatggcagcacatatacataaatgataagcaaaacctgcagggtgtggaagacaatcatttggagcataaacaataagtacgtatataattataaatatttaaatacatgcatattattgctggagaagagaaacggtctttatatcaacgtctactttgatgaagagactctaggattgtttaattattccatggaaaaaataaagggggaaaaagaaatggctagctagaccggtcgttccatgcatgtagagctgcatgaattgtgagatggatgatcatgatcgtggtgaccacgacaaattaagccatcaaaatcttctctttccgttgagtgcaacagcacttcacttgggagtatatagctagcgtgccgtggtcgcaagctacgatcgagtcgagtatatatgaagctaccagagctgcactgctggtggtcaaaggcacccggccgcctcgttccttaactcttgcatgcatctatatatgcatgactgcatacagaaatatggtggattaattcctgaaattctccatagaaaagagaggcagatcgatgttaataagataattaatcaacacgtacaaacttagcttgtctcgtaacttaatttgttctcttgtatatttgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctcttttttgtggggacttacccccccttttcataaatggacggagatttgtatagttgccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcaacttagcaatctacatgctcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgctcagccaaaccgcaataaatgtgg

SEQ ID NO: 16723 - DNA, 5023 bp, Oryza sativa
atgtgtttcattggatttgatctgtgatgtatgtgatattggatctgatctgggatgtatttgagttgtgatgcatttcttttaggatttgtgatgtatttttcgtttgagatttggtgatgtgatgtatttgtgatctgtgatgcatttctttgcaatatgtgatgtatttcttcccaaatctgtgatgcttgtggatgatttgggatatttagggagcaaatcgattgagcaatgaaacaacaacaaaaaaaaaaaaagaatcaaccgggactgctccaccatttttagtcccggttggtaataccaaccgggaataaagatggatttttagtcccggttatttcacccgggactaaagatgggtatctttagtcccggattcgtactcccggttgtataaccgggactataggggggtttctaaccgggagtaaagcccctttctctaccagtgttatataatttctggctccgccactagattttatcgagagtcatcggtccttatactatagatccgctccacgcatgcaagacaaactggccgaagtacgtaggtacttctcatcattagtactaatggctagtgtacttgtgattcagttttgcagtatctgttatctgtatactgtagatctcgatccggtccaatcattttcaagctaggttctagctgatacgccaggtcatgttgttgaattcagtaatcaatcgagacaaattaatcatcgataattatttttttatttcaccaattcgtgtggctgctagctgatgaaaccagcaaattagagaaaatggctctaaatggtcaagagatactatcactaggtatagctagcaactatcagctaccagtatgcagcagattgtgtggtcgtcgtcgtcgtcacattaagtcattaattcgaccggttttctagatcatgtaatatgcggagtaatatatacatctgcgccgccatatatccacatcgaatgacccctttaatttattctcatccatctcagcagtagcagctagcatcgattatatatatatgtatctatgtatccattttcttttgcctagctagctctctcgtcccatcatatatatatgtatggcgcggcaatcagcagcatgggcttctacctaattgactgaaaaagtgaagttatttttgttatcctcttcttcttattattattccgatcgatatatgcacagcatctctgtatacaaatacatatataaatggatgacgtttgaaaggaataaaaggctaggaaaaaaaaggcatgcaactcacatactccagcacttgatatatatcaataatggatcagataaggccacagttgctgctttgatccacttgagcttagctagcttttgctgatgatcacaattagtaattgccgtcatccacatcggtgtcaggttttggcaagctagtagatagtggagtactccgtactccaaataaaggatgagcttagctagcttaattacctagagagatcgccgtctccgtcgtcgtcgtcgagaggaggcatgacatgagcgagagctgtacacatgtgtgccagtagttgcaggtcgatgtaattaagcgatggatgagatgcatatgtacagagctacagctacaggtggcggcgcgcgcacggcgacgcgtgtggcgacgagagggacaaggcgaggcgtgctacgactaatttaaccactgcacgccgcgccaaaagtttaaaaccccagccaatgcgcgcaagggcttcttcgcgacggcgacggccattgcgttcgtgcatgcacctggctgatccgacgacctatcagagattctcgccgccccggccggacggatcgatgacgagctagctagctatagcttagtgtgtcgctgttaacttgatgcatgctgaattagttagttcagttcgcgccgtttctatcttatctatggccaaagtacaggttgttcctcgttgatgcaatctacatcatatcgatccatggtcttttgtgtacttacttggattaattaattatgtttcactcgttttgtgaacacccgctattactatacacacacacacaatagtactactatgcccttgttttcaaatcacctccgtgacttgtttcatcttcttttaatctttatcttttttgtcaactaattaattaatcgctgcatttcggggtttcgtgtgctgaatcaaatagatcttactccctccgtcacaaaatataagtatttttagaatagtgacaagtctaacatttttttaacattttttactagatttattattaaataaactatcataatattcaactctttttatttaaaacatcttttttgaatactgttggtcaaagtagcatatttagaacggagggagtaccatatattgatcgttaattggttggcttataatcctacgtttgagtctttgaaagatcgatgaatatgaacgaaagggttgccaattgtcacgtacgcgtgtttggtgttctgaagacgcagctgatctcaaactgcagtgcacgtgtctgcttgacttaaatctcagctaattttggtcagaccacgaccacgttccgattaagttcacacgtagtaccgcttgatgacaattaatattccctcaataaaatggatggcaacctaacttcaaacagttagtggagtatataccactccgttccaaaccagagctgttttgaaatgagtgcatgcacacttatttcacacacttccatctgaaagtttacatttagacgaagaaaaaaaatcatatttattttctcggtgtcatggcgatgagagaggttcaaattcgtacaagttttcttcaaaatttgatatataattattcgaacttaacaaattaacccttcttaatttcaaccaagctcaataaagtctataattgtcctaggtccaaacccaaaacatgggtaagtagtaactaacatgtaggcctaacctactaggggaacaaaatagtagagtaaggagggacatcgaaaaagatgatctaaataggatgtttcgccttttattttgactagtaacatatcttgcataccaataagcacgcacgattggtttgggcgtgttgtatgggctcatatgtggctgatgataggttgggagttcgaatcaagatccaaccgctcatggatggtgggagaacaggaaggagaacaacttcattatttaagtaatagaggaaagtcagttatggatgacagtttttccataaagttatatgacaacctcaataaccattgtggccatggccgcttccctaaagcctcttctcctgccactggtgccacaagagcatcagcattttcactattgtcttagtggatgatgtgctctgttcccacacaaaactatgagctaagcaatcctaagaactaacaacaaatcattggtaggacgaacatcgacaacaatagttggataggtgaagtgaaggataagttgtgatgacccggcggtggttgttggtggtaaaaaaaatatgatatagtgagatgccacggatttaaagtcttgtatatgacttagatgtttgtctttgacttctacgttcttccatgttaagaactttatgggaggaggaagaagaacaacaagcttatactttagtaactttgtaatatcggaataatttattagtctatgacccaagttaataagaaacaaggcgattctcatttttgtcaggtctcatgaaggtcaaagatacctagatatgggttcttggattataaataatgggaaacaaataaggttctggaaagataaatggctaggaaacttggcttttaaagacaaatatccatctttatactctattgtccgaaggaaaagttctactattgctaatgttatgagatctgttccactcaatgtttcctttaggagatcattagttggtcagaatcttgcatattggcatgaattgtgtgcttatattgtacatattcaattgaatcaatcctctgatagctttagatagaattatcatcagaatggaatattttctattaggtcgatgtatctagctttaactaataatggttatattgagataaacaagattatttggaagcttaagatgccacttaagattaagatttttatgtggtacttgtttaaaggggttgtgctaaccaaggataatttggcaagacgaaattggaatggcaatttaagattttgtttttgtatgaaaaatgagactatgcaacatctttttatagagtgtcattatgcaaaatttgtttggagagcagtacagttctctcttggtttataccttcctactaccatatctaatatgtttgatggttggctcttgggggtagacaagaagaagagtaaactcatacttgtaggagcttctgccatatgttggtctctgcggttgactaggaatgatatggtttttgacaaatcaccatctatctcatatatgcaggtgattttcagggcaacatattggctccgattttgggcacagctgcaaatgtgtgaagatgatcgagagcttatgaaggttgcatgtcgtaggcttgagacaacggtcatgcaactccttgcaaactatggatgaagattcacagatagacttgaataaatgtgctctccttatcttagtttgatcttttatttcgttgggtgtgtttaattcatttgaactacactcagtgtttgggtgttacttttataataattggctatagctctgatgagcaaaggccgggatgttttattctattattgtagcgcccgttccgtcgtggcgcctagcggaaaaattatctcttaaaaaccctaattgcgaaatttgtttctttgcttgttgtctagtgttcgtgccatctcaagatctcaatccccgatctatcgtcgagtccaattccgaatccaatccttccaaatcaaattcctccgcaaaagtctattttgcctcccccgggggtcgatgggccgatttcctcccggcccat

SEQ ID NO: 16724 - DNA, 5498 bp, Oryza sativa
gcgctctctctctctctctctctctctctctctctctctctctctctctctctatctctttctctctctctcgccctctcccctccccggtgcgctccctttccccctctccctaccgttccgcccgcgcgccgggcgcgggtgcacgggaatcgcccgcgccgagcgccccctcccctcgctccccttctccccatccctggcgagcttcccgctcgcaaagccagcccccgcgcgccgtggttcgcgcgcgcgcccgcgtggtcgtctgcgccgtccgcgtggttgccgtccggccccgctgccctgccgcgtctgtcgcccgtgtcgtcgcgcagctccaaaccgcccgccgtcatcgccgtcgtcaccgcccggcccccgccactccgcgcgcaagccgccaagggacggaggcagcgtccctcctccctctgccgcgtcgcccccgctcccctcctcctttttcccgaatcggcaaaagggcaagcccctttctccctctcctttttccccttttcccccgccggcgtcatcctacctgtcgccgctttggccgcgaccgccgagcgctagctcgcgcccttgaccgcgcaagtcggttcccaaaccgacattgccgcccatttaaaccccagcctccctcccttcctttcctctccctttcgtctccgcgccattgccgccgcccccgtgctctgttcgccgtcgccgttcgttgttgcgcgtgtcggaggagccggcacgagcaaggacgcggaagaggacttcggccgcgccctctccttcctcttccccggcccgaggccggagagattactcccgcgccgtcggcctcttgtcacagcgccccgacccgcatggtagtgcctccctccgttcttcctcctcgctccatctcctccccctagctttcggtagtagctcgagtagactccccgtagttagccggcgccgccccgaccgttgccgtcgctcgccgcgtgctcgccgccgtcaccgctcgagctccgtagcacccgcacgtcgccagcctcgctcggtgtagctccgtccaatccgacgctagcatcgagttcccgaaaccgcgtagatgctctcaccgccgggaatcgacccctcgtggcctcgccgccgtttccctcttccctccccgccggttgtcgccgccgtgattcgccgccgtcaagcttcctccggcaaatccgagccgttggctcgtctcccctcatcacgagcaaccgcccggtgtgctagcttttgcccgtatcgccgtggttcgctccgccgctcgccgttgccgcccgccgtccattcgtggccgggtcttcgtctacctcccgccggcccgcgtggcagccacgtaggcgccacgtcggcgccagctcagcctagaccgggtcgagccaaccccggtcagtccctccccgtgcgcgcgttccaccgcgagccgtgaggctgcgcgtgggcccgctgcatccgcgtccaccgcgaaccgcgcgcgtgcaccgcgtccctcccccgcccgcgcgcatgagccgcgtactccctccgcacggtgagccgagccgctgacaagcgggtcccacccgggaccgcgcatggtgagcccggtccaccggctctctctcctccctcccccgcgcgcgcgtcttgggccgctgtgggccgccttcttgggccggccagcccgttaagctcggccgagccgccctttttctcgggccgcgccctagccgcccgagggaagtctatattccctccctctccccttttcttttctttttcttttccaaaaaaaagggatttaattaaatccttttcctttagaccaaaaatccaataatcttagaaattcaatatcttcccaaccgtaaatccgtttgactccgttcaaattccaaaatttctcaaatctcgagatctatctaatggcacgcttagagttcattaatagggctttattttcgccgtttgttgagttgtcccgttttgcgtatagtttcggagcccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggtagacctacctaacttgttgcatttgattcttccattgttaattgctataccatgtccccttgtaaccatccagttgcgcctcgatattcgtgcaccctgtgccagtatcgacggttgccctcaaacttaaaatctgagtaacaacttgggtaaaactggagttttacaaaatacttggaaaacccgacacctgggtcggtgcttgcgaactaaatgaatttccaaaaccgcggaccgggaaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggatttgccggggtggtgtcggggaggacccctgggcttcctggcacagtatggtctgggacctaacctgttgttggtctgggacccctctcgtcgacatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagtttggtttgactactgcttgtgaaattgctgtgtgaaaaggggttcggtgtttgaaaaatctacagctgatgggatcagctaggcccgggtggccgtttgaaaagttgttggcccgggtggccgttgaaaaagctgttggccgggtgccaaccttgtttaaattctaaagactgatacattgcacatactccgaccggacgagacgcactgtctcatccgtgtcgtttgagaagcactcacttagttgtttcagaaaagagttcaattaaaattaattgcaaaaacaccagcctttccttgaagcctgcattaaacacttatttcccatggcttgctgagtactcccgtactcacccttgctctatataaataatcccccccagttgctgaagaagatgaagcggatcctgctgatgaggagttcttccaggagcaagccggctatgatgagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctaggactggtatcgattaacaggttaatttggagcgtcacgggctagttccggtcgggactagttcgaggcgtgacagtttgtttgccgcatccactaagataaccattggtgatgggaatatagcgtgattctgggactctgcgtggattgatgggagaagaccaaaggacctcatgcccctagtatacgcaatttctaagaagaggaaaaagaccctgcgccaaggaaaggagaatgatgcctgggtaggtgatttggcactggagacaaacccagtaattacagtggccctttgtggagcagctggttgccctatggactgcagtccacaacgtgcagttagaagaagaagagtcagaccaaatcgcctggaagttcactcctcatgggcactactcggcttcatcggcctacaaagcgcagtgtgttggcgcgcctgacacaacttttgacttcttgatctggaaggtctgggcgcccggaaaatgcaaactccacgcttaacttatcatacagaatagggtttggacctctgaccggcttgcgaccaggggttggcaaaataatggcaggtgccctctctgtagaagagaagatgaaatggctttgcatcttgtcgctgagtgcaggtatacgagacggatttggaacctcgttgcgacatgggtagggttccaccagctaaaaccccgacgctggggggtggcgcaatcggttaaagattggtgggaaaggctggcctctgtgtctggcgtccccaagaagggactccgcaccctgattctactcatcgtatgggaagtctggaaggagcgaaataggaggatatttgatcataaggaagccgcaacctcgtatctcctttcaaagataaaagaagaggctggcatgtgggccttagcaggcgccaagcgtcttggagagatcatcccgcagtttgtatagtgtacagctttccttgttttttgctttttctttacccttaggggttgtatttttctcctgctatattcaatgaataagcacattcttgtgctggttcctttcaaaaaaaaaaagataacatcacttactttgtaatgcaaatacttcttgaaattcttaggagaactagtagtaggttgatcttaatcagatgagtatggttttcaaaattgcggcaactaatttcgtgttagaataaatttataaaacgtaataagcttatgtctattggaggtagatctacatataacatttattttttaaaaaaagtagtatttgagaaattattgaaagttagaattttaaagggaccatcaaatatttatgagtgacgcgatgtgccagctgctgccaaagctcaagtctgaagaaagagtacagtacgcaattcttcaggcctattttagatgggccttactctgggctcatctttgtctaaagacctgtaaaattccagcccatacatgtgaattggccaggattgaggcccatatcagcgaggtacatgacagaattttgtttatttatacattttttattaaaatatttacaaaaatatttttttatttcgaaaatttacaaatctaatcgccctcccaaagggcggcaagggacctaaatgcaaaatttttatttgtgttcaaaccctttccaccggttttaattgcttaaaaactaataatgcttattcgatacttcaaatgattttaaatgaaaaagtgataaactacaaagttatagatctcatcaagatctacaacttttatataaaatttatctccatccaatgtcgtttgagatgtagatctgagattttttaaaatgtgttttatattttgtaacgaatatttgaatatctaaaacatgttaaatgaaaaagttgttaactacaaagttgtagatccccctgagctctactattttgatataaagttttattacatctgactttatataatataattttaaattataaaatcatagagct

SEQ ID NO: 16725 - DNA, 13460 bp, Oryza sativa
attatttttgtaaatattttaataaaaaaaatgtataaataaaaaaaattcgtacatgacacacattggaatatctgccgaagtgagaaatggataatggaaaagcgaaagcatgtacgggaattttcagagattggcctaccttacgtaatagtattattattatttttagaagtatatgacaaaaataacttcatctaatataatacacggttacagtaaatcatgcgttaaaaaaaactgcctcccgatcagtctctacatgaactagattacatatattcagagaaattaaagcaccttccttattgatcatacatggcgatcgatcgatgcaccaccaccatctttggcttaatttcatcgtgctcatagcaagaaatgaatcacttgcccagttgctgcttgctaattttctactacctgcttttctccatcgatcagttaagttggttcagctccagcctgcaccattcagatcgatgttttcgcgcctgtgagagtgggacgacgacctgccattgatgctgaggtccagctccgacgcctgcagcgtgctcatctcgcggcgccgttcatccgaacacgatcgtcgcctgctcggctcgttggggaacagcaggtagtggtgctccttgcctgatcttgctgctgccggctcaaatggcggcaagccgatggacaggatgtcctgctctcctctgtggccatgagagcgcgagtgatgcgagccctcgcagtcgcaggcggtcaggcagctgtccaccgatccatcgccgacctgctgctgctgctggtgatggtgaagctgggtgtgctcgttttggaggcgtttcgatgaggaggcgtttgcagttgcagcagtttctgctacggcgatggtgccgagtgcctcctgcgccttctccagcactgactgcaggtactttccttgggcttcaatccgaagctgcaggtgtctttgtaccttttattttcaggatccatgatcacttataaatactactgatttatttattaggagacacaagactattgctatgcattgttacatatattccatcgagaaacaactgaaagatttttatatatacctctagttgttcatgcagccgtctctgcacctcaatttgcatctggagggcttcatttatgtgcatagaactgctaaaaagattgtgaaatatacattacattctgatgtttgatgtttctattcatgagagaaaaaattaactttatttgcttcttagttacctgtttgtctgagtctctaggtccaagtgactagccggtgatccatttccttcacatggtttatctatctctgtcgtactacaacctaagactgaaaacgtgaaagcaagtttactatctcgcttattactaatactgataatcaagctacttcagagttcagaatcatgtagcacttaccaccttgtgcacgggaagcattggcttgagattgaagattcttgctaagtcggtatttctacgataaaagaagccaacttagtttctatcttcaagtcacgaataatgctagacacctatagtttaaacatatttcaaaatgtacctgaagatgactcttaagatggtaaagggttaatccaggaattcccatgagcctcatgattgttttcggcgtcgcctctgaagaagtttcaagtgtagccattgtaagatatgcaaatttaccattcctctgctgcttcaaagcatgaatgattaattaagttttgaatactcactgtccggccctcccagctgatttactgcttccacaaaacgctcatgcaactctgatgtccattttaaccgaggtttagcgtcggtcgagaggacaagccctgatgatgaatctgctccgccttgcaggagaaattgcttctccggaggcaaacccggccttgaagacaggtgctggctatcactctgaacctgttgctgatgatacatcatctgccatcaaagatgtcatgttcctaatttgcagatatcatcttgtgtgagcataagcatatgatacgaaaggcctctcttccttgcatggttcaaagaaactaacacagtagtacatacagacctgttcagttccagtcatgcactgaaatgtctgtctgcttgtagtaggctgcacatttatcagtagtgataagatcctctgcagcctttttcagtgcctctatttgtagtaaccaaagacttgattggattatgtgtgtatggtcttctgggagtgagacaaccttggcttcttcagactatctgcctctccaatgactagctgctgctgcctctgctcatgtcaaggtctcaagcagagagtcttgagtctttataaggcagggaagagaatgtggaatcactgggacaacacacacactcaagcctgcctgacccaatctttgcagcaactgaaaagagatattatccttattctctcagggtgcccgtggaccctaacctctgccgatcttttccattgtaaattccaaaaacgctctcccattctgattatacacttgtaccaactttggttgaaattacatggcacatgagaagggcgaaaggcgaagaacaatcttttatttttcttccttttcttttcttttgagaaactagggggagggaggggcggggggagcaccttattctcatgacaactttggggctgtggtgctgcaaacctatggtgttagaacttgccggcctcttcggctggattcctgaatgatatccatagttgagaactaattctggtctccactgcatttctggaggcctataagtgttgaaatgaaagggcaacatctgtggtcaatcagcattggttaagattccatatgatctgctgtatgatcacaatgaattgtttcgcattttgcccggatgcggtgtacatatgtgtgcacaagttctttcttgatcagaattcaggcacacttggttaaggaataatagagtggttaacctaagaggcccaaagttcttttgactgcagctgcagctgcaggcatccagaagaagaattgtgcaaagttgcctgcatagagtgaaagtgaagttgcccattctataacccctttgatgccttcttggggttgcacaaaggcatggaatggaataatggaataagcatagaattcccttttgtctcctttggtaagtttggcacctgttcagctacctgcaagccaaagcaagctgctggtagggttaaggcaatctaaatagggctgtgtctgtgtaaccttttaagccattgccgtaacttcgttgctgttcttcatatggcacccaaaagtgagcttaaaatgaaggtttagttccaacgtttttaagcactctttgctgctttccctttattcctgcctcaaaaaaaccgcctctagaagtatcaacagcactcccatccttgtccattcaggtttaaatccgggttaggatcccacacaactttgtgaccgacatatggatctaacgaaacctagacccacatgtcaatgataaagtcactgtgactttaaagttagaggaactggtaccaactgtcaggtacacattcagcaagccataccaaaatttttaatgaacgctagagcttcttgtcagatctcaaagggagatgatcatacttgcatgctcccacagtgctacgtcatgtgcgtttcatgattgcatcagcatctgtaatccttttgaagtttatagactcctgccatgtgaaaatgagaggaatctagacgataagcttgcggcgtagtggactagagttttatcccccgtgacctttctttctacaccccaattaaccttgtcaagttggtgttgctcaggaagacaacttgttaattgcaagggctgtaaatattcctcacaaaatttacctttattagtcctttttatatactagtacggccgtgctgtttcactcgcgtaataagtaggaataattcatccagcctgttatgttaatgtttggccaagtacagttgtgttgtttcagagtatcaaactactccaggtaggatacaaagttaataacgcaatatgtgccacgagagtgataaaccagagatcaagtattcaccagagatcaagtattcagatgctgcaggtctggttgaaaaagattgacagagtatgggcatacgaaggcagagcacatcagtattttcgttgttctttcaaaagtcccttgcattgcacttttattcggatttgtgcctgttgctgttacgtggttcgatacaatttcatctaagttggtaagggaatcttggtggctaacccaggtacggatatcacttgtactaagataagcaaagtgctcctgtgatatggtatctatacctgtatttccttagctatatatcgaagttgaatatgttctgttccagctgatagctgcctgattctccagctttggtcgatcgtgagttgtcaacaaaggtaaccgatcaatgatcatacagagaaactaaaaccatgtttatgttccaacagcatcggttcgtgaaagaaaaaaagaactataacacggtaccgtagaatatggaataaactccttcagccctaatggccttagctttctctaactccgttttatgctgttatatatttgggaaaagaatacatgaatacattcggttgttacttgttaaatgtttggtatcatatgcttttgttctctctttgcccatctgtccggctggtaacctctgttgacagtttcatgcatgtaactcttgatgctcgcatgcccatttacttgttgaaattaaagtacactaaaccaaacatcacaacatgaattaactaggcgttagccaaataccaacttagcataccggtaccaggatgatagaatatttgtattaacttagaattctgatcatgcatgcgcactgctcatctatctcttgttgaaagaaatagggggtccaaaaatgttcgtcagtcagttccatattagccactgtgttcgatgtacaaatatcgaggttgaacttaccaggtgctgggagttccacaatagctacagctaatgcacgaagaacaatttttggtgcatgcataagggccactgcagccgaaaggaatgaagaactaggatacctggaaacaactctgttattttctcatctgtgtcaaaagattcgctgggggtcctccagatccagcagagccactcccagcaaatgccgagaagccagacccttgattaccaccaaaagctccaaatccaccttccaattcaaccaaatggagttaattctcagaaaaatggagatggagttaacagattctaagcaaaaaaataagtgtgagatatgtgcattaaagctttagtagctgtggagcaaattggatagaatttactattaagtcacatttgtccagacggtcaaactgcttgtaccaaatacattattttcaattaaaaggaataccttgatttttaatcctttttgccagtaaagaatggttaggcatatatcatttgccaaaaccatacgagaacttagaagttacaaatgacaacactatatttaagttatgaaatagattggaaaagatggttaggcaaaatgatcaatgattactcgatcaataatggataaatccattatatgctatagagctaagtaaatcatggtatgcagaacagcttatgacttaccgattgaaaactagctgtgaatgaacttaaattagcacgctactgctagagcaaataccaaacactattattcacaaggaaaataaaagtaacgcatttatgtaaaatagacctaatagagcagccttaccaaagtcaaaaacagactgctcatgttcctaatatggaaatttagttccacatttggttatatgctagcagttcaagtttaaagaatagttggggagtggcaggctttctaaatttcacaacattgtcacaatatatatcaatcaacaagatcaagttgataatcaccggttcgataattaactactattctaggacatgtctcaaacacaaagatgtggacacatctaaccatgaacatgttgatgtaggctacatcatcatgatctcaaagacgaaaacagcaaaaatccagagagctcaccactgctgaagccacttccctgggctgcacctccaaagccgccaccagatgaagccgcagccgcaaaacccccacctttggaggcaagagcagcaaaccctccaccagtagcagcagcagcaaatcctccgccagcaggagcagcagctgcagaaaagccaccgcctgttgcaccaccagcaaatccagaattgctagaaaagcccccggaagcagaggcactagcgaatccaccaaatcccccagcaccgaaacttcccaattggcgtgattgtccaaaagaacccaggacagatccaagtgcttgctgagcaccaaattgtgcaggctgcccaaatcctgactgctgtgctgtcccaatttgtgcaggctgcccaaatcctgactgttgcgcaactccaacttgtgctggttggccaaatcctgactgaatttgtgctggctgaccaaatcctgcctgctgcccagctccaatttgtgaaggctgcccaaaccctgactgctgcgctgatccaatctgtgcagactgtccgaatccactaagcccacttgagaatgcactagaaaatgtacttgagctagttgattgagatgactgtgctggctgagatgagggaatactcagtgacgccggacggaaaagctgtcctggactggttgtcagggtaaatgacgaacctgaactcttattgtcagaggtagtaaatgagttcccaaagggattggattttgggggacttgaagaaggcacagacccaagaccaaacccaccaagggctcccaagttgagatccgaacttgcagaaggaacttcctcttccatatcatcttcatctgatgagggattgctcggtcctacatcttttccggtggaagtgacaacaacagattctgcagacactggcaccactttaggtgcagagacaggaattgaaggtaagcttccactggttgctggaatcgatgaaggtttgccttcagtgattggtacgcttgagctagtacttgcagaaacggttgttccagttacctctgatgtaaccacttcaggcttagatacaattttattcaagccagttgatgactccttaacaggcattggaatagatagtagggaactagatatggtaccatcaggtaatggtgatgaaggttttgtcattgattcctttgatggaagaatggaaggacctgttggagacaaaacatctgatgtttttgcagctgattcttgcatagttgacgaggatgatgtagctgaagagggaacagttggcttaatagagcatggagaagattgtgcaacaggtgttggtggaaatgcaggaggttggaatgccacctcaggtttagctttcactgggctctgcactgtttcagtaatcttaccaagttgcacagtcttcccttgtaacagagcagacttgggaggttcaggagacaaagacggtttgttaagatctctaaatgcaccacccatattctgtggagaaacatccagtccttttgtggttcccaaatatggcattgcctgtccaccttgtttgttctttgtaataatggatgacgcacctccagaatccccagataaagttttcacggtcaatggactcagagagaattttgagcccgtcatcaaaggcgacaaatctgggagtgtactggtattagtttttggaatgacagtggttttaaatgtcaaagtacttgactttggcatggtatgagttgttccagaggatggaacattggatgagctgatattatcccagacatccttatgtgaataactgaatgacaacggtgaagatgagcccaactttggtgtctggtcagaacttttcagctgccctggtaattcaggatacttatgctgagggccttgagatggtccagccgattcctttacccatttgaacagtgtgttgtgctggggtcctgacggctttgttttctcgtgcagcactgtaaaaatgattcaataagaaagttgtacccaactctataatcaaactttcttaaaataatgaaatttctactgaagaattgttaaatagcttaccttcacttggataatgcagcttgtttgcatatgattctactatggaggaagtggggctactgctggacttctcctgggacatagctgccatctgagaatcaaatattttcttatttgacctgaatggcaggtcactgctgatcttgaggcgctgttgttgcgctattcttttaacagtagttttctgaggctccaaactagccaggctctaagaaattgacaagtattttgtggttagatttgcagccaattcaccatacatagagcaacaagaaaatacgatgagaatgtgccaaaagaaaagaagtgcagaaagaagtgataaaatggaacagaaagatccacatttcttccctcaatcatgtgcataatgcatatatatgcaaagtttgggtctgggttaaaaaatttaccctatccagtgactctctcctcctccttgcagtctcaggctcagcagtcttggaaggccctgatatgctagttatgtgttctctcgttgatggatatctcttaactgacttggaaggagtaccacctgaaaatttggctgcatccatcgtgtgatctagaccaatcgattcaaacaactctttggccactgaccctcgctttgtagaaggagaacttatatttagtgcagatatttgttttgagaggcagtctgacagttgttcagctgctgctaattgtgaattaagcgcattgtaaacactggatatttgtgtctgactgcacaataagaagataaaaatcagataagaaactcacatacatcgatttatatttgaaaacaaaaaaaaagattaaagtattcttttcagaataaacagtttcttattaccatcaccatcccaaaataacttcatctttgcctatctcacacataccaatacaaaagccaaaagactaggatacccatcactttttcaaactccaatgcatttatccccaacttcctcaaactccaatgcaatgattgctctaaagttgaagcatttgtgggacaaatgaattaggtaaagtcgtaaagatgaagttattttggaacggagggagtactaagaaagagtaaagaacagtttataattttgtcattatgatgtggtaaaagtcgtaaaagcgactttagagatatgttaatgtgtgagaacaaaatcaaagaggtatgaacaagctaacagcatatgtacaagctactacatgcatctgtaccaagatagtttctgctcaccctgatcacatagcaagctagcaaagcaattggttactttgaaaattcagaaaaataattggatattgatcaagtttggtacaccatccatttaatgatatgactaaacacacaggaattgctcgtgaggtgtagtattgagtacctggatcgtgccttactagaataaatagctctgcgactagaagcaactcttcctgtttctccaaatttgttcatctccagattattgaaatgcctctccagctctaccagctggtttgtcaaattctgtatgacaaaagaaccacgaattacaaattaggctgttgatgttattttccttaaaaaaaagaacataaagggtcagattgtacctggttagccttgagaatattctgcctcttcgcttcgaattctggactcaatttctgacggttccatatatcccagtattgggtatctgaagattggtcgacgattcctttcatgtaagcttgcctagcagagactgtagagaaacagaaataagtttcttatttagtgtgctaaccaaaatttaatttacccagatagcagatgcaggctaagtgtggcgtccacttcttgcctagaaggccaggaacactttaaaccctttaatttccaattgagatataaaacattgacatcagtagaaaaggagaaaccgacaaatccaagctcaagtcatgatgggtaaaactcctttgtcatgtcacaaccatatcattcacttggaaggctttttcaaacccacaaagtcgaggaactaaaaacagaccaggtctagcatacactcaagttaagggcaagcaatcagcattccgctttctgggtttcctcaatccttatatatggaatgcacaaaagcattgccaaaacaacaaatttgaaataaatacaaacataaaatgccatccccactctccacaattgcaatgttgacaaaatgttaaaatagcagcagagcaaaccagttcttcaaacctaaccctggcctgacgaattgtttttatttttttttcaatatatataaatgtgcagtaggcatgtattaggaactactccctctgtcccagaataagttaatctagtactaggatgtgttacatccagcacttgattaacttattctgggacagaggaagtatgaagtaaccaaagtaatgacagtcatcaattgatggaaatatcagagatgatcgatatatcaattttcattttttttcccaaacgcaaagagagaatgttggtattggatgaccaacaatatcaactaccaaaacaacggcaccaaaccaggtgtggataaaacttagctaattatctgtaagcactatgaagatacatataacctatatttctttcaggcatatattgaagtactagatgtagtgtgtctattggcaaaaagaaataaccacgagtagtagacgtgccttgaaacatcttattccgcaggtcttcaactcttgaacactgttctgctatcttgttctggagatcaaaaataagaaggaatttctttagcaggttaaaggcagaactggaagataagaaaggtaaaggagaccaaaaaaaaatgtgtggtgaaaattagtataataccttgaagatctgcaacagttccagaaaattttgcaaatcaccctcaaacatagaaagaggccgttcctggaaggttatgcaagcatctctgaaaccaccatccttctctatgtatgataggagtgtatctaactccttggtcatatcattaatctgtttaacaaaagggtaagaaatttactagttgaaataaagataacaaaaggtagacccaaattccaatatttaaaatattcactctgtttaaggacatgtttcatacagtattgcacaacagttgaggtgaataagatattagcatgaaaacaattgaaagagtagagagatgaaataaaacaggaaccgagcatgagtgcagaagaacataattatctatatttataccctatcctaaggagatttaatatggcaaattgaactgaaaaggttcaaaacatcatttccgaagacaatattcaggaaaattaattacatgctgaatcataaaaaacagaccaaactgaggcattggtagtaaaaaaacattataatcaaatgtttttgttgatcttacactgtaaaattttttagacaggtcctgttcagtatcgaacattgcgcctaacttgaaatttttagaatggtccactactgcatgtgttctgtcatgtggtttgtcaatgctttcctgtggtagaggtgatccacgggaggtaggaaatgcctcaagatttcctgtgcgaaagccagtggatgaaggtccagctgaggaaggttttattggagaaattgatggtgatgacttggaacttaagccaactgaactaggaactttcttatcggtagtgtagctgctttgcagcgggtgacttccaaaaccaggttcattcctttctccaggcttaaccagggtagatccatcagaagtgaacactgatgatttattaaagctaaggttaccatctttctttgagttctgagatcctccaaatgctcccaccggctgagtggaaggtatgcttcctttaccaagttggttatttacgaaattgctactgctgctttgttgccaggaagaacctaattcactagatgtgttgcttccagctggactcaaactgacgctattagcagtagaaaagctgaaagatattccaggtttcaagttgcttgctggtgctaagaaagaggcaggtgcaggtgaggaagccactatttccttggcttttgaaactggagaactgtttttcatatctgttgatccatgcaggtctctatctgcaagatacaaaaggaagaattattaagtctccaaagaacttggaaacctaacaaacaacccctcaaagataaagtaactgccgcataacagtccttttacctggttgtacactagaaagctcagccccatctgggcgaatactcttgtccaatgagctggtagcacttggagtaaactcttttccagatacagttacaggtgaaatttctttcatcacatcgctatcttcaatagcagatagctttgtttgaggtaattcagaaggatcagaaatcctaggtaagagaccagtggcaacacattagtttttctttcccaaacaaaggttagtacacagacgctatagcaagtaataaacagaccatatttttgtttgtgatttggcactggcaaacagaggttgactacctggcaagataatatatattcagtttcccttcaccagtcagataaagtagaatatgttgaggagcaacctccttttgttcaggaccaactgttactgtgatcttctgaaataatgacacattctcgacaccaaaccccaatatgacattgtcatcaccattctctgaaatggtagattagagtagagaaacccaagtttagactttattcacagagaaacagtctgctctagttgcggctgaattatgtcttaccttgtaggtcaatcctaggactatatttatcctccaacatctcaagatatactacagtttttttgtcatcagttgcagatgaccacttcaagagagaaatgtgttcatcaatgctctttttgttggaagtcaccattagatccctgtcaaattacaatcacagctaacaaatgttggaaaaaaatataagtaaaaataaatgcaatattaccacattgatgctaattggcagaactaagaagatactaatgccccaatctaaggtcagaaataacatagccaattagaaaagttgcattgtgcaagtttagtccgtatagcttaaaatttcagcacatatactattttacttcatgctatggacaaaataacatgaaatccacctattaaactctcaggaggtgacaaaagaacagaaatgtttagttaaataaatactttgatcaagtatttacttgctcacaacatgaacatttctgttggactcttagaagtataacaaaaaaaa

SEQ ID NO: 16726 - DNA, 12271 bp, Oryza sativa
  unsure (1)..(12271): unsure at all n locations
cttcagaaggctagtttcataataaaaactactacctctgtgccataatacaactacttttgccatttcttgaggggattaaggttgaagagagaaatggttgtgattggttgagatgagggagtaggtgaagaaattaaaattgggatggttgtgattggttgaggtggggaagtaggcgactaggcggagaagtagtagtattttgggacaaatgtcaaatgccaaaggtagttgtaacattggatgaagggagtaccaagttcaaatcatagaaagtatcaatatacagccaattcataacagctcaaaagcctcttaaattttggccagtagacacggtatggatcaaaggattcatccactgaattaatgccaaggattatgtagcatttcaatatattagcacaactcatacatatatgagcacacaagtatgcagatgcacgtggttatgacagaatgatggagatgaaggctacaacattcagaaaatggtgatgagttgttcctctcaaaccgctcctctcttctttgaagacataatttccatttgctgaaatatatacaaatattgccatcacagcaatatgaaaatatgcgtaaaactaaatccttgattatttaaggtagcttgtttcatacaagcatatgataaaaaggaaacatcgttttctaaaaaaataaaaaataaatttcatgatatataatctacacagcagaagcaactggaactaaacgacagactaacctcaaaaaatgtatttccgccgcttcttattacttggacaagataaccctcttcattgccttcttcattcaatcttacagaaccaacaacaatactgtcatcgcgcacccacccaatcgaatccactgataaaaagaaaacattaataacaaatcaaaatgatcacctacttaacacagtccaatgcatttgactgtgtgcctgcaatgatggcaatagaataataaaaaaatgaataagatgaccttgaggaaaagagcataaacttcatagagcatggaacaaatcttgaaacccatgttcaccccattagtcatttttattctataagtggcgatcatatttgtgggttgtgtttttctcacatatttttggaaaataagaaacgggtatgtttagcatgtctgtgtactgtgacgctaagagtaacaaaccatgtgctgctcatgaagtttaggcctgagtaacaagcttacttgtttcatttaccacagaatagaaaacaattttacgagttttacgcactaggacgtagtgagccaatcaatatgtcctagtgtgtaatagtgctaatagtgctaccaaattaagcctggtgatgattgtatctgttctaatagtgctaccataaaccatttcgtttaaaaatgtgtgaataataataactgcgaagaacttggagcaattcaataattcatcctgtaactggggaatggagatacaggccacaaaagaaaaactgaatggtgcttacctttgatgctagcatcatctgaatcactatcatcagaccatagctggaacaagaggggcatgcaacatatttccttaaaatctgatgataatatgttaagtgtattcttttttgaaagaacaatgtgagtcccttccttgcagcagtcaactgtatacatttcaaaacgatgggagaattcagttcagaaactagtatggtggtgatggttaacttcaattacaacaatgaatcattgatcaagaaatatgctatgctagcacataatggccaaggagtgtgctaatgactaaaggcaggaatgcgccaaagataagtactcaatatggcatcatcctttttatacagcccacaacaaaaatcaatctagtttgtctagctgtcttctgtaaagactaagcattatagaaaaaagatgactcatagaaacaaagatctgtcgaatgaacttgcaatacccacagagagatatatgttgcaaatgaacgatgttcttgtaattttcattcacaataatataggctatagcatcaataaattaatggttcttaccatctatgatccaaatatataccatttacaaaccaatgcatgtttaacaactgtacagatgcatttctaaaacaaaactacaaaaaggatcctagaacatgatctcctatccaaaacagtaacacgacgaaataaggttttcaagtattgaacttcacaacagccaataacaaataaaatttactttataaggtgtgaatattgaatatttgaaatatattggtgtatgctatatctcacatctgcttcaagaaagtttcactggaatttgtaacagttagtcattgcataacattgtgcctcaaatttattaggaatagaagaagccacaaaccagcatcaacattttccattatgtccttcagaccttcccccagacttccttgagacagcaacccgtctttcgagagtacaataaaggctttggaagcatgatttagccacttgaaatctttcacagtgctggatccttccaaggtacatgatgacagtggttccacatcctatgtagcataattgtgaatagcatgagtagaagatacatgagcaaaattactagatgtataagagatccacgaggtcaaagtgcaaatagacatgggatactgaaaacattcactgactataggtcattatcgcataaacatttctgtcagatattgttatgtaaaatgcagctcagtaggatatatattaaaaaaaacaattctccggttctaataagttgtgctggccctgtggttgaaatttatcatcgacatgagggaaggagatgagataaccttgtctgtgagcagggaagaagccgagaagaagtggatcacactgcctgcgcaggcagcaagcaccgattcatcacgggagagttcgaggagagagaccccggggagagggatgtccgcgacgcagcagtcccgtgcgcagcgggtggtcgacttgcccttctcgcgcgcctccttgctggcctcgatcaacgccttggtcgtcgcagccataaaccctggaaacacgaggggaaacccgaagcggtgagatcgagatgggaatgccctggtccgtcgcgacttctccgtggcttaccgttggggtgggcaaggaagaccgcggcccggcggttggagacggcgagcgggcgcgagggaggcgactggaggtcgaagagcgggagcggcgaggaggtggtagggaggagggggatggggtcgccggcgaggcggaagacgaagtcggtggtgccgtcctcctcgcccttgacctcgtcggagaggtccagctcccgcggcggcgccatggccccccaccggtggtcggaggagcctagggttttgggcgggaagcgggacggagacggcgcggcggcgagggagcaatagcaaatggggtttcgtgaagcgagagcgctagtagcggaggccttggcgtggagtgtaagcagagcccagcagcgtggccggcgggcgggcgcacgcggcggaggggagagggagaggcggaggcggccgcttcgcttgccggcggtgatggtggtggcgctgaatacatgggctcttgtcgttgccccgtgggcttaattgggccttctactgggccgtcacatatattaatttggacttctttttattgggcttgaccttgacggtgagtaagaacagaaggcgcatgannnnnnnnnnnnnnnnnnnnaggcgagaaaattccggcgatgtcgcgacggtgacacggcgaccgaacacaaagatatcgccggcaaactcacgcaagcaccgcgcgaccgacgaacggcaggcggaaccgcgcgaacagtcgctgcttccttttcgtctccacctagcgacgtggagcaacgccatacacacgctcccatccgcacgcgcatttccagccttactactctctcgcaccatcgtcttccatccgcccatctacctccctcctccgtccaccctaactacggcgggtcgccggccatgctcgcgttcgcggtcatcgtctcgccttccgcgtggccgagagccgtctcctcagctttcgcggcggccgtcttcgcgttcctggacgtcgtcgacgtgctcctctgcttcgtgtacggcttcctcgacgccgtcttcgaggacagcccggtcagctgctactgccacgggagccacagcgcggcggcgctggacgacgacgacgaggtctccgacacattgtaccaccggcggagcgctctccgagacgcgctgatggggctcgtcagaggcaggagcggcggctcgccggagacggagacggagcggcgcaaggggcggagcccgaggtggtcggactgcggctgcgattcgtgccgcgcatggcagcgccacgacgacggccggctgcacttcgtcgccaaccaaccgccgccgccgccaaacggtctcaaccgcttccgttatttctgttacaatcctttcgctttgccgtgtcggcgacattaacgttcgcgagcttagcttttgcagatggagcagtgacaacgacgcagcagagtggagaagaagacgccatcttcatccacggcttcacctcgtcatcgtcgttctgggcaacagtgttccgcgaatcatccatcctcaacaactgcagaatgttggcggtcgatctcctcggcttcggcaagtctcccaagccggcaaactgcatgtacagactgaaagatcacgtcgagatgatcgagcggagcctcatcgatccactcaacctgagctccttccatcttgtcagccactccatgggctgcatcatcgccctcgcattggctgccaagcacccagaacgagtcagatcaatcacactgattgcaccggtaagtacagtacatatatatctgaagaagaatcagtgagagctctgaatttaattaaggaaatatcgatccgttgctttggttgtagccgtacttcggagcatgcgaagagaaggcgagccaagtggcactgaagagactggcggagaagaagctgtggccgccattgcagttcggatccgcagtgatgtcatggtacgagcacattgggaggactgtctgcttcttggtctgcaaaaatcacctgctctgggagcgcctcttcaggctcatcacaggaaagaggtaatcacatactaggattaattcagagttcagaaaacaaagctccttttaactaagattgattttaaacaaaaaaaaatgttgttgcatgctgcagggatgtggactttctgctgggtgatctgacgaagcacacgcaccactcggcgtggcacacgatgcacaacgtcatctgcggtggggccatgctgcaggacaggaacctggaggccgtcgaggcggccggcgtcccggtgcaggtgatccacggcggcgacgatcaggtggttccggcggagtgcggccgccacctcaaggccaagcttcccggcgccgagctccgactcatggaaggctgcgaccacaagacggtggttttcggcagggagaggggatttgctgaggagctcagagcattctggtccgcgtctcatcagaataagcagctagcagcatctgcatcagggtgggcaggttaacggatgttgattgttggtgtgtagaataatgtctgatatgaaatcatgatgtagcatagagaaattcagtccacactttgaaattactggtactacaatttttagagattaaagactagggtgaatccatcgacacgtttctttcgtcagaacagtgtccgtatattggaaaatccttttctagctcgtggattggcagattaatctttgaatttgcaaaggggacttgactgtttcagatataagcactcactcttgttttcatattataaatcataatataagtcggttttattttttttctattcaaattttatttaagtttaaccaagtttatagaaacaataccaaatgatttaatatttttttgatagtatatttgttttgtgttaaaaagaagttactatatctttctacaaatttagacaaacctaataaaaattgactagaaaaaaaagtaaaacaaattataatatgaaactgagggagttgatactatcgacgacatgaagtttggcctgacaaatgttcatacccccatgtggctgttaactgggagatatagattcctttcccgattgatcaaagcgcacagaaattaagtcgtgcatatagttcagctacatttattctccgatcgctttcatagcttttccttttctcatcgatcgagctgattgctgcttcgcgtacgcgcctagaaatacagcacgccccgtcgacccggggggttgcagatcgatcggaagctcaaacgcacgctagctactgcaggcacaccaagctgacgaacgacaacatgagcaccaccggaagggctctcctcgtcgctctcgccgccgttcttctcgtcaccggcgacgcactcctcgctcccgccggtggccaggagcagtacaccaaggcgccggcggaagcgcacaaaggctacagcatcgtgcctggtgagcatgcaattgaatccatcctagctatactcaaactcccaatgttatcaacttatcatgtgatgatgatcgtcatcgtatatcgtatatactgggccacgagaaatattgcataatgggcccttacagatcgcattacgggggcaggatgtcaaggcccatgaccacgagaaatttagcatactgggccgttgcagacctagctggtagcccatgccaagaaatcagtcctcgttagttttgtaccacatcgcctaccagagaggatagggagagcacccagggtataagaagaggggttcagcttcgtaccaactcatacctttctcggccttttggctaagatcaagtgtagtatctgttcttatcagtttaatatctgatatgtgggccatgtgcccacttcgatattaaatttattttttatgggggagggtccaccatagtggcttgccactggggccctcgcgtgtcgcccaggcgttgcactgcagcctgggcctggcgcaccccaaccaagtctcaacttaaatttttaattttgtttacaaaatctaatctaagttttaaatttatttttaccaaagctcaatcgaagttttaaatatttttacttcattatttcttcatgctcattcaggcttggtttcagcccaggaatgcaactattttgaatcgacccaaattccttcaattcgtaaattcctgcatcaatatgatcccttaggaattcgatttgtatttctcatcactgtacatatgatggctgtatgaataatctgacagcctgaatatgaactaggttcagtgatactagagatcgcttggatgagttgggtggccgacaagtgttatcctccaacctgtcgccgttactgttcagagaggataataacaaacgagtactattgtagcatagtcacccagattcctagcgtttatacgtactacagaacgtataatatccggcctgttgcttccctcaacagagaacatgaaaggcacatgatagttcagcgttgctgataaaaagagcacgaagattgaaggacacgacgtaacataggcaagcacaactggttcaatacttacttcagattgttagatttgcctttccatgccatgatgtagtactaggccatcacttcctttaaaaagttcagaacttaacctctgctaaagagaagaaagggaagacagataagttcagcaatcagcattcctgttgctagatactagtagagtacaaaactgcatgcatacaatttcatgattaccatatctaagtctggtaactgttcaagacttgaagtgtttatcattccttttgctaccaacaaagagaatttgaggccgtcttgcgatatgtacgattggtacgtactcggtactctctctgaatgttgagcaagcaatgagcacacacacacacgatgacacgagacatctgaaaattggcacttcgagacttgtacagtagcagtaacagtagtagtaccaatccgatgttgagatggattgggtgcaaacgcatgcaggaaccaaatgaggccccaacacctgtatcatatccacgatctccatctccatccatgttccccagtactgcaaatattgcgccagccactgtatgatatacatgcagggggatctatctatatccacagtgttgagagcacccaccaatcgcaggcacgagacgtgtaatcctgtcgagccaagggaccacccacgagcggcagatcagagaatttcactattgcagcggctccatctccatactgcagtcgatcgatcgatcgccgactcgccgtcgccgtcgatgttgctgtcagccgccgaccggcaggcagccgctctcgatccctctctgagaaagtcgagtctgaatttcttcgctggccacacttggcgcgcagctgcgtgcgtcgtactcgctcactgtcctctcctctcctcgcgttgatgccgtgtcctacatactgctagctatcaaaagcagcctcctccattatttttgtgtagctgaaggtggagagaacgttccttcttgaggccttttgttttgttttggccacgagttttccatgcgtttgtcaacttgtcctcccctatttattcctgcagaattcgacgtgtgaggtttttggtcgggagttactactagccaccagtatttcttcactctgaaaatagtaggagtattttttttctagtatatcttcttcttcagattcagcaaaacggctaaggaattcctttcggttggtttcttcaattgactatactttttagttatgaggttactgtcagtttctttgagtctcatctgaagactggaagggtttcagataaaataaacagccatccccatatgttttaaaacagctgtatattagttctactttaatgagtgattattccgcttttgttcttcctcctaccgatttcataattaaacattgaccaaaagtagaggattattggtgaaccataccatgggaatgttaaattatctctagtcacactagccatttttttaatcctgtaaacggctgaaggcatatgttaatcacaaaccaaatcgtgtacataaaaaaattgcaaggacctattttttaagagtcagattaggtagatctcaagaatgatttggagccgacagggcccagatttggtggcatcagcatggtagcttatactcctaaatccatagctcacaactggctcgaatgttcatcggagaggcatcttaattcattcagttataagtgttccctcccctgtttcaaccatagcatctgattaaaaatcttcagacatttttaagcccatttcgagacaattaagccactaaaatcagttatgctacatttccaaaaaaaaaaaagaacctcagttaccttgagccgagtgcaccatgtgctgtattgccgtgtccgtcaggtaaacagtccttatcatgactcaacagttcatagctcctacatgaccatgatatgctcatcgaggattacgagcatgtgagtgaggggtcaccgaatgaatcaaagaaaaagggacaagatgatggatcgatggatgtatcgccaccagcaccggcaccaagctgcagcagatcgagtaaagcacaagattgttttttttttttaattttaacgcaaggaaagactgttgaaagagcctttgtgctcatgaaagggcaacatcacttttctagataagggaaagacaccttttattataaaaaaatattgcaaaaaaatgtttttttatttttaaaaaaggatctttgagctgctggacgagcaaatttgaccttgttcatggagagaaaccgtgcgtatgcatgtcttggcttaatttgcatttcgtgtccatatcgatcgatcagaagatcacgagaagtagctcacgtagtacatctagatcgtcctatcgagtacacgagcagcaccacgacaaagaaaaaaaaaatcaaacatggaaatttccataaagaggtttgatggcgtgaaccgttttgcagagccaactgtgttttgcaagcttgcatagcatggatctacactgaaaaattattaaccaataattcttacaagcacactgaaaattaatcaggcttatgagctcctctaatcccctacagctacaagctactgatcgaatcgaactaggggtggtgattcttttggttcccattcgattcgaattcgtttcagtagaaccagttggatccggcgtacttcgccggcggttgctgcatggcgccgccgtagtccacggcgccccctcctgtcacgttgaaatttgaactgaacctgaactccggcgccgccgccgccgtggcggcgacgtcgcctccgaacggcgcgtcgtcgcggatgaagaaattagcctgctgctgctgatggtggtggtggtgcatctgcgtggcggcggcgacgtcgttgtcgtacatggtcatcagcccggcgaggcatctctggccgtcgacggggaggtcgaagtcgaagctgccgagtggctcgaagatgtgcggcggcggcggcttgctctcggcggcggcggcggcggcgttgtgcttgcaggcgtactgatgggcgttgcgttcgttgcggtcgaggaagccgagcgcgtagttgctgtgcgggcactgcacgttgccgcaggtgtagacgcgggcatggctgtcgctgctcagcatcagctccggctcgctcctcttctggatgaagtcgacgtcgatggcctcttccttcatcagcggcatgatcaggaacttgttgttgctcacagcagcatccatggtggtggtgaggtccatgaacgcggtcgcgtcgttctgcgccttctgcaggttgttgttcccggcctcgtcgccgtcgactccttcgacgtcgtactcgccgaagacgctggcgttgaaggacgcggcggaaagcggcggggggagggcgccgggatggagctgagatagaggtcctcctcctgcttgaggacggcgagccaggtgacgatctccttggcggtcatcttgtcctggaggcacttggactgacgcacgaggcggcggaccttgtcgacgtcgggggacatgtgcttgatgacggcggtgagcacggcgaccttccacgccttcttgaggtcgtgcggcttcttgtacggcggcgggccgagctccttgggcacgccggcctcgggccaccacgcctcgctcccctccggccaccacggcggcggcacgcccttctccagcgggaagcggcgctgcggcgggtcgcagtgctgcatgagcgccgagagcagcgatcccagcgtggtgtcctgcagctcgtgcagggagtgcggccccgccggcgcggcgccgccggcgtcgccgtcgcaccccggcacggcgttgtcggcctggtacttggcgatggcggccgggccattgcggtcgaagcggaccttctccttccaccatgagcggaggttgtcggaggcgccgctcaccggcttccccttctccgggatgatgccgtacacgaacccctgcgcgttgcacacctccatcatcttgagcatgtacttgaggatcccgtcctgcgcccgcgacatcttcttccgccgcgcctgctcctgcgactgccgctgctgcctgcctccgccgccggcgtcgcccgcccggctctccctcccggcgcggctctgctgaagctccttgagccgcttgtgccggacgcggtcgcgccacatgcggcgctccagctcctcgatgtcgtccacgtcgtcgtcgtcgtcgtcgtcgtcgtcgccgtcgctctcgtcctcggcggcgaatccgccctcgtgcacctgctgctgctgcggcggcggcggcgccgggttgaccaggtcgccctcgccgacgaagcactcgcctccgaagaatccaaaggcggccttgctatcaacgtcggcctccgccgcgaacgccatgcgccgatccaccatggtcaccgctgctcccatcatctcctcgatcgtagcacagactgacttaatagcagcagcagagcagtagctatctatagatccacctgcacgtaagccgacctcgaattagttttttttccccatagtaattactttgctgatcaatgatcatnnnnnnnnnnnnnnnnnnnnnnnnnnnnnnnnnnnnnnnnnnnnnnnnnnnnnnnnnnnnnnnnn

SEQ ID NO: 16727 - DNA, 873 bp, Oryza sativa
taatggcgatttgaccgccattaaccgcgctgatgatgggggcgcctagggcgcgaaaatcagggggtcgacctggccatgcccagaatcgtcacccatgccgcctggactcccctacctgccaggcatgcgatgggaccgacggcgggcccgcctaatcgcgcccgtgaacatcgcacgccccgcgccgagtgtgccgctgacaggcgcactaaacgcggggcgtgggttcaatgggcgatgtgatgagtggacgcgagaaacgatgaggcaaccgcaggtgtaggaatcgaggaggcaaccgcgagggcgtgaaacgaggaggcgagcgcggtcgaggcggggataaaaggatagggaggcggagatttcgtccccttcctctcgccgactgctcgcccgcacactcgctcctcaagccctaacgcttctctcgctccacgctattccgtacaccaaactcctcgccgtttccccgccggtcatcatggcccaagacgctagtgacgttgtgctcccggtgtcgcgcatcacggcagagaggcaccttagcctcatccgcaagatcatgccggaggacgccgccatgatggtgggggagtcacggccgcggccgcggtacccagagcgatccgtgcacctcctgtccttcgccatggtggggttgatcctgccattctccaggttcttccataaggttttggatttctacgaaattcatgccttgcatctcacacccaacgccgtgatgacactggccatcttcgcgcacttgtgcgagatgttcgtcggggtgcggccgacgatgcggctgttccagtccttcttcgtcccacagctgctgcaaggcgcggtggtgggaggatgctactt

SEQ ID NO: 16728 - DNA, 407 bp, Oryza sativa
atctcctgaaatgagaaattgctggatcctctcagtccgtaattgattatcgttgtttaaacagcattgcaagttgaaatcaacacgccgcggcaaccatcctatcccctgaaatgcagcaagcacgccatgttttcccgtggcagggaaaggcagtatccaagaagccccaggatcaagaacccccaaacagacacgcaacgaagatccagccctctcacagcaccggatcacgcgattccaccccaccgacgacgactcccttgctgtgagaggagatcctagtagtagaaagaaaccgcaagaaccccaagaatggcggacctggtggatgggcgggtacatggagttggtgcaaacggggcactcgagcagctcgtggacgctcgtcgccggggggacggcgg
